(12) United States Patent
Guggisberg et al.

(10) Patent No.: US 12,376,589 B2
(45) Date of Patent: Aug. 5, 2025

(54) CHRYSEOBACTERIUM INSECT INHIBITORY MICROBIAL COMPOSITIONS AND METHODS OF MAKING AND USING

(71) Applicant: Pluton Biosciences, Inc., St. Louis, MO (US)

(72) Inventors: Ann M. Guggisberg, St. Louis, MO (US); Diana L. Beckman, St. Louis, MO (US); Boahemaa Adu-Oppong, St. Louis, MO (US); Barry S. Goldman, St. Louis, MO (US); Philip A. Ruzycki, St. Louis, MO (US); Thomas Malvar, North Stonington, CT (US); Kirk D. Narzinski, Columbia, IL (US); Farhan James William, St. Louis, MO (US); Steven C. Slater, Bainbridge Island, WA (US); Ashootosh Tripathi, Ann Arbor, MI (US); Osama Gomaa Mahmoud Mohamed, Ann Arbor, MI (US); Pamela J. Schultz, Ann Arbor, MI (US)

(73) Assignee: Pluton Biosciences, Inc., St. Louis, MO (US)

( * ) Notice: Subject to any disclaimer, the term of this patent is extended or adjusted under 35 U.S.C. 154(b) by 115 days.

(21) Appl. No.: 17/724,078

(22) Filed: Apr. 19, 2022

(65) Prior Publication Data
US 2022/0369635 A1 Nov. 24, 2022

Related U.S. Application Data

(60) Provisional application No. 63/188,961, filed on May 14, 2021.

(51) Int. Cl.
*A01N 43/38* (2006.01)
*C12N 1/20* (2006.01)

(52) U.S. Cl.
CPC .............. *A01N 43/38* (2013.01); *C12N 1/20* (2013.01)

(58) Field of Classification Search
CPC ........ A01N 25/34; A01N 25/10; A01N 43/22; A01P 7/04
See application file for complete search history.

(56) References Cited

U.S. PATENT DOCUMENTS

| | | |
|---|---|---|
| 5,695,934 A | 12/1997 | Brenner |
| 5,714,330 A | 2/1998 | Brenner et al. |
| 5,743,477 A | 4/1998 | Walsh et al. |
| 5,750,341 A | 5/1998 | Macevicz |
| 6,052,943 A * | 4/2000 | Hoffmann .......... A01G 13/0256 47/58.1 R |
| 6,306,597 B1 | 10/2001 | Macevicz |
| 6,432,360 B1 | 8/2002 | Church |
| 6,485,944 B1 | 11/2002 | Church et al. |
| 6,511,803 B1 | 1/2003 | Church et al. |
| 6,787,308 B2 | 9/2004 | Balasubramanian et al. |
| 6,833,246 B2 | 12/2004 | Balasubramanian |
| 2005/0130173 A1 | 6/2005 | Leamon et al. |
| 2006/0073161 A1 | 4/2006 | Breton |
| 2012/0100236 A1* | 4/2012 | Asolkar ............... C07K 5/0205 530/323 |
| 2014/0088167 A1* | 3/2014 | Heil ..................... C07D 209/42 548/492 |
| 2018/0049435 A1 | 2/2018 | Sikuljak et al. |
| 2018/0222861 A1 | 8/2018 | Tang et al. |
| 2019/0223441 A1 | 7/2019 | Hoffman et al. |
| 2019/0382714 A1 | 12/2019 | Wigley et al. |
| 2022/0369635 A1 | 11/2022 | Guggisberg et al. |
| 2023/0220410 A1* | 7/2023 | Chamovitz ............ A01N 37/46 800/279 |

FOREIGN PATENT DOCUMENTS

| | | |
|---|---|---|
| WO | WO 00/018957 | 4/2000 |
| WO | WO 2006/084132 | 8/2006 |
| WO | WO 2019/211850 | 11/2019 |
| WO | WO-2020183022 A1 | 9/2020 |

OTHER PUBLICATIONS

NPIC—National Pesticide Information Center (www.npic.orst.edu/pest/select.html; published Jul. 8, 2021) (Year: 2021).*
International Search Report and Written Opinion for PCT/US2022/025342. Mailed Sep. 21, 2022. 15 pages.
Abbott. A method of computing the effectiveness of an insecticide. 1925. J Am Mosq Control Assoc. Jun. 1987;3(2):302-3.
Adessi et al., Solid phase DNA amplification: characterisation of primer attachment and amplification mechanisms. Nucleic Acids Res. Oct. 15, 2000;28(20):E87. 8 pages.
Altenbuchner. Editing of the Bacillus subtilis Genome by the CRISPR-Cas9 System. Appl Environ Microbiol. Aug. 15, 2016;82(17):5421-7.
Aly et al., Floating bait formulations increase effectiveness of *Bacillus thuringiensis* var. israelensis against Anopheles larvae. J Am Mosq Control Assoc. Dec. 1987;3(4):583-8.
Andrews et al., Characterization of the lipid acyl hydrolase activity of the major potato (*Solanum tuberosum*) tuber protein, patatin, by cloning and abundant expression in a baculovirus vector. Biochem J. May 15, 1988;252(1):199-206.
Bennett et al., Toward the 1,000 dollars human genome. Pharmacogenomics. Jun. 2005;6(4):373-82.
Birren et al., Genome Analysis: Analyzing DNA, 1, Cold Spring Harbor, N.Y. 1997. TOC only. 12 pages.

(Continued)

*Primary Examiner* — Michael B. Pallay
(74) *Attorney, Agent, or Firm* — Casimir Jones, S.C.; Thomas A. Isenbarger

(57) ABSTRACT

Insect inhibitory compositions comprising certain *Chryseobacterium* organisms, compositions and compounds derived from *Chryseobacterium* organisms, methods of using the compositions to inhibit insects that are injurious to humans, animals, and plants, and methods of making the compositions are disclosed.

15 Claims, 33 Drawing Sheets

Specification includes a Sequence Listing.

(56) References Cited

OTHER PUBLICATIONS

Brenner et al., Gene expression analysis by massively parallel signature sequencing (MPSS) on microbead arrays. Nat Biotechnol. Jun. 2000;18(6):630-4.
Chen et al., Catalytic Asymmetric synthesis of 3,3' -Bisindoles Bearing Single Axial Chirality. J. Org. Chem. 2020, 85, 10152-10166.
Cheung et al., Micro-lipid-droplet encapsulation of *Bacillus thuringiensis* subsp. *israelensis* delta-endotoxin for control of mosquito larvae. Appl Environ Microbiol. Oct. 1985;50(4):984-8.
Compendium of Herbicide Adjuvants, 13th Edition, Southern Illinois University, 2016. 76 pages.
Czapla et al., Effect of Plant Lectins on the Larval Development of European Corn Borer (Lepidoptera: Pyralidae) and Southern Corn Rootworm (Coleoptera: Chrysomelidae). Journal of Econocomic Entomology. 1990, 83, 6, 2480-2485.
Desantis et al., High-density universal 16S rRNA microarray analysis reveals broader diversity than typical clone library when sampling the environment. Microb Ecol. Apr. 2007;53(3):371-83.
Finn et al., The Pfam protein families database: towards a more sustainable future. Nucleic Acids Res. Jan. 4, 2016;44(D1):D279-85.
Gao et al., Microarray-based analysis of microbial community RNAs by whole-community RNA amplification. Appl Environ Microbiol. Jan. 2007;73(2):563-71.
Garrity et al., Taxonomic Outline of Bacteria and Archaea. The Taxonomic Outline of Bacteria and Archaea. TOBA Release 7.7, Mar. 2007. 141 pages.
Guo et al., Highly Enantioselective Alkylaiton Reaction of Enamides by Bronsted-Acid Catalysis. Organic Letters 2009, 11, 4620-4623 and associated supporting information. 84 pages.
Hinchee et al., Production of Transgenic Soybean Plants Using Agrobacterium-Mediated DNA Transfer. Bio/Technology. 1988, 6, 915- 922.
Hurt et al., Simultaneous recovery of RNA and DNA from soils and sediments. Appl Environ Microbiol. Oct. 2001;67(10):4495-503.
Ishida et al., High efficiency transformation of maize (*Zea mays* L.) mediated by Agrobacterium tumefaciens. Nat Biotechnol. Jun. 1996;14(6):745-50.
Kang et al., Streptindole and Its Derivatives as Novel Antiviral and Anti-Phytopathogenic Fungus Agents. J. Agric. Food Chem. 2020, 68, 7839-7849.
Kushwah et al., Pyrethroid-resistance and presence of two knockdown resistance (kdr) mutations, F1534C and a novel mutation T15201, in Indian Aedes aegypti. PLoS Negl Trop Dis. Jan. 8, 2015;9(1):e3332. 8 pages.
Kushwah et al., Status of DDT and pyrethroid resistance in Indian Aedes albopictus and absence of knockdown resistance (kdr) mutation. J Vector Borne Dis. Mar. 2015;52(1):95-8.
Lacey et al., Effect of formulation, concentration, and application time on the efficacy of Bacillus thuringiensis (H-14) against black fly (Diptera: Simuliidae) larvae under natural conditions. J Econ Entomol. Apr. 1984;77(2):412-8.
MacLean et al., Application of 'next-generation' sequencing technologies to microbial genetics. Nat Rev Microbiol. Apr. 2009;7(4):287-96.
Manual on Development and Use of FAO and WHO Specifications for Pesticides, United Nations, First Edition, Third Revision. 2016. 306 pages.
Margulies et al., Genome sequencing in microfabricated high-density picolitre reactors. Nature. Sep. 15, 2005;437(7057):376-80.
Marrone et al., Improvements in Laboratory Rearing of the Southern Corn Rootworm, Diabrotica undecimpuncta howardi Barber (Coleoptera: Chrysomelidae), on an Artificial Diet and Corn. Journal of Economic Entomology, vol. 78, Issue 1, Feb. 1, 1985, pp. 290-293.
McCutcheon's Detergents and Emulsifiers Annual, MC Publishing Corp., Ridgewood New Jersey. 1996. TOC only. 2 pages.
McGrath et al., Isolation and analysis of mRNA from environmental microbial communities. J Microbiol Methods. Oct. 2008;75(2):172-6.
Mei et al., Indolylmethanols as Reactants in Catalytic Asymmetric Reactions. J. Org. Chem. 2017, 82, 7695-7707.
Mistry et al., Pfam: The protein families database in 2021. Nucleic Acids Res. Jan. 8, 2021;49(D1):D412-D419.
Mitra et al., Fluorescent in situ sequencing on polymerase colonies. Anal Biochem. Sep. 1, 2003;320(1):55-65.
Morozova et al., Applications of next-generation sequencing technologies in functional genomics. Genomics. Nov. 2008;92(5):255-64.
Porter et al., Mosquitocidal toxins of bacilli and their genetic manipulation for effective biological control of mosquitoes. Microbiol Rev. Dec. 1993;57(4):838-61.
Salter et al., Reagent and laboratory contamination can critically impact sequence-based microbiome analyses. BMC Biol. Nov. 12, 2014;12:87. 12 pages.
Schnepf et al., Bacillus thuringiensis and its pesticidal crystal proteins. Microbiol Mol Biol Rev. Sep. 1998;62(3):775-806.
Shendure et al., Accurate multiplex polony sequencing of an evolved bacterial genome. Science. Sep. 9, 2005;309(5741):1728-32.
Sorrell, Organic Chemistry, 2nd edition, University Science Books, Sausalito, 2006, TOC only. 8 pages.
Sparks et al., IRAC: Mode of action classification and insecticide resistance management. Pestic Biochem Physiol. Jun. 2015;121:122-8.
Voelkerding et al., Next-generation sequencing: from basic research to diagnostics. Clin Chem. Apr. 2009;55(4):641-58.
Woese et al., Towards a natural system of organisms: proposal for the domains Archaea, Bacteria, and Eucarya. Proc Natl Acad Sci U S A. Jun. 1990;87(12):4576-9.
Wu et al., Microarray-based analysis of subnanogram quantities of microbial community DNAs by using whole-community genome amplification. Appl Environ Microbiol. Jul. 2006;72(7):4931-41.
Zhou et al., DNA recovery from soils of diverse composition. Appl Environ Microbiol. Feb. 1996;62(2):316-22.
Database Embl [Online]., "Chryseobacterium Gleum ATCC 35910 DNA-Directed RNA Polymerase, Alpha Subunit", Jul. 15, 2010 (Jul. 15, 2010), ID—EFK37989, SV 1, linear, genomic DNA, WGS, PRO, 996 BP, XP002813034, retrieved from EBI accession No. EMBL: EFK37989, sequence, 3 Pages.
Database Embl [Online]., "Chryseobacterium Gleum DNA Gyrase Subunit A", Dec. 19, 2018 (Dec. 19, 2018), ID—VEE05492, SV 1, linear, genomic DNA, STD, PRO, 2592 BP, XP002813028, retrieved from EBI accession No. EMBL: VEE05492, sequence, 3 Pages.
Eski A., et al., "Identification and Pathogenicity of Bacteria in the Mediterranean Corn Borer Sesamia Nonagrioides Lefebvre (Lepidoptera: Noctuidae)", Turkish Journal of Biology, vol. 39, No. 1, Jan. 1, 2015 (Jan. 1, 2015), pp. 31-48, XP055611950, TR ISSN: 1300-0152, DOI: 10.3906/biy-1402-69, the whole document, SN6, figure 5.
Supplementary European Search Report for European Patent Application No. 22808018.0, dated Mar. 10, 2025, 8 Pages.

* cited by examiner

| Description | Scientific Name |
|---|---|
| Chryseobacterium gleum strain NCTC11432 genome assembly, chromosome: 1 | Chryseobacterium gleum |
| Chryseobacterium gleum strain FDAARGOS_1103 chromosome | Chryseobacterium gleum |
| Chryseobacterium arthrosphaerae strain FDAARGOS_519 chromosome, complete genome | Chryseobacterium arthrosphaerae |
| Chryseobacterium flavum strain KCTC 12877 16S ribosomal RNA gene, partial sequence | Chryseobacterium flavum |
| Chryseobacterium indologenes strain FDAARGOS_648 chromosome | Chryseobacterium indologenes |
| Chryseobacterium cucumeris strain MW-6 16S ribosomal RNA gene, partial sequence | Chryseobacterium cucumeris |
| Chryseobacterium lactis strain KC_1864 chromosome, complete genome | Chryseobacterium lactis |
| Chryseobacterium bernardetii strain G0229 chromosome, complete genome | Chryseobacterium bernardetii |
| Chryseobacterium timonianum strain G972 16S ribosomal RNA, partial sequence | Chryseobacterium timonianum |
| Chryseobacterium aureum strain 17S1E7 chromosome | Chryseobacterium aureum aureum |
| Chryseobacterium jejuense strain JDG189 16S ribosomal RNA gene, partial sequence | Chryseobacterium jejuense |
| Chryseobacterium nakagawai strain G0041 chromosome, complete genome | Chryseobacterium nakagawai |
| Endosymbiont of Nilaparvata lugens clone M293 16S ribosomal RNA gene, partial sequence | endosymbiont of Nilaparvata lugens |
| Chryseobacterium joostei strain DSM 16927 chromosome, complete genome | Chryseobacterium joostei |
| Chryseobacterium jlt 16S ribosomal RNA gene, partial sequence | Chryseobacterium sp. jlt |
| Chryseobacterium gallinarum strain FDAARGOS_636 chromosome, complete genome | Chryseobacterium gallinarum |
| Chryseobacterium rhizoplanae partial 16S rRNA gene, strain R-54350 | Chryseobacterium rhizoplanae |

FIG. 6A

| Description | Max Score | Total Score | Query Cover | E value | Per. ident | Acc. Len | Accession |
|---|---|---|---|---|---|---|---|
| Chryseobacterium gleum strain NCTC11432 genome assembly, chromosome: 1 | 2795 | 16678 | 100% | 0 | 100 | 5608922 | LR134289.1 |
| Chryseobacterium gleum strain FDAARGOS_1103 chromosome | 2795 | 16678 | 100% | 0 | 100 | 5643321 | CP068486.1 |
| Chryseobacterium arthrosphaerae strain FDAARGOS_519 chromosome, complete genome | 2734 | 16375 | 100% | 0 | 99.27 | 5361872 | CP033811.1 |
| Chryseobacterium flavum strain KCTC 12877 16S ribosomal RNA gene, partial sequence | 2728 | 2728 | 100% | 0 | 99.21 | 1523 | MK116543.1 |
| Chryseobacterium indologenes strain FDAARGOS_648 chromosome | 2723 | 16332 | 100% | 0 | 99.14 | 4799263 | CP050961.1 |
| Chryseobacterium cucumeris strain MW-6 16S ribosomal RNA gene, partial sequence | 2689 | 2689 | 100% | 0 | 98.74 | 1517 | MW630117.1 |
| Chryseobacterium lactis strain KC_1864 chromosome, complete genome | 2684 | 16100 | 100% | 0 | 98.68 | 5618212 | CP033924.1 |
| Chryseobacterium bernardetii strain G0229 chromosome, complete genome | 2651 | 18374 | 100% | 0 | 98.28 | 5318634 | CP033932.1 |
| Chryseobacterium timonianum strain G972 16S ribosomal RNA, partial sequence | 2647 | 2647 | 99% | 0 | 98.41 | 1505 | NR_164811.1 |
| Chryseobacterium aureum strain 17S1E7 chromosome | 2639 | 15812 | 100% | 0 | 98.15 | 5069854 | CP034661.1 |
| Chryseobacterium jejuense strain JDG189 16S ribosomal RNA gene, partial sequence | 2636 | 2636 | 99% | 0 | 98.4 | 1512 | JX035956.1 |
| Chryseobacterium nakagawai strain G0041 chromosome, complete genome | 2634 | 18430 | 100% | 0 | 98.08 | 5595345 | CP033923.1 |
| Endosymbiont of Nilaparvata lugens clone M293 16S ribosomal RNA gene, partial sequence | 2608 | 2608 | 97% | 0 | 98.58 | 1478 | JQ975885.1 |
| Chryseobacterium jootsei strain DSM 16927 chromosome, complete genome | 2606 | 18247 | 100% | 0 | 97.75 | 4860412 | CP033926.1 |
| Chryseobacterium jil 16S ribosomal RNA gene, partial sequence | 2599 | 2599 | 99% | 0 | 97.81 | 1509 | AY278484.2 |
| Chryseobacterium gallinarum strain FDAARGOS_636 chromosome, complete genome | 2584 | 15457 | 100% | 0 | 97.49 | 4337626 | CP050995.1 |
| Chryseobacterium rhizoplanae partial 16S rRNA gene, strain R-54350 | 2577 | 2577 | 97% | 0 | 98.3 | 1469 | LN995706.1 |

FIG. 6B

CHRYSEOBACTERIUM INSECT INHIBITORY MICROBIAL COMPOSITIONS AND METHODS OF MAKING AND USING

STATEMENT OF RELATED APPLICATIONS

This application claims priority to U.S. Provisional Patent Application No. 63/188,961, filed May 14, 2021, the entire contents of which are incorporated herein by reference for all purposes.

REFERENCE TO SEQUENCE LISTING SUBMITTED ELECTRONICALLY

The instant application contains a Sequence Listing which has been submitted electronically in ASCII format and is hereby incorporated by reference in its entirety. Said ASCII copy, created on Apr. 19, 2022, is named "40129-202_SEQUENCE_LISTING_ST25.txt" and is 14,009,737 bytes in size.

INCORPORATION OF TABLES

The tables filed herewith in the files:
"PLU6_Table1.txt";
"PLU6_Table2.txt";
are part of the disclosure of this application and are incorporated herein in their entireties.

LENGTHY TABLES

The patent contains a lengthy table section. A copy of the table is available in electronic form from the USPTO web site (https://seqdata.uspto.gov/?pageRequest=docDetail&DocID=US12376589B2). An electronic copy of the table will also be available from the USPTO upon request and payment of the fee set forth in 37 CFR 1.19(b)(3).

FIELD

This disclosure is drawn to certain insect inhibitory compositions comprising *Chryseobacterium* strains, insect inhibitory compositions and compounds derived from *Chryseobacterium* organisms, plant parts treated with the insect inhibitory compositions, methods of using the insect inhibitory compositions to control insects, and methods of making the insect inhibitory compositions.

BACKGROUND

Insect pests can afflict humans, livestock, companion animals, and plants either directly or indirectly by serving as vectors for a variety of pathogens and parasites. As insect resistance to insecticides is an ongoing problem, there is an ongoing need for new insect control agents to both inhibit insecticide resistant insects and stall development of such resistance.

Agents that can inhibit Dipteran insects including mosquitos such as *Aedes* species are of particular value. *Aedes aegypti* mosquitoes are known carriers of human diseases, including Zika virus, Chikungunya, Dengue, and Yellow Fever that are particularly problematic. Reports of resistance to DDT and pyrethroid insecticides in certain *Aedes* populations (Kushwah et al. PLoS Negl Trop Dis. 2015 Jan. 8; 9(1):e3332; Kushwah et al. J Vector Borne Dis. 2015 March; 52(1):95-8) underscore the importance of identifying other insect inhibitory agents with distinct modes of action.

SUMMARY

Provided for herein are compositions comprising: (i) a *Chryseobacterium* monoculture or a product thereof wherein the *Chryseobacterium* comprises: (a) at least one coding region encoding a protein with at least 95%, 96%, 97%, 98%, 99%, 99.5%, 99.8%, 99.9%, or 100% sequence identity across the entire length of SEQ ID NO: 1 (MKCIGJBJ_03627 DNA gyrase subunit A), at least 95%, 96%, 97%, 98%, 99%, 99.5%, 99.8%, 99.9%, or 100% sequence identity across the entire length of SEQ ID NO: 2 (MKCIGJBJ_03079 DNA topoisomerase 1), at least 95%, 96%, 97%, 98%, 99%, 99.5%, 99.8%, 99.9%, or 100% sequence identity across the entire length of SEQ ID NO: 3 (MKCIGJBJ_00500 DNA-directed RNA polymerase subunit beta), at least 95%, 96%, 97%, 98%, 99%, 99.5%, 99.8%, 99.9%, or 100% sequence identity across the entire length of SEQ ID NO: 4 (MKCIGJBJ_00499 DNA-directed RNA polymerase subunit beta'), and/or at least 95%, 96%, 97%, 98%, 99%, 99.5%, 99.8%, 99.9%, or 100% sequence identity across the entire length of SEQ ID NO: 5 (MKCIGJBJ_02095 DNA-directed RNA polymerase subunit alpha); (b) at least one gene encoding a protein with at least 95%, 96%, 97%, 98%, 99%, 99.5%, 99.8%, 99.9%, or 100% sequence identity across the entire length of a sequence contained in Appendix A (PLU6_1-PLU6_352; SEQ ID NO: 851-1202); (c) any combination of any coding region of (a) or any gene of (b); (d) *Chryseobacterium* strain PLU6 deposited as ATCC Patent Deposit Number PTA-127072, a variant thereof, or progeny thereof; or (e) *Chryseobacterium* strain PLU6 deposited as ATCC Patent Deposit Number PTA-127072, a variant thereof, or progeny thereof, wherein the variant or progeny comprise any coding region of (a), any gene of (b), or any combination of coding regions of (a) and/or genes of (b). In certain embodiments, the composition comprises (ii) an adjuvant and/or excipient.

Certain embodiments provide for a kit comprising a *Chryseobacterium* composition of this disclosure, and at least one of an application device, diluent, and/or vessel.

Certain embodiments provide for a plant part that is at least partially coated with a *Chryseobacterium* composition of this disclosure.

Provided for herein is a method for inhibiting growth, reproduction, egg laying, development, and/or feeding of an insect (e.g., a dipteran, a lepidopteran) comprising exposing the insect to an insect inhibitory amount of a *Chryseobacterium* composition of this disclosure.

Certain embodiments provide for a method of reducing insect damage to a plant comprising the step of applying an insect inhibitory amount of a *Chryseobacterium* composition of this disclosure to one or more parts of the plant, to soil that is adjacent to the plant, and/or to soil in which the plant is grown.

Certain embodiments provide for a method of making an insect inhibitory composition comprising the step of combining: (i) a monoculture of a *Chryseobacterium* organism that comprises: (a) at least one coding region encoding a protein with at least 95%, 96%, 97%, 98%, 99%, 99.5%, 99.8%, 99.9%, or 100% sequence identity across the entire length of SEQ ID NO: 1 (MKCIGJBJ_03627 DNA gyrase subunit A), at least 95%, 96%, 97%, 98%, 99%, 99.5%, 99.8%, 99.9%, or 100% sequence identity across the entire length of SEQ ID NO: 2 (MKCIGJBJ_03079 DNA topoisomerase 1), at least 95%, 96%, 97%, 98%, 99%, 99.5%, 99.8%, 99.9%, or 100% sequence identity across the entire length of SEQ ID NO: 3 (MKCIGJBJ_00500 DNA-directed RNA polymerase subunit beta), at least 95%, 96%, 97%, 98%, 99%, 99.5%, 99.8%, 99.9%, or 100% sequence identity across the entire length of SEQ ID NO: 4 (MKCIGJBJ_00499 DNA-directed RNA polymerase subunit beta'), and/or at least 95%, 96%, 97%, 98%, 99%, 99.5%, 99.8%, 99.9%, or 100% sequence identity across the entire length of SEQ ID NO: 5 (MKCIGJBJ_02095 DNA-directed RNA polymerase subunit alpha); (b) at least one gene encoding a protein with at least 95%, 96%, 97%, 98%, 99%, 99.5%, 99.8%, 99.9%, or 100% sequence identity across the entire length of a sequence contained in Appendix A (PLU6_1-PLU6_352; SEQ ID NO: 851-1202); (c) any combination of any coding region of (a) or any gene of (b); (d) *Chryseobacterium* strain PLU6 deposited as ATCC Patent Deposit Number PTA-127072, a variant thereof, or progeny thereof; or (e) *Chryseobacterium* strain PLU6 deposited as ATCC Patent Deposit Number PTA-127072, a variant thereof, or progeny thereof, wherein the variant or progeny comprise any coding region of (a), any gene of (b), or any combination of coding regions of (a) and/or genes of (b); and (ii) at least one adjuvant and/or excipient, thereby making an insect inhibitory composition.

In some embodiments, the PLU6 organism or PLU6-type organism is a *Chryseobacterium* species, e.g., *C. timonianum, C. indologenes, C. gleum*, or *C. rhizosphaerae*, having insecticidal activity, e.g., having killing activity against dipterans and/or lepidopterans (e.g., an insect from a genus *Aedes, Anticarsia, Culex, Anopheles, Heliothis, Trichoplusia, Spodoptera, Chrysodeixis, Diatraea, Helicoverpa*, or *Chloridea*).

Accordingly, in some embodiments, the technology provides a method of killing an insect. For example, embodiments of methods comprise contacting an insect with a microbial organism that is PLU6, a PLU6-type organism, or an organism having an insecticidal activity similar to PLU6 or a PLU6-type organism. In some embodiments, the microbial organism produces a diindolylalkane compound. In some embodiments, the diindolylalkane compound is 3,3-diindolylmethane or 3-((1H-indol-2-yl)methyl)-1H-indole. In some embodiments, the insect is a lepidopteran or dipteran. In some embodiments, the insect is from the family Culicidae, Noctuidae, Tortricidae, Crambidae, or Erebidae. In some embodiments, the insect is from the genus *Aedes, Anticarsia, Culex, Anopheles, Heliothis, Trichoplusia, Spodoptera, Chrysodeixis, Diatraea, Helicoverpa*, or *Chloridea*. In some embodiments, the insect is *Aedes aegpyti, Culex quinquefasciatus, Heliothis viriscens, Trichoplusia ni, Spodoptera exigua, Chrysodeixis includens, Helicoverpa zea, Spodoptera eridania, Spodoptera frugiperda, Diatraea saccharalis, Diatraea grandiosella, Anopheles quadrimaculatus*, or *Anticarsia gemmetalis.*

In some embodiments, the microbial organism (e.g., PLU6-type organism) comprises a nucleotide sequence having at least 95% sequence identity to one or more sequences provided by one or more of SEQ ID NO: 78-82 (16S rRNA gene, 23S rRNA gene, and three different 5S rRNA genes).

In some embodiments, the microbial organism (e.g., PLU6-type organism) comprises a nucleotide sequence having at least 95% sequence identity to one or more sequences provided by a sequence of SEQ ID NO: 83; SEQ ID NO: 84-157; SEQ ID NO: 158-234; SEQ ID NO: 235-464; SEQ ID NO: 465-723; or SEQ ID NO: 724-850, corresponding to sequences associated with the phylogenetic clades 1-6, respectively, as shown in FIG. 10.

In some embodiments, the microbial organism (e.g., PLU6-type organism) comprises a nucleotide sequence encoding a polypeptide having at least 95% sequence identity to one or more amino acid sequences provided by SEQ ID NO: 1-5 (DNA gyrase subunit A, DNA topoisomerase 1, DNA-directed RNA polymerase subunit beta, DNA-directed RNA polymerase subunit beta', DNA-directed RNA polymerase subunit alpha); or comprises a nucleotide sequence encoding a polypeptide having at least 95% sequence identity to one or more amino acid sequences provided by a sequence SEQ ID NO: 851-1202 (Appendix A).

In some embodiments, the technology provides a method of producing an insecticide. For instance, in some embodiments, methods comprise growing a liquid culture comprising a microbial organism that is PLU6, a PLU6-type organism, or an organism having an insecticidal activity similar to PLU6 or a PLU6-type organism. In some embodiments, the microbial organism (e.g., PLU6-type organism) comprises a nucleotide sequence having at least 95% sequence identity to one or more sequences provided by one or more of SEQ ID NO: 78-82 (16S rRNA gene, 23S rRNA gene, and three different 5S rRNA genes). In some embodiments, the microbial organism (e.g., PLU6-type organism) comprises a nucleotide sequence having at least 95% sequence identity to one or more sequences provided by a sequence of SEQ ID NO: 83; SEQ ID NO: 84-157; SEQ ID NO: 158-234; SEQ ID NO: 235-464; SEQ ID NO: 465-723; or SEQ ID NO: 724-850 corresponding to sequences associated with the phylogenetic clades 1-6, respectively, as shown in FIG. 10. In some embodiments, the microbial organism (e.g., PLU6-type organism) comprises a nucleotide sequence encoding a polypeptide having at least 95% sequence identity to one or more amino acid sequences provided by SEQ ID NO: 1-5 (DNA gyrase subunit A, DNA topoisomerase 1, DNA-directed RNA polymerase subunit beta, DNA-directed RNA polymerase subunit beta', DNA-directed RNA polymerase subunit alpha); or comprises a nucleotide sequence encoding a polypeptide having at least 95% sequence identity to one or more amino acid sequences provided by a sequence SEQ ID NO: 851-1202 (Appendix A).

In some embodiments, methods further comprise isolating an insecticidal compound from said liquid culture. In some embodiments, methods further comprise isolating the microbial organism that is PLU6, a PLU6-type organism, or an organism having an insecticidal activity similar to PLU6 or a PLU6-type organism. In some embodiments, the insecticidal compound is a diindolylalkane compound. In some embodiments, the diindolylalkane compound is 3,3-diindolylmethane or 3-((1H-indol-2-yl)methyl)-1H-indole.

In some embodiments, the technology relates to heterologous expression of an insecticidal compound. In some embodiments, the technology relates to heterologous expression of one or more polypeptides from PLU6, a PLU6-type organism, or an organism having an insecticidal activity similar to PLU6 or a PLU6-type organism functioning to produce an insecticidal compound. In some embodiments, the technology relates to heterologous expression of one or more polypeptides of a biosynthetic pathway, biological system, metabolic pathway, metabolic network, gene cluster, operon, or other group of genes, proteins, and/or enzymes from PLU6, a PLU6-type organism, or an organism having an insecticidal activity similar to PLU6 or a PLU6-type organism that function to produce an insecticidal compound (e.g., an indolylalkane). In some embodiments, methods comprise expressing an insecticide from a nucleotide sequence obtained from PLU6, a PLU6-type organism, or an organism having an insecticidal activity similar to PLU6 or a PLU6-type organism. In some embodiments, methods comprise expressing a protein from a nucleotide sequence obtained from PLU6, a PLU6-type organism, or an organism having an insecticidal activity similar to PLU6 or a PLU6-type organism, wherein the protein functions alone or with other proteins to produce an insecticidal compound. In some embodiments, methods comprise expressing a product (e.g., an insecticide or a protein functioning to produce an insecticide) in a heterologous host that comprises one or more nucleotide sequences obtained from PLU6, a PLU6-type organism, or an organism having an insecticidal activity similar to PLU6 or a PLU6-type organism. In some embodiments, the one or more nucleotide sequences comprise a sequence provided by SEQ ID NO: 83, 84-157, 158-234, 235-464, 465-723, or 724-850. In some embodiments, the nucleotide sequence encodes a polypeptide having an amino acid sequence provided by one or more sequences provided by SEQ ID NO: 851-1202 (Appendix A).

In some embodiments, the technology provides a heterologous organism (e.g., a microbe or a plant) comprising a nucleic acid from PLU6, a PLU6-type organism, or an organism having an insecticidal activity similar to PLU6 or a PLU6-type organism. In some embodiments, the nucleotide sequence is a sequence provided by SEQ ID NO: 83, 84-157, 158-234, 235-464, 465-723, or 724-850. In some embodiments, the nucleotide sequence encodes a polypeptide having an amino acid sequence provided by one or more sequences provided by SEQ ID NO: 851-1202 (Appendix A). In some embodiments, the technology provides a heterologous organism expressing one or more polypeptides from PLU6, a PLU6-type organism, or an organism having an insecticidal activity similar to PLU6 or a PLU6-type organism functioning to produce an insecticidal compound. In some embodiments, the technology relates to a heterologous organism expressing one or more polypeptides of a biosynthetic pathway, biological system, metabolic pathway, metabolic network, gene cluster, operon, or other group of genes, proteins, and/or enzymes from PLU6, a PLU6-type organism, or an organism having an insecticidal activity similar to PLU6 or a PLU6-type organism that function to produce an insecticidal compound.

In some embodiments, the technology provides a method of producing an insect-resistant plant, said method comprising expressing in the plant a product encoded by a nucleotide sequence of PLU6, a PLU6-type organism, or an organism having an insecticidal activity similar to PLU6 or a PLU6-type organism. In some embodiments, the product encoded by a nucleotide sequence of PLU6, a PLU6-type organism, or an organism having an insecticidal activity similar to PLU6 or a PLU6-type organism is a polypeptide that functions alone or with other proteins to produce a diindolylalkane compound (e.g., a diindolylalkane as described herein). In some embodiments, the plant comprises a nucleotide sequence provided by SEQ ID NO: 83, 84-157, 158-234, 235-464, 465-723, or 724-850. In some embodiments, the plant comprises a nucleotide sequence that encodes a polypeptide having an amino acid sequence provided by one or more sequences provided by SEQ ID NO: 851-1202 (Appendix A). In some embodiments, the technology provides a method of producing a plant expressing one or more polypeptides from PLU6, a PLU6-type organism, or an organism having an insecticidal activity similar to PLU6 or a PLU6-type organism. In some embodiments, the technology relates to a method of producing a plant expressing one or more polypeptides of a biosynthetic pathway, biological system, metabolic pathway, metabolic network, gene cluster, operon, or other group of genes, proteins, and/or enzymes from PLU6, a PLU6-type organism, or an organism having an insecticidal activity similar to PLU6 or a PLU6-type organism.

In some embodiments, the technology provides a plant expressing a product encoded by a nucleotide sequence of PLU6, a PLU6-type organism, or an organism having an insecticidal activity similar to PLU6 or a PLU6-type organism. In some embodiments, the product encoded by a nucleotide sequence of PLU6, a PLU6-type organism, or an organism having an insecticidal activity similar to PLU6 or a PLU6-type organism is a protein that functions alone or with other proteins to produce a diindolylalkane compound (e.g., a diindolylalkane as described herein). In some embodiments, the plant comprises a nucleotide sequence of PLU6, a PLU6-type organism, or an organism having an insecticidal activity similar to PLU6 or a PLU6-type organism is provided by SEQ ID NO: 83, 84-157, 158-234, 235-464, 465-723, or 724-850. In some embodiments, the plant comprises a nucleotide sequence that encodes a polypeptide having an amino acid sequence provided by one or more sequences provided by SEQ ID NO: 851-1202 (Appendix A). In some embodiments, the technology provides a plant expressing one or more polypeptides from PLU6, a PLU6-type organism, or an organism having an insecticidal activity similar to PLU6 or a PLU6-type organism. In some embodiments, the technology relates to a plant expressing one or more polypeptides of a biosynthetic pathway, biological system, metabolic pathway, metabolic network, gene cluster, operon, or other group of genes, proteins, and/or enzymes from PLU6, a PLU6-type organism, or an organism having an insecticidal activity similar to PLU6 or a PLU6-type organism.

In some embodiments, the technology provides a method of killing an insect by contacting an insect with a dindolylalkyl compound. In some embodiments, the dindolylalkyl compound is 3,3-diindolylmethane. In some embodiments, the diindolylalkane compound is 3-((1H-indol-2-yl)methyl)-1H-indole. In some embodiments, the insect is a lepidopteran or dipteran. In some embodiments, the insect is from the family Culicidae, Noctuidae, Tortricidae, Crambidae, or Erebidae. In some embodiments, the insect is from the genus *Aedes, Anticarsia, Culex, Anopheles, Heliothis, Trichoplusia, Spodoptera, Chrysodeixis, Diatraea, Helicoverpa,* or *Chloridea*. In some embodiments, the insect is *Aedes aegpyti, Anopheles quadrimaculatus, Culex quinquefasciatus, Heliothis viriscens, Trichoplusia ni, Spodoptera exigua, Chrysodeixis includens, Helicoverpa zea, Spodoptera eridania, Spodoptera frugiperda, Diatraea saccharalis, Diatraea grandiosella,* or *Anticarsia gemmetalis*. In some embodiments, the dindolylalkyl compound (e.g., 3,3-diindolylmethane or 3-((1H-indol-2-yl)methyl)-1H-indole) is produced by a PLU6 organism, a PLU6-type organism, or an organism having an insecticidal activity similar to PLU6 or a PLU6-type organism.

In some embodiments, methods of killing an insect comprise producing a dindolylalkyl compound (e.g., 3,3-diindolylmethane or 3-((1H-indol-2-yl)methyl)-1H-indole)

using a PLU6 organism, a PLU6-type organism, or an organism having an insecticidal activity similar to PLU6 or a PLU6-type organism (e.g., by culturing the PLU6 organism, a PLU6-type organism, or an organism having an insecticidal activity similar to PLU6 or a PLU6-type organism) and contacting the insect with the diindolylalkyl compound or with a composition comprising the diindolylalkyl compound (e.g., a culture comprising the PLU6 organism, a PLU6-type organism, or an organism having an insecticidal activity similar to PLU6 or a PLU6-type organism and the diindolylalkane compound; or a composition comprising an isolated diindolylalkyl compound).

In some embodiments, the technology provides a method of producing an indole compound. For example, in some embodiments, methods comprise growing a liquid culture comprising a microbial organism that is PLU6 or a PLU6-type organism. In some embodiments, the microbial organism comprises a nucleotide sequence provided by SEQ ID NO: 78-82; 83, 84-157, 158-234, 235-464, 465-723, or 724-850; or the microbial organism comprises a nucleotide sequence encoding a polypeptide comprising an amino acid sequence provided by SEQ ID NO: 1-5; or 851-1202. In some embodiments, methods further comprise isolating an indole compound from said liquid culture. In some embodiments, the indole compound is a tri-indole compound or a tetra-indole compound. In some embodiments, the indole compound has a structure according to

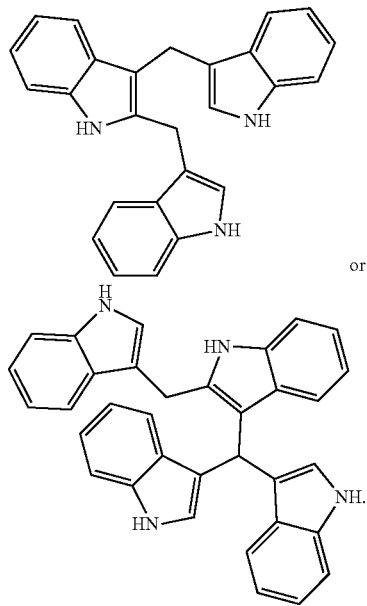

In some embodiments, the microbial organism is a heterologous organism comprising a nucleotide sequence obtained from PLU6 or a PLU6-type organism. In some embodiments, the heterologous organism comprises a nucleotide sequence that is a nucleotide sequence provided by SEQ ID NO: 78-82; 83, 84-157, 158-234, 235-464, 465-723, or 724-850; or is a nucleotide sequence encoding a polypeptide comprising an amino acid sequence provided by SEQ ID NO: 1-5; or 851-1202.

Additional embodiments will be apparent to persons skilled in the relevant art based on the teachings contained herein.

BRIEF DESCRIPTION OF THE DRAWINGS/FIGURES

These and other features, aspects, and advantages of the present technology will become better understood with regard to the following drawings.

FIG. 1 is a bar plot of data showing the larvicidal activity of PLU6 against various species of mosquito larvae (*Aedes aegypti, Culex quinquefasciatus*, and *Anopheles quadrimaculatus*). The bioactive culture of PLU6 was grown for 2 days. Mortality was assessed 72 hours after application to third-instar larvae. Error bars represent standard deviations from at least three independent biological replicates. "Neg. control" represents data obtained using *Bacillus thuringiensis* subspecies *israelensis* strain 4Q7 from the Bacillus Genetic Stock Center (Ohio State University, Columbus, OH), from which the plasmid encoding the larvicidal toxin has been removed. The positive control was sourced from a commercially available larvicide product comprising *Bacillus thuringiensis* subspecies *israelensis*. "Media only" samples were treated with sterile NYSM media.

FIG. 2 is a bar plot of data showing the larvicidal activity of PLU6 culture against *Ae. aegypti* larvae following various treatments to the culture. The bioactive culture of PLU6 was grown for 2 days. Cell pellets and supernatants were obtained by centrifuging the whole culture for 10 minutes at 4000 rpm. Supernatants were filtered through a 0.22 μm sterile filter to obtain cell-free supernatants. Cell pellets were resuspended in fresh NYSM and applied to larvae. For heat treatments, whole cultures were heated in a heat block for the indicated time and temperature before application to larvae. Mortality was assessed 72 hours after application to larvae. Error bars represent standard deviations from at least three independent biological replicates. The positive control was sourced from a commercially available larvicide product comprising *Bacillus thuringiensis* subspecies *israelensis*. "Media only" samples were treated with sterile NYSM media.

FIG. 3 is a bar plot of data showing larvicidal activity of PLU6 culture and ATCC 29898 culture against *Ae. aegypti*. The bioactive cultures of PLU6 and ATCC 29898 were grown for 2 days. Mortality was assessed 72 hours after application to larvae. Error bars represent standard deviations from at least three independent biological replicates. "Media only" samples were treated with sterile NYSM media.

FIG. 4 shows a phylogenetic tree of 16S rRNA genes (1513 bp) from reference whole genome sequences deposited in NCBI compared to whole genome sequence of PLU6 and negative control ATCC 29898. The 16S rRNA genes were extracted post-assembly of reads using a Hidden Markov Model and aligned using MUSCLE. The phylogenetic tree was constructed using FastTree, which infers maximum-likelihood phylogenetic trees from nucleotide alignments, with a Gamma20-based likelihood under the generalized time-reversible model.

FIG. 5 shows the relationships between all sequencing runs of PLU6 and other closely related strains using a core set of proteins that are concatenated and aligned. Appendix A (SEQ ID NO: 851-1202) provides the amino acid sequences of predicted proteins present in the PLU6 strains shown in FIG. 5 (L0947, L0948, L0949, L0950, L0951, L0952, L0953, L0954, L78 and L88). The functions of the encoded proteins were predicted using Hidden Markov Modeling and the Pfam database of protein families (see, e.g., Mistry (2021) "Pfam: The protein families database in 2021", Nucleic Acids Research 49: D412-D419, incorporated herein by reference).

FIG. 6A and FIG. 6B represent a parsed output of the PLU6 16S rDNA to the same region of organisms found at NCBI and describes the most closely related organisms using a classic methodology for comparing organisms.

FIG. 7 is a bar plot of data showing the larvicidal activity of *Chryseobacterium* strains related to PLU6 ("biosimilars") isolated from environmental sources. Cultures were applied at 10% v/v. Strains M289, M290, M291, and M48 are control strains sourced from the American Type Culture Collection. M289, M290, and M291 are clones of ATCC29897 (*C. indologenes*). Strain M48 is a clone of ATCC29898 (*C. taihuense*). NYSM represents the negative control (media, no bacterial cells). Isolated Flavobacterium strains are also shown. Error bars represent standard deviations calculated from at least three independent replicates.

FIG. 8 is a bar plot of data showing the larvicidal activity of cell-free supernatants derived from *Chryseobacterium* strains biosimilar to PLU6. Cell-free culture supernatants were applied at 10% v/v. Strains M289, M290, M291, and M48 are control strains sourced from the American Type Culture Collection. M289, M290, and M291 are clones of ATCC29897 (*C. indologenes*). Strain M48 is a clone of ATCC29898 (*C. taihuense*). NYSM represents the negative control (media, no bacterial cells). Error bars represent standard deviations calculated from at least three independent biological replicates.

FIG. 9A to 9C is a whole genome phylogeny based on gene presence/absence created using PEPPAN v1.0.5. Bars represent average 72 hour mortality against *Aedes aegypti* following application with microbial cultures. Black bars represent mortality rates above 15%, and grey bars represent mortality rates below 15%.

FIG. 10A to 10D is a whole genome phylogeny based on core genes present in over 60% of strains in the analysis created using PEPPAN v1.0.5. Bars represent average 72 hour mortality against *Aedes aegypti* following application with microbial cultures. Black bars represent mortality rates above 15%, and grey bars represent mortality rates below 15%. After extracting the common ancestors for the clades in which the activity was greater than 15%, all biosimilar organisms comprised nucleotide sequences having at least 95% identity to the nucleotide sequences of PLU6 DNA gyrase subunit A, DNA topoisomerase I, DNA-directed RNA polymerase subunit beta, DNA-directed RNA polymerase subunit beta prime, DNA-directed RNA polymerase subunit alpha. Boxes numbered 1 to 6 indicate six clades of organisms (clades 1-6) having significant insecticidal killing activity against *Aedes aegypti*. A nucleotide sequence common to all members of Clade 1 is provided by SEQ ID NO: 83. Nucleotide sequences common to all members of Clade 2 are provided by SEQ ID NO: 84-157. Nucleotide sequences common to all members of Clade 3 are provided by SEQ ID NO: 158-234. Nucleotide sequences common to all members of Clade 4 are provided by SEQ ID NO: 235-464. Nucleotide sequences common to all members of Clade 5 are provided by SEQ ID NO: 465-723. Nucleotide sequences common to all members of Clade 6 are provided by SEQ ID NO: 724-850.

FIG. 11A and FIG. 11B are plots of data showing that organic extracts from supernatants of PLU6 and M82 cultures are active against *Ae. aegypti* larvae. Activity is dose-dependent and is not sensitive to heat treatment. Shown are representative dose curves for PLU6 (FIG. 11A) and M82 (FIG. 11B) extracts applied to *Ae. aegypti* larvae. Mortality data were plotted against $log_{10}$-transformed compound concentrations. Inhibitory dose-response curves were fitted using GraphPad Prism software. Error bars represent standard deviations calculated from two technical replicates (assay wells). The mean $LC_{50}$s calculated for PLU6 extract and PLU6 extract treated at 60° C. for 10 minutes were 253±11 µg/mL and 249±17 µg/mL, respectively. The mean $LC_{50}$s calculated for M82 extract and M82 extract treated at 95° C. for 10 minutes were 340±113 µg/mL and 271±227 µg/mL, respectively. Standard deviations were calculated from two independent replicate dose curves for which the curve fit R2 values were ≥0.75.

Figure 12:
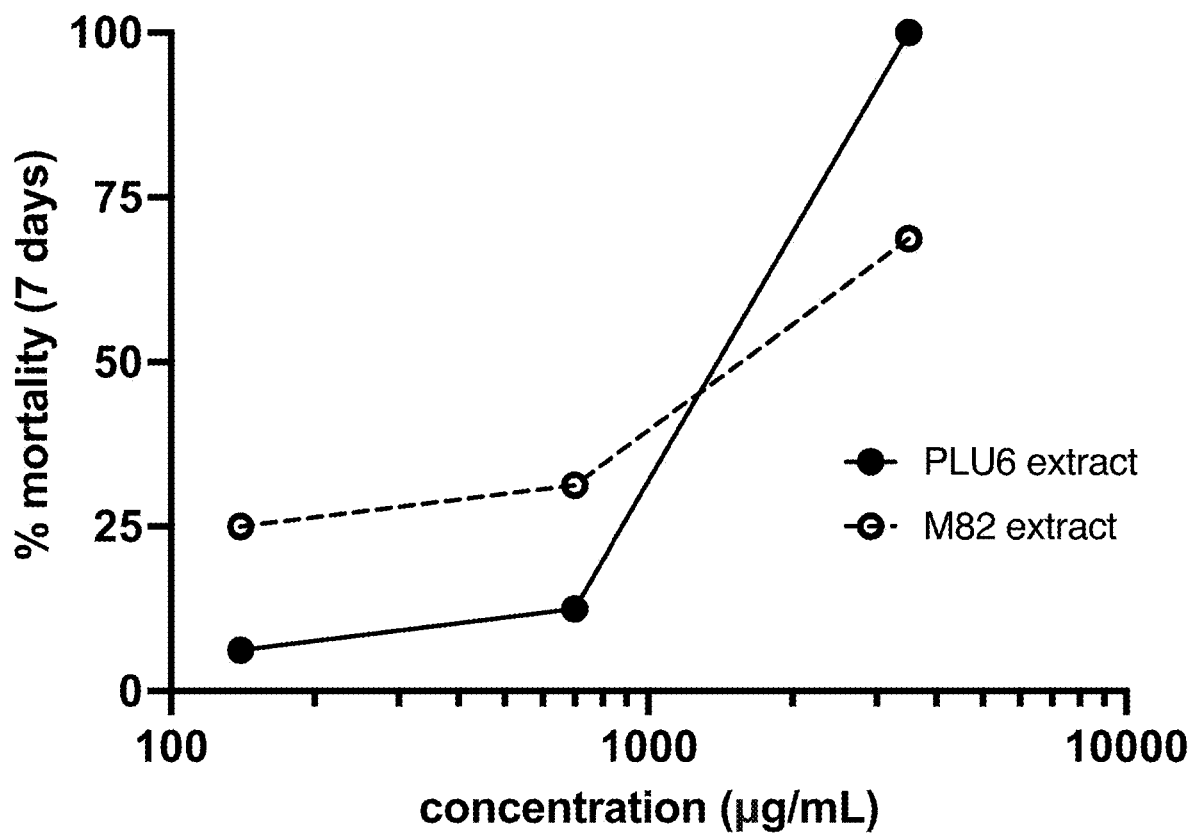

FIG. 12 is a plot of data showing that treatment with extracts prepared from *Chryseobacterium* strains causes mortality in cabbage looper (*Trichoplusia ni*) neonates. Assay used N=16 larvae per concentration. The negative controls (no extract) displayed 0% mortality.

Figure 13:
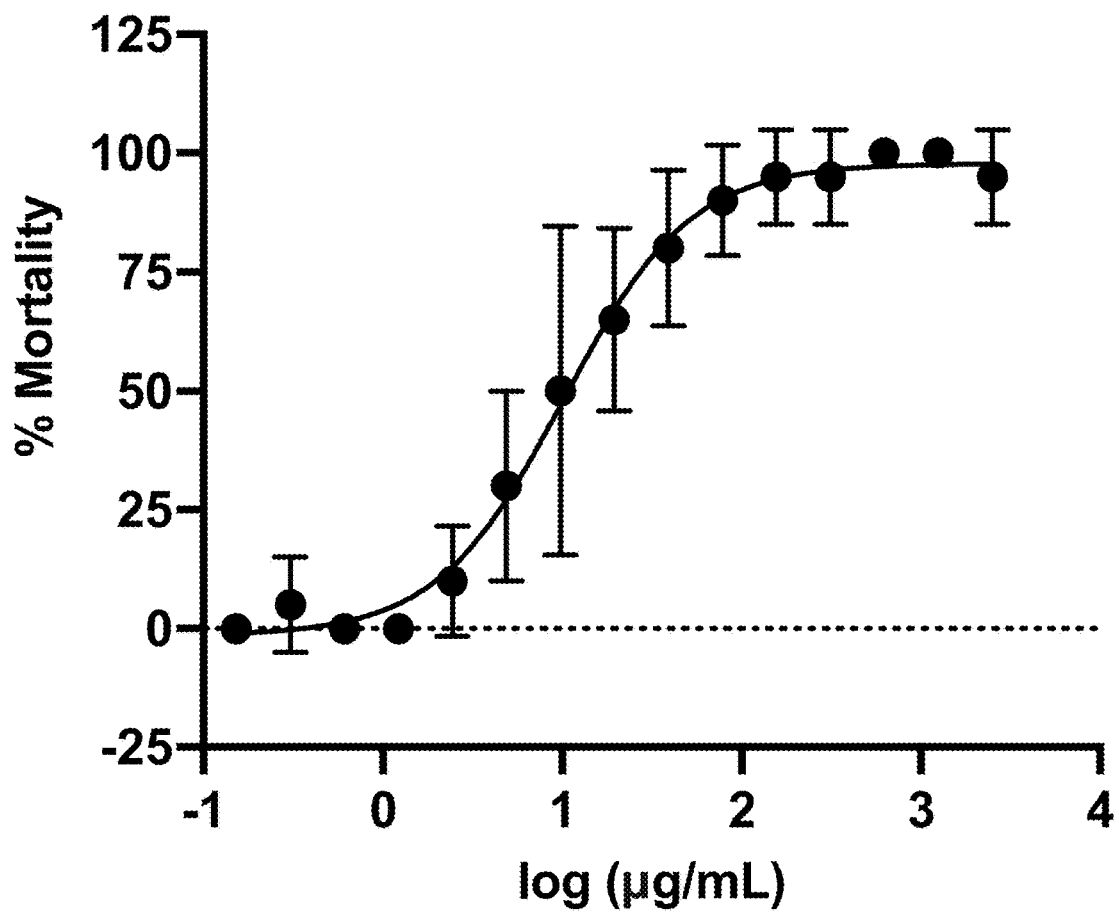

FIG. 13 is a plot of data showing that the diindole compound 3,3'-diindolylmethane produced by strain PLU6 is active against *Aedes aegypti* larvae in a dose-dependent manner. Shown is a representative dose curve for 3,3'-diindolylmethane applied to *Ae. aegypti* larvae. Mortality data were plotted against $log_{10}$-transformed compound concentrations. An inhibitory dose-response curve was fitted using GraphPad Prism software. The representative curve fit shown corresponds to a 3,3'-diindolylmethane $LC_{50}$ of 10.2 µg/mL (95% CI [7.3, 14.2]). Error bars represent standard deviations calculated from four technical replicates (assay wells). The mean $LC_{50}$ calculated for 3,3'-diindolylmethane was 7.5±3.0 µg/mL (standard deviation calculated from five independent replicate dose curves for which the curve fit $R^2$ values were ≥0.75. Significant outlier $LC_{50}$ values were identified using Grubb's test with P<0.01 and were not included in calculating the mean $LC_{50}$). Mortality in the negative control was not subtracted but was <10% for all assays.

Figure 14:
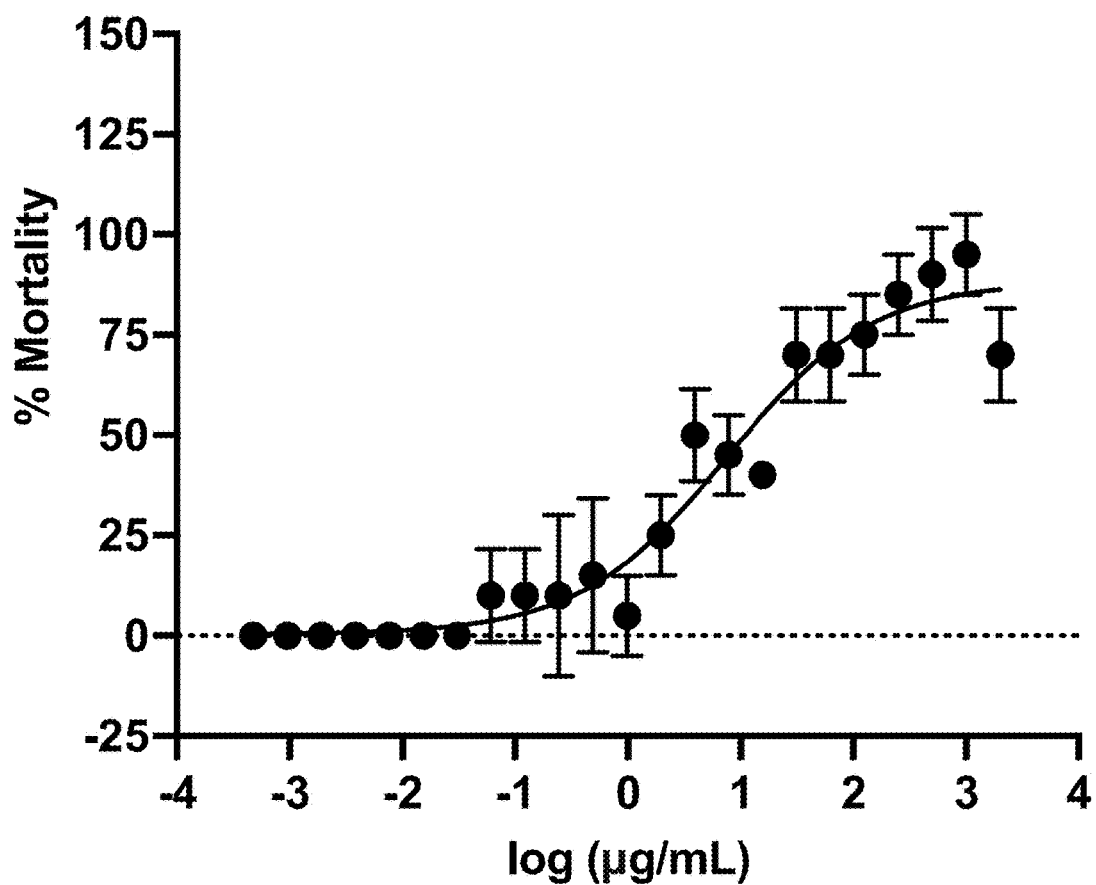

FIG. 14 is a plot showing that the diindole compound 3,3'-diindolylmethane produced by strain PLU6 is active against *Culex quinquefasciatus* larvae in a dose-dependent manner. Mortality data were plotted against $log_{10}$-transformed compound concentrations. An inhibitory dose-response curve was fitted using GraphPad Prism software. The representative curve fit shown corresponds to a 3,3'-diindolylmethane $LC_{50}$ of 7.5 µg/mL (95% CI [4.5, 13.3]). Error bars represent standard deviations calculated from four technical replicates (assay wells). Mortality in the negative control was 0%.

Figure 15:
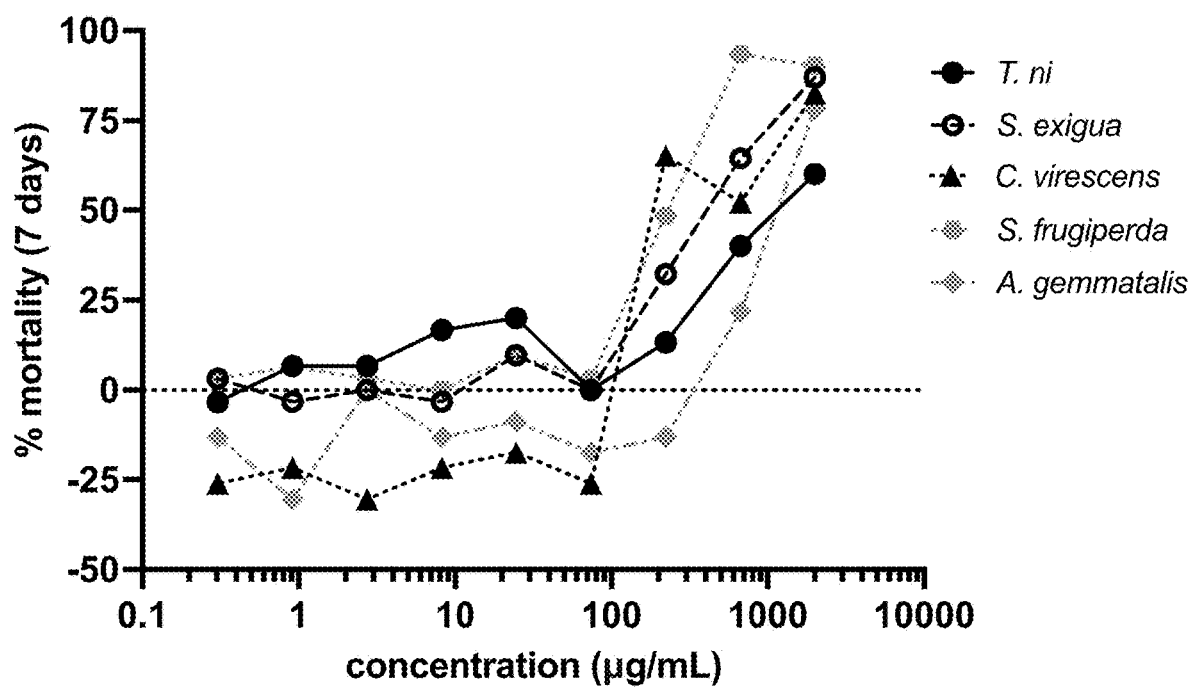

FIG. 15 is a series of plots showing that 3,3'-diindolylmethane has dose-dependent activity against five Lepidopteran species. Data presented are derived from a bioassay performed with N=32 neonates in a diet overlay format. Full species names are as follows: *Trichoplusia ni* (cabbage looper), *Spodoptera exigua* (beet armyworm), *Chloridia virescens* (tobacco budworm), *Spodoptera frugiperda* (fall armyworm), and *Anticarsia gemmatalis* (velvetbean caterpillar). Data are corrected using Abbott's Correction. Positive control samples (1000 ppm *Bacillus thuringiensis kurstaki*) produced 100% mortality for all five species.

Figure 16:
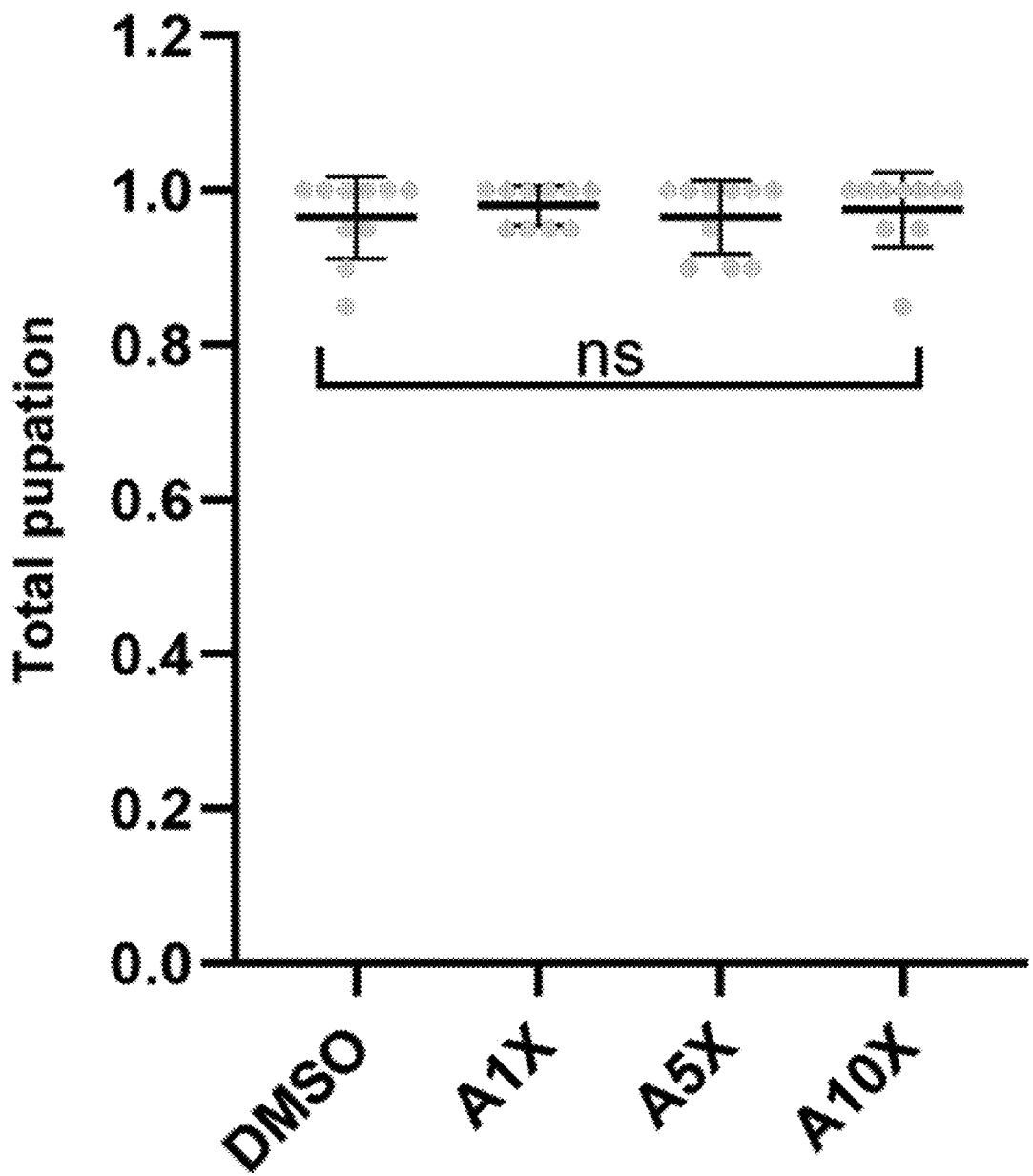

FIG. 16 is a plot of data showing that the pupation rate of *Drosophila suzukii* (spotted wing *Drosophila*) is not affected by 3,3'-diindolylmethane treatment (diet incorporation). A1X=100 μg/mL; A5X=500 μg/mL; A10X=1000 μg/mL. Each concentration was tested with 10 vials containing 20 *D. suzukii* L2 larvae. Pupation rates were not significantly different, as measured by a one-way ANOVA (alpha=0.05).

FIG. 17 is a plot of data showing that the eclosion rate of *Drosophila suzukii* (spotted wing *Drosophila*) is not affected by 3,3'-diindolylmethane treatment (diet incorporation). A1X=100 μg/mL; A5X=500 μg/mL; A10X=1000 μg/mL. Each concentration was tested with 10 vials containing 20 *D. suzukii* L2 larvae. Treatments labeled with the same letter are not significantly different, as measured by a one-way ANOVA (alpha=0.05).

FIG. 18 is a series of plots showing that the egg-to-adult survival of *Drosophila suzukii* (spotted wing *Drosophila*) is not affected by 3,3'-diindolylmethane treatment (diet incorporation). A1X=100 μg/mL; A5X=500 μg/mL; A10X=1000 μg/mL. Each concentration was tested with 10 vials containing 20 *D. suzukii* L2 larvae. "Dpi" indicates days post infestation (0 dpi is the day of egg-laying).

FIG. 19 is a plot of data showing that the synthetic diindole compound 3-((1H-indol-2-yl)methyl)-1H-indole is active against *Aedes aegypti* larvae. Shown is a representative dose curve for 3-((1H-indol-2-yl)methyl)-1H-indole applied to *Ae. aegypti* larvae. Mortality data were plotted against $\log_{10}$-transformed compound concentrations. An inhibitory dose-response curve was fitted using GraphPad Prism software. The representative curve fit shown corresponds to a 3-((1H-indol-2-yl)methyl)-1H-indole $LC_{50}$ of 5.8 μg/mL (95% CI [5.1, 6.8]). Error bars represent standard deviations calculated from four technical replicates (assay wells). The mean $LC_{50}$ calculated for 3-((1H-indol-2-yl)methyl)-1H-indole was 6.3±2.1 μg/mL (standard deviation calculated from four independent replicate dose curves for which the curve fit $R^2$ values were ≥0.75. Significant outlier $LC_{50}$ values were identified using Grubb's test with P<0.01 and were not included in calculating the mean $LC_{50}$). Mortality in the negative control was not subtracted but was <10% for all assays.

FIG. 20 is a plot of data showing that the synthetic diindole compound 3-((1H-indol-2-yl)methyl)-1H-indole is active against *Culex quinquefasciatus* larvae. Shown is a representative dose curve for 3-((1H-indol-2-yl)methyl)-1H-indole applied to *C. quinquefasciatus* larvae. Mortality data were plotted against $\log_{10}$-transformed compound concentrations. An inhibitory dose-response curve was fitted using GraphPad Prism software. The representative curve fit shown corresponds to a 3-((1H-indol-2-yl)methyl)-1H-indole $LC_{50}$ of 1.5 μg/mL (95% CI [1.3, 1.7]). Error bars represent standard deviations calculated from four technical replicates (assay wells). The mean $LC_{50}$ calculated for 3-((1H-indol-2-yl)methyl)-1H-indole was 0.95±0.75 μg/mL (standard deviation calculated from two independent replicate dose curves for which the curve fit $R^2$ values were ≥0.75. Mortality in the negative control was not subtracted but was <10% for all assays.

FIG. 21 is a plot of data showing that indole trimer (e.g., metabolite 2 or tri-indole) and tetramer (e.g., metabolite 3 or tetra-indole) compounds display no activity against *Aedes aegypti* larvae compared to diindole compounds. Error bars represent standard deviations calculated from two technical replicates (assay wells).

It is to be understood that the figures are not necessarily drawn to scale, nor are the objects in the figures necessarily drawn to scale in relationship to one another. The figures are depictions that are intended to bring clarity and understanding to various embodiments of apparatuses, systems, and methods disclosed herein. Wherever possible, the same reference numbers will be used throughout the drawings to refer to the same or like parts. Moreover, it should be appreciated that the drawings are not intended to limit the scope of the present teachings in any way.

DETAILED DESCRIPTION

In this detailed description of the various embodiments, for purposes of explanation, numerous specific details are set forth to provide a thorough understanding of the embodiments disclosed. One skilled in the art will appreciate, however, that these various embodiments may be practiced with or without these specific details. In other instances, structures and devices are shown in block diagram form. Furthermore, one skilled in the art can readily appreciate that the specific sequences in which methods are presented and performed are illustrative and it is contemplated that the sequences can be varied and still remain within the spirit and scope of the various embodiments disclosed herein.

All literature and similar materials cited in this application, including but not limited to, patents, patent applications, articles, books, treatises, and internet web pages are expressly incorporated by reference in their entirety for any purpose. Unless defined otherwise, all technical and scientific terms used herein have the same meaning as is commonly understood by one of ordinary skill in the art to which the various embodiments described herein belongs. When definitions of terms in incorporated references appear to differ from the definitions provided in the present teachings, the definition provided in the present teachings shall control. The section headings used herein are for organizational purposes only and are not to be construed as limiting the described subject matter in any way.

To facilitate an understanding of the present technology, a number of terms and phrases are defined below. Additional definitions are set forth throughout the detailed description.

Throughout the specification and claims, the following terms take the meanings explicitly associated herein, unless the context clearly dictates otherwise.

The phrase "in one embodiment" as used herein does not necessarily refer to the same embodiment, though it may. Furthermore, the phrase "in another embodiment" as used herein does not necessarily refer to a different embodiment, although it may. Thus, as described below, various embodiments of the invention may be readily combined, without departing from the scope or spirit of the invention.

In addition, as used herein, the term "or" is an inclusive "or" operator and is equivalent to the term "and/or" unless the context clearly dictates otherwise. The term "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

The term "based on" is not exclusive and allows for being based on additional factors not described, unless the context clearly dictates otherwise. In addition, throughout the specification, the meaning of "a", "an", and "the" include plural references. The meaning of "in" includes "in" and "on."

As used herein, the terms "about", "approximately", "substantially", and "significantly" are understood by persons of ordinary skill in the art and will vary to some extent on the context in which they are used. If there are uses of these terms that are not clear to persons of ordinary skill in the art given the context in which they are used, "about" and "approximately" mean plus or minus less than or equal to 10% of the particular term and "substantially" and "significantly" mean plus or minus greater than 10% of the particular term.

As used herein, disclosure of ranges includes disclosure of all values and further divided ranges within the entire range, including endpoints and sub-ranges given for the ranges. As used herein, the disclosure of numeric ranges includes the endpoints and each intervening number therebetween with the same degree of precision. For example, for the range of 6-9, the numbers 7 and 8 are contemplated in addition to 6 and 9, and for the range 6.0-7.0, the numbers 6.0, 6.1, 6.2, 6.3, 6.4, 6.5, 6.6, 6.7, 6.8, 6.9, and 7.0 are explicitly contemplated.

As used herein, the suffix "-free" refers to an embodiment of the technology that omits the feature of the base root of the word to which "-free" is appended. That is, the term "X-free" as used herein means "without X", where X is a feature of the technology omitted in the "X-free" technology. For example, a "calcium-free" composition does not comprise calcium, a "mixing-free" method does not comprise a mixing step, etc.

Although the terms "first", "second", "third", etc. may be used herein to describe various steps, elements, compositions, components, regions, layers, and/or sections, these steps, elements, compositions, components, regions, layers, and/or sections should not be limited by these terms, unless otherwise indicated. These terms are used to distinguish one step, element, composition, component, region, layer, and/or section from another step, element, composition, component, region, layer, and/or section. Terms such as "first", "second", and other numerical terms when used herein do not imply a sequence or order unless clearly indicated by the context. Thus, a first step, element, composition, component, region, layer, or section discussed herein could be termed a second step, element, composition, component, region, layer, or section without departing from technology.

As used herein, the word "presence" or "absence" (or, alternatively, "present" or "absent") is used in a relative sense to describe the amount or level of a particular entity (e.g., component, action, element). For example, when an entity is said to be "present", it means the level or amount of this entity is above a pre-determined threshold; conversely, when an entity is said to be "absent", it means the level or amount of this entity is below a pre-determined threshold. The pre-determined threshold may be the threshold for detectability associated with the particular test used to detect the entity or any other threshold. When an entity is "detected" it is "present"; when an entity is "not detected" it is "absent".

As used herein, an "increase" or a "decrease" refers to a detectable (e.g., measured) positive or negative change, respectively, in the value of a variable relative to a previously measured value of the variable, relative to a pre-established value, and/or relative to a value of a standard control. An increase is a positive change preferably at least 10%, more preferably 50%, still more preferably 2-fold, even more preferably at least 5-fold, and most preferably at least 10-fold relative to the previously measured value of the variable, the pre-established value, and/or the value of a standard control. Similarly, a decrease is a negative change preferably at least 10%, more preferably 50%, still more preferably at least 80%, and most preferably at least 90% of the previously measured value of the variable, the pre-established value, and/or the value of a standard control. Other terms indicating quantitative changes or differences, such as "more" or "less," are used herein in the same fashion as described above.

Where a term is provided in the singular, embodiments comprising the plural of that term are also provided.

As used herein, the terms "include," "includes," and "including" are to be construed as at least having the features to which they refer while not excluding any additional unspecified features.

As used herein, the term "insect" refers to any stage of an insect's life cycle (egg, larva, pupa, or adult).

As used herein, the term "egg" refers to both fertilized and unfertilized eggs.

As used herein, the phrase "an insect inhibitory amount", refers to an amount of a composition that results in any measurable inhibition of insect motility, viability, growth, insect development, insect reproduction, insect egg laying, insect feeding behavior, insect mating behavior, and/or any measurable decrease in the adverse effects caused by insect feeding, egg laying or other interaction with a plant.

As used herein, the term "heterologous" refers to any element (e.g., a microorganism or any component thereof) that is in a context other than that which it occurs in nature.

As used herein, the term "heterologous" when used in reference to a gene or nucleic acid refers to a gene that has been manipulated in some way. For example, a heterologous gene includes a gene from one species introduced into another species. A heterologous gene also includes a gene native to an organism that has been altered in some way (e.g., mutated, added in multiple copies, linked to a non-native promoter or enhancer sequence, etc.). Heterologous genes are distinguished from endogenous genes in that the heterologous gene sequences are typically joined to nucleotide sequences comprising regulatory elements such as promoters that are not found naturally associated with the gene for the protein encoded by the heterologous gene or with endogenous gene sequences in the chromosome, or are associated with portions of the chromosome not found in nature (e.g., genes expressed in loci where the gene is not normally expressed).

As used herein, the term "host cell" refers to any cell capable of replicating and/or transcribing and/or translating a heterologous gene. Thus, a "host cell" refers to any eukaryotic or prokaryotic cell (e.g., plant cells, algal cells such as C. reinhardtii, bacterial cells such as yeast cells, E. coli, insect cells, etc.), whether located in vitro or in vivo. For example, a host cell may be located in a transgenic plant or located in a plant part or part of a plant tissue or in cell culture. In some embodiments, a host cell is a "heterologous host cell". As used herein, a "heterologous host cell" is a cell comprising a heterologous gene, e.g., a gene from an organism that is different than the heterologous host cell.

As used herein, the term "transgenic" when used in reference to a plant or leaf or fruit or seed, e.g., a "transgenic plant," transgenic leaf," "transgenic fruit," "transgenic seed," or a "transgenic host cell", refers to a plant or leaf or fruit or seed that contains at least one heterologous or foreign gene in one or more of its cells. The term "transgenic plant material" refers broadly to a plant, a plant structure, a plant tissue, a plant seed or a plant cell that contains at least one heterologous gene in one or more of its cells.

As used herein, the term "plant" is used in its broadest sense. It includes, but is not limited to, any species of grass (e.g. turf grass), ornamental or decorative, crop or cereal, fodder or forage, fruit or vegetable, fruit plant or vegetable plant, herb plant, woody plant, flower plant or tree. It is not meant to limit a plant to any particular structure. It also refers to a unicellular plant (e.g. microalga) and a plurality of plant cells that are largely differentiated into a colony (e.g. volvox) or a structure that is present at any stage of a plant's development. Such structures include, but are not limited to, a seed, a tiller, a sprig, a stolen, a plug, a rhizome, a shoot, a stem, a leaf, a flower petal, a fruit, et cetera. Transgenic plants may be produced using techniques known in the art.

The terms "protein," "polypeptide," "peptide," "encoded product," "amino acid sequence," are used interchangeably to refer to compounds comprising amino acids joined via peptide bonds and a "protein" encoded by a gene is not limited to the amino acid sequence encoded by the gene, but includes post-translational modifications of the protein. Where the term "amino acid sequence" is recited herein to refer to an amino acid sequence of a protein molecule, the term "amino acid sequence" and like terms, such as "polypeptide" or "protein" are not meant to limit the amino acid sequence to the complete, native amino acid sequence associated with the recited protein molecule. Furthermore, an "amino acid sequence" can be deduced from the nucleic acid sequence encoding the protein. The deduced amino acid sequence from a coding nucleic acid sequence includes sequences which are derived from the deduced amino acid sequence and modified by post-translational processing, where modifications include but not limited to glycosylation, hydroxylations, phosphorylations, and amino acid deletions, substitutions, and additions. Thus, an amino acid sequence comprising a deduced amino acid sequence is understood to include post-translational modifications of the encoded and deduced amino acid sequence. The term "X" may represent any amino acid.

The term "sequence identity" means that two polynucleotide or two polypeptide sequences are identical (i.e., on a nucleotide-by-nucleotide basis or amino acid basis) over the window of comparison. The term "percentage of sequence identity" is calculated by comparing two optimally aligned sequences over the window of comparison, determining the number of positions at which the identical nucleic acid base (e.g., A, T, C, G, U, or I) or amino acid, in which often conserved amino acids are taken into account, occurs in both sequences to yield the number of matched positions, dividing the number of matched positions by the total number of positions in the window of comparison (i.e., the window size), and multiplying the result by 100 to yield the percentage of sequence identity. The terms "substantial identity" as used herein denotes a characteristic of a polynucleotide sequence, wherein the polynucleotide comprises a sequence that has at least 85 percent sequence identity, preferably at least 90 to 95 percent sequence identity, more usually at least 99 percent sequence identity as compared to a reference sequence over a comparison window of at least 20 nucleotide positions, frequently over a window of at least 25-50 nucleotides, wherein the percentage of sequence identity is calculated by comparing the reference sequence to the polynucleotide sequence which may include deletions or additions which total 20 percent or less of the reference sequence over the window of comparison. The reference sequence may be a subset of a larger sequence, for example, as a segment of the full-length sequences of the compositions claimed in the present invention.

The term "expression" when used in reference to a nucleic acid sequence, such as a gene, refers to the process of converting genetic information encoded in a gene into RNA (e.g., mRNA, rRNA, tRNA, or snRNA) through "transcription" of the gene (i.e., via the enzymatic action of an RNA polymerase), and into protein where applicable (as when a gene encodes a protein), through "translation" of mRNA.

As used herein, a "system" refers to a plurality of real and/or abstract components operating together for a common purpose. In some embodiments, a "system" is an integrated assemblage of hardware and/or software components. In some embodiments, each component of the system interacts with one or more other components and/or is related to one or more other components. In some embodiments, a system refers to a combination of components and software for controlling and directing methods. For example, a "system" or "subsystem" may comprise one or more of, or any combination of, the following: mechanical devices, hardware, components of hardware, circuits, circuitry, logic design, logical components, software, software modules, components of software or software modules, software procedures, software instructions, software routines, software objects, software functions, software classes, software programs, files containing software, etc., to perform a function of the system or subsystem. Thus, the methods and apparatus of the embodiments, or certain aspects or portions thereof, may take the form of program code (e.g., instructions) embodied in tangible media, such as floppy diskettes, CD-ROMs, hard drives, flash memory, or any other machine-readable storage medium wherein, when the program code is loaded into and executed by a machine, such as a computer, the machine becomes an apparatus for practicing the embodiments. In the case of program code execution on programmable computers, the computing device generally includes a processor, a storage medium readable by the processor (e.g., volatile and non-volatile memory and/or storage elements), at least one input device, and at least one output device. One or more programs may implement or utilize the processes described in connection with the embodiments, e.g., through the use of an application programming interface (API), reusable controls, or the like. Such programs are preferably implemented in a high-level procedural or object-oriented programming language to communicate with a computer system. However, the program(s) can be implemented in assembly or machine language, if desired. In any case, the language may be a compiled or interpreted language, and combined with hardware implementations.

As used herein, the term "biological system" refers to a collection of genes, enzymes, activities, or functions that operate together to provide a metabolic pathway or metabolic network. A biological system may also be described in terms of nutrient flux, energy flux, electrochemical gradients, metabolic inputs (biological reactants), and metabolic outputs (biological products), e.g., that provide for conversion of energy inputs into energy for biological processes, anabolic synthesis of biomolecules, and elimination of wastes.

As used herein, the term "metabolic pathway" refers to a set of connected metabolic, biochemical, and physical processes that transform a metabolic input to a metabolic output in a series of steps and intermediates.

As used herein, the term "metabolic network" refers to a set of connected metabolic pathways. A metabolic network may transform a metabolic input to a metabolic output in a series of steps and intermediates.

As used herein, the terms "microbial", "microbial organism", and "microorganism" refer to an organism that exists as a microscopic cell that is included within the domains of Archaea, Bacteria, or Eukarya in the three-domain system (see Woese (1990) Proc Natl Acad Sci USA 87: 4576-79, incorporated herein by reference), the latter including yeast and filamentous fungi, protozoa, algae, or higher Protista. Therefore, the term is intended to encompass prokaryotic or eukaryotic cells or organisms having a microscopic size and includes bacteria, archaea, and eubacteria of all species as well as eukaryotic microorganisms such as yeast and fungi. Also included are cell cultures of any species that can be cultured for the production of a chemical. The terms "microbial cells" and "microbes" are used interchangeably with the term "microorganism". The terms "bacteria" and "bacterium" and "archaea" and "archaeon" refer to prokaryotic organisms of the domain Bacteria and Archaea in the three-domain system.

The term "Archaea" refers to a taxonomic domain of organisms typically found in unusual environments and distinguished from the rest of the prokaryotes by several criteria, including the number of ribosomal proteins and the lack of muramic acid in cell walls. On the basis of small subunit rRNA analysis, the Archaea consist of two phylogenetically-distinct groups: Crenarchaeota and Euryarchaeota. On the basis of their physiology, the Archaea can be organized into three types: methanogens (prokaryotes that produce methane); extreme halophiles (prokaryotes that live at very high concentrations of salt (NaCl); and extreme (hyper) thermophiles (prokaryotes that live at very high temperatures). Besides the unifying archaeal features that distinguish them from Bacteria (e.g., no murein in cell wall, ester-linked membrane lipids, etc.), these prokaryotes exhibit unique structural or biochemical attributes which adapt them to their particular habitats. The Crenarchaeota consist mainly of hyperthermophilic sulfur-dependent prokaryotes and the Euryarchaeota contain the methanogens and extreme halophiles.

The term "Bacteria" or "eubacteria" refers to a domain of prokaryotic organisms. Bacteria include at least 11 distinct groups as follows: (1) Gram-positive (gram+) bacteria, of which there are two major subdivisions: (1) high G+C group (Actinomycetes, Mycobacteria, *Micrococcus*, others) (2) low G+C group (*Bacillus*, Clostridia, *Lactobacillus*, Staphylococci, Streptococci, Mycoplasmas); (2) Proteobacteria, e.g., Purple photosynthetic+non-photosynthetic Gram-negative bacteria (includes most "common" Gram-negative bacteria); (3) Cyanobacteria, e.g., oxygenic phototrophs; (4) Spirochetes and related species; (5) *Planctomyces*; (6) *Bacteroides*, Flavobacteria; (7) *Chlamydia*; (8) Green sulfur bacteria; (9) Green non-sulfur bacteria (also anaerobic phototrophs); (10) Radioresistant micrococci and relatives; (11) Thermotoga and Thermosipho thermophiles.

"Gram-negative bacteria" include cocci, nonenteric rods, and enteric rods. The genera of Gram-negative bacteria include, for example, *Neisseria, Spirillum, Pasteurella, Brucella, Yersinia, Francisella, Haemophilus, Bordetella, Escherichia, Salmonella, Shigella, Klebsiella, Proteus, Vibrio, Pseudomonas, Bacteroides, Acetobacter, Aerobacter, Agrobacterium, Azotobacter, Spirilla, Serratia, Rhizobium, Chlamydia, Rickettsia, Treponema*, and *Fusobacterium*.

"Gram positive bacteria" include cocci, nonsporulating rods, and sporulating rods. The genera of gram positive bacteria include, for example, *Actinomyces, Bacillus, Clostridium, Corynebacterium, Erysipelothrix, Lactobacillus, Listeria, Mycobacterium, Myxococcus, Nocardia, Staphylococcus, Streptococcus*, and *Streptomyces*.

As used herein, the term "genus" is defined as a taxonomic group of related species according to the Taxonomic Outline of Bacteria and Archaea (Garrity et al. (2007) The Taxonomic Outline of Bacteria and Archaea. TOBA Release 7.7, March 2007. Michigan State University Board of Trustees).

As used herein, the term "species" is defined as a collection of closely related organisms with greater than 97% 16S ribosomal RNA sequence homology and greater than 70% genomic hybridization and sufficiently different from all other organisms so as to be recognized as a distinct unit.

As used herein, the term "strain" as used herein in reference to a microorganism describes an isolate of a microorganism considered to be of the same species but with a unique genome and, if nucleotide changes are non-synonymous, a unique proteome differing from other strains of the same organism. Strains may differ in their non-chromosomal genetic complement. Typically, strains are the result of isolation from a different host or at a different location and time, but multiple strains of the same organism may be isolated from the same host.

As used herein, the term "naturally occurring" as applied to a nucleic acid, an enzyme, a cell, or an organism, refers to a nucleic acid, enzyme, cell, or organism that is found in nature. For example, a polypeptide or polynucleotide sequence that is present in an organism that can be isolated from a source in nature and that has not been intentionally modified by a human in the laboratory is naturally occurring.

As used herein, the term "non-naturally occurring" as applied to a nucleic acid, an enzyme, a cell, or an organism refers to a nucleic acid, an enzyme, a cell, or an organism that has at least one genetic alteration not normally found in the naturally occurring nucleic acid, enzyme, cell, or organism. Genetic alterations include, for example, modifications introducing expressible nucleic acids encoding metabolic polypeptides, other nucleic acid additions, nucleic acid deletions, and/or other functional disruption of the microbial genetic material. Such modifications include, for example, coding regions and functional fragments thereof, for heterologous, homologous, or both heterologous and homologous polypeptides for the referenced species. Additional modifications include, for example, non-coding regulatory regions in which the modifications alter expression of a gene or operon.

As used herein, the term "in vitro" refers to an artificial environment and to processes or reactions that occur within an artificial environment. In vitro environments include, but are not limited to, test tubes and cell cultures. The term "in vivo" refers to the natural environment (e.g., an animal or a cell) and to processes or reactions that occur within a natural environment.

As used herein, the term "cell culture" refers to any in vitro culture of cells, including, e.g., prokaryotic cells and eukaryotic cells. Included within this term are continuous cell lines, primary cell cultures, transformed cell lines, finite cell lines (e.g., non-transformed cells), bacterial or archaeal cultures in or on solid or liquid media, and any other cell population maintained in vitro.

As used herein, the term "culturable organism" refers to a living organism that can be maintained and grown in a laboratory. In some embodiments, a culturable organism may not be maintained and grown in a laboratory in a pure culture free of other organisms and so may be referred to as an "unculturable organism" with respect to growing as a pure culture. However, in some embodiments, such an organism may be grown in a laboratory in a microbial consortium comprising at least one other organism and so may be a "culturable organism" with respect to the consortium and be also an "unculturable organism" with respect to being grown in a pure culture without the other member(s) of the consortium.

As used herein, "isolate", "isolated", "isolated microbe", and like terms are intended to mean that the one or more microorganisms has been separated from at least one of the materials with which it is associated in a particular environment (for example, soil, water, or a higher multicellular organism). Thus, an "isolated microbe" does not exist in its naturally occurring environment; rather, through the various techniques described herein, the microbe has been removed from its natural setting and placed into a non-naturally occurring state of existence. Thus, the isolated strain may exist as, for example, a biologically pure culture, or as spores (or other forms of the strain) in association with a carrier composition. In certain aspects of the disclosure, the isolated microbes exist as isolated and biologically pure cultures. It will be appreciated by one of skill in the art that an isolated and biologically pure culture of a particular microbe denotes that said culture is substantially free (within scientific reason) of other living organisms and contains only the individual microbe in question. The culture can contain varying concentrations of said microbe, and isolated and biologically pure microbes often necessarily differ from less pure or impure materials. Furthermore, in some aspects, the disclosure provides for certain quantitative measures of the concentration, or purity limitations, that are found within an isolated and biologically pure microbial culture. The presence of these purity values, in certain embodiments, is a further attribute that distinguishes the presently disclosed microbes from those microbes existing in a natural state.

As used herein, "genome" refers to the genetic material (e.g., chromosome) of an organism.

As used herein, the term "gene" refers to a nucleic acid molecule that comprises a nucleic acid sequence that encodes a polypeptide or non-coding RNA and the expression control sequences that are operably linked to the nucleic acid sequence that encodes the polypeptide or non-coding RNA. For instance, a gene may comprise a promoter, one or more enhancers, a nucleic acid sequence that encodes a polypeptide or a non-coding RNA, downstream regulatory sequences and, possibly, other nucleic acid sequences involved in regulating the transcription of an RNA from the gene.

As used herein, the term "genetic basis" refers to the underlying genetic or genomic cause of a particular observation.

As used herein, the term "genetic" refers to the heritable information encoded in the sequence of DNA nucleotides. As such, the term "genetic characterization" is intended to mean the sequencing, genotyping, comparison, mapping, or other assay of information encoded in DNA.

As used herein, the term "genetic material" refers to the DNA within an organism that is passed along from one generation to the next. Normally, genetic material refers to the genome of an organism. Extra-chromosomal elements, such as organelle or plasmid DNA, can also be a part of the genetic material that determines organism properties.

The term "polynucleotide" is used herein interchangeably with the term "nucleic acid" and refers to an organic polymer composed of two or more monomers including nucleotides, nucleosides or analogs thereof, including but not limited to single stranded or double stranded, sense or antisense deoxyribonucleic acid (DNA) of any length and, where appropriate, single stranded or double stranded, sense or antisense ribonucleic acid (RNA) of any length, including siRNA. The term "nucleotide" refers to any of several compounds that consist of a ribose or deoxyribose sugar joined to a purine or a pyrimidine base and to a phosphate group, and that are the basic structural units of nucleic acids. The term "nucleoside" refers to a compound (as guanosine or adenosine) that consists of a purine or pyrimidine base combined with deoxyribose or ribose and is found especially in nucleic acids. The term "nucleotide analog" or "nucleoside analog" refers, respectively, to a nucleotide or nucleoside in which one or more individual atoms have been replaced with a different atom or with a different functional group. Accordingly, the term polynucleotide includes nucleic acids of any length, DNA, RNA, analogs and fragments thereof. A polynucleotide of three or more nucleotides is also called nucleotidic oligomer or oligonucleotide.

It is understood that the polynucleotides described herein include "genes" and that the nucleic acid molecules described herein include "vectors" or "plasmids." Accordingly, the term "gene", also called a "structural gene" refers to a polynucleotide that codes for a particular sequence of amino acids, which comprise all or part of one or more proteins or enzymes, and may include regulatory (non-transcribed) DNA sequences, such as promoter sequences, which determine for example the conditions under which the gene is expressed. The transcribed region of the gene may include untranslated regions, including introns, 5'-untranslated region (UTR), and 3'-UTR, as well as the coding sequence.

The term "enzyme" as used herein refers to any substance that catalyzes or promotes one or more chemical or biochemical reactions, which usually includes enzymes totally or partially composed of a polypeptide or polypeptides, but can include enzymes composed of a different molecule including polynucleotides.

The term "homolog" as used herein with respect to an original enzyme or gene of a first family or species, refers to distinct enzymes or genes of a second family or species which are determined by functional, structural, or genomic analyses to be an enzyme or gene of the second family or species which corresponds to the original enzyme or gene of the first family or species. Homologs most often have functional, structural, or genomic similarities. Techniques are known by which homologs of an enzyme or gene can readily be cloned using genetic probes and PCR. Identity of cloned sequences as homologs can be confirmed using functional assays and/or by genomic mapping of the genes.

As used herein, the term "taxonomic unit" is a group of organisms that are considered similar enough to be treated as a separate unit. A taxonomic unit may comprise a family, genus, species, or population within a species (e.g., strain), but is not limited as such.

As used herein, the term "operational taxonomic unit" (OTU) refers to a group of microorganisms considered similar enough to be treated as a separate unit. An OTU may comprise a taxonomic family, genus, or species but is not limited as such. OTUs are frequently defined by comparing nucleotide sequences between organisms. In certain cases, the OTU may include a group of microorganisms treated as a unit based on, e.g., a sequence identity of ≥97%, ≥95%, ≥90%, ≥80%, or ≥70% among at least a portion of a differentiating biomarker, such as the 16S rRNA gene.

As used herein, "environmental sample" means a sample taken or acquired from any part of the environment (e.g., ecosystem, ecological niche, habitat, etc.) An environmental sample may include liquid samples from a river, lake, pond, ocean, glaciers, icebergs, rain, snow, sewage, reservoirs, tap water, drinking water, etc.; solid samples from soil, compost, sand, rocks, concrete, wood, brick, sewage, etc.; and gaseous samples from the air, underwater heat vents, industrial exhaust, vehicular exhaust, etc.

To the extent to which any of the preceding definitions is inconsistent with definitions provided in any patent or non-patent reference incorporated herein by reference, any patent or non-patent reference cited herein, or in any patent or non-patent reference found elsewhere, it is understood that the preceding definition will be used herein.

Provided herein are insect inhibitory compositions comprising certain *Chryseobacterium* strains, plant parts treated with the compositions, methods of using the compositions to control insects, and methods of making the compositions. Insect inhibitory compositions provided herein provide for inhibition of insect viability, insect growth, insect development, insect reproduction, insect egg laying, insect feeding behavior, insect mating behavior and/or any measurable decrease in the adverse effects caused by insect (e.g., damage to a plant including reductions in yield, fruit quality, and the like; numbers of insects present in a sample, numbers of insects carrying viruses and/or parasites). In certain embodiments, such insect inhibitory activity of the compositions is increased in comparison to untreated controls and/or controls comprising a mock composition lacking insect inhibitory microorganisms and/or compounds. In certain embodiments, such insect inhibitory activity of the compositions is increased against insects that have acquired resistance to other insect inhibitory microorganisms and/or compounds with distinct modes-of-action in comparison to untreated control compositions, controls treated with a mock composition lacking insect inhibitory microorganisms and/or compounds, and/or control compositions comprising other insect inhibitory microorganisms and/or compounds with distinct modes-of-action.

*Chryseobacterium* strains that can be used in the compositions, plant parts, and methods provided herein include strains characterized by the presence of particular genes. In certain embodiments, the *Chryseobacterium* strain can comprise: (a) at least one gene and/or coding region encoding a protein with at least 95%, 96%, 97%, 98%, 99%, 99.5%, 99.8%, 99.9%, or 100% sequence identity across the entire length of SEQ ID NO: 1 (MKCIGJBJ_03627 DNA gyrase subunit A), at least 95%, 96%, 97%, 98%, 99%, 99.5%, 99.8%, 99.9%, or 100% sequence identity across the entire length of SEQ ID NO: 2 (MKCIGJBJ_03079 DNA topoisomerase 1), at least 95%, 96%, 97%, 98%, 99%, 99.5%, 99.8%, 99.9%, or 100% sequence identity across the entire length of SEQ ID NO: 3 (MKCIGJBJ_00500 DNA-directed RNA polymerase subunit beta), at least 95%, 96%, 97%, 98%, 99%, 99.5%, 99.8%, 99.9%, or 100% sequence identity across the entire length of SEQ ID NO: 4 (MKCIGJBJ_00499 DNA-directed RNA polymerase subunit beta'), and/or at least 95%, 96%, 97%, 98%, 99%, 99.5%, 99.8%, 99.9%, or 100% sequence identity across the entire length of SEQ ID NO: 5 (MKCIGJBJ_02095 DNA-directed RNA polymerase subunit alpha; (b) at least one gene and/or coding region encoding a protein with at least 95%, 96%, 97%, 98%, 99%, 99.5%, 99.8%, 99.9%, or 100% sequence identity across the entire length of a sequence contained in Appendix A (PLU6_1-PLU6_352; SEQ ID NO: 851-1202); or (c) any combination of gene and/or coding regions of (a) and/or genes and/or coding regions of (b).

In certain embodiments, the *Chryseobacterium* strain can comprise: (a) at least one gene comprising a sequence with at least 80%, 90%, 95%, 98%, 99%, 99.5%, 99.8%, 99.9%, or 100% sequence identity across the entire length of a gene described above wherein the gene sequence can be found within SEQ ID NO: 77, or found within or comprises or consists of SEQ ID NOs: 6-76.

Any of the aforementioned *Chryseobacterium* strains that can be used in the compositions and methods provided herein are hereinafter referred to as "PLU6-type" strains, "PLU6-type" bacteria, "PLU6-type" monocultures, and the like. In certain embodiments, the compositions will comprise PLU6-type bacteria at a concentration of least $1\times10^6$, $2\times10^6$, $5\times10^6$, $1\times10^7$, $2\times10^7$, $5\times10^7$, $1\times10^8$, $2\times10^8$, or $5\times10^8$ colony forming units (CFU) per milliliter of the composition or at a titer of at least $1\times10^6$, $2\times10^6$, $5\times10^6$, $1\times10^7$, $2\times10^7$, $5\times10^7$, $1\times10^8$, $2\times10^8$, or $5\times10^8$ colony forming units (CFU) per gram of the composition. In certain embodiments, the compositions will comprise PLU6-type bacteria at a concentration of $1\times10^6$, $2\times10^6$, $5\times10^6$, $1\times10^7$, or $2\times10^7$ to about $5\times10^7$, $1\times10^8$, $2\times10^8$, or $5\times10^8$ colony forming units (CFU) per milliliter of the composition or at a titer of $1\times10^6$, $2\times10^6$, $5\times10^6$, $1\times10^7$, or $2\times10^7$ to about $5\times10^7$, $1\times10^8$, $2\times10^8$, or $5\times10^8$ colony forming units (CFU) per gram of the composition. A representative PLU6-type strain, PLU6, that can be used in the compositions, plant parts, and methods provided herein was deposited with the AMERICAN TYPE CULTURE COLLECTION (ATCC) under the terms of the Budapest Treaty on the International Recognition of the Deposit of Microorganisms for the Purposes of Patent Procedure. The above deposit was made on May 18, 2021, pursuant to the terms of the Budapest Treaty, and is intended to meet the requirements of 37 CFR § 1.801-1.809. The deposit was made under Patent Deposit Number PTA-127072. Access to the deposits will be available upon request during the pendency of the application to the Commissioner of Patents and Trademarks and persons determined by the Commissioner to be entitled thereto. All restrictions upon availability to the public will be irrevocably removed upon granting of the patent. The deposit will be maintained in the CECT Depository, which is a public depository, for a period of 30 years, or 5 years after the most recent request, or for the enforceable life of the patent, whichever is longer. The viability of the deposit will be tested and will be replaced if it becomes nonviable during that period. Upon allowance of any claims in the application, Applicant will maintain and will make this deposit available to the public, pursuant to the Budapest Treaty.

Variants and/or progeny of the deposited strain PLU6 (ATCC Patent Deposit Number PTA-127072) comprising any of the aforementioned genes and/or provided at any of the aforementioned concentrations can also be used in the compositions, plant parts, and methods provided herein. Such variants can be obtained by genetic transformation or gene-editing (e.g., CRISPR-Cas9 editing) of the deposited strain PLU6 (ATCC Patent Deposit Number PTA-127072). Methods for editing PLU6 can be adapted from methods disclosed for editing bacterial genomes (e.g., Altenbuchner, J., Appl Environ Microbiol. 2016, 82(17):5421-7. doi: 10.1128/AEM.01453-16). Such progeny can be obtained by culturing the deposited strain PLU6 (ATCC Patent Deposit Number PTA-127072) or by isolation of progeny from products containing or treated with the PLU6 strain (e.g., compositions comprising PLU6, plants or plant parts treated with PLU6, environmental samples treated with PLU6 including soil, water, and the like).

Insects inhibited by the aforementioned compositions include Dipteran insects (e.g. *Aedes* sp., *Anopheles* sp., *Culex* sp., *Ceratitis* sp., a *Delia* sp., *Mayetolia* sp., *Rhagoletis* sp., *Anastrepha* sp. a *Glossina* sp., a *Musca* sp., *Cochliomyia* sp., *Chrysops* sp., *Simulium* sp., *Phlebotomus* sp., *Culicoides* sp., or *Dermatobia* sp.).

Methods for identifying PLU6-type bacteria, as well as compositions, environmental samples (e.g., water, soil, and the like), and plant parts comprising and/or treated with such bacteria are also provided herein. In certain embodiments, the PLU6-type bacteria can be detected by detecting a protein or ortholog thereof having at least 95%, 96%, 97%, 98%, 99%, 99.5%, 99.8%, 99.9%, or 100% sequence identity across the entire length of SEQ ID NO: 1-5 and/or a sequence contained in Appendix A (PLU6_1-PLU6_352; SEQ ID NO: 851-1202). Such proteins can be detected by methods including immunological-based detection and/or mass-spectrometry based detection. In certain embodiments, the PLU6-type bacteria can be detected by detecting a gene or ortholog thereof having at least 80%, 90%, 95%, 96%, 97%, 98%, 99%, 99.5%, 99.8%, 99.9%, or 100% sequence identity across the entire length of a PLU6 gene as described herein. Such genes can be detected by methods including hybridization-based, PCR-based, chain elongation-based, nanopore-based, sequencing-based, and/or mass spectrometry-based nucleic acid detection methods.

PLU6-type monocultures used in the compositions, plant parts, and methods as well as cultures or harvested PLU6-type monocultures provided herein include embodiments that are essentially free of contaminating organisms. Such contaminating microorganisms are microorganisms other than the desired PLU6-type strain of the monoculture. In certain embodiments, the contaminating microorganisms are of an indeterminate origin and arise through inadvertent infection of the PLU6-type monocultures. In certain embodiments, the compositions or cultures comprising the harvested PLU6-type monocultures that are essentially free of contaminating microorganisms comprise less than about 5%, 3%, 2%, 1%, 0.5%, 0.2%, or 0.1% by mass, colony forming units, or metagenomic analysis contaminating microorganisms other than the desired PLU6-type strain of the monoculture. In certain embodiments, compositions useful in the practice of the methods of inhibiting insects provided herein do not need to be entirely free of contaminating microorganisms. In certain embodiments where compositions for use as insect inhibitory agents are formulated under non-aseptic conditions, it is anticipated that some levels of contaminating microorganisms (e.g., less than about 5%, 3%, 2%, 1%, 0.5%, 0.2%, or 0.1% by mass, colony forming units, or metagenomic analysis) can be present without reducing the insect inhibitory activity of the composition to unacceptable levels. In certain embodiments, the compositions, cultures, or harvested PLU6-type strains that are free of contaminating microorganisms comprise 0% by mass, colony forming units, or metagenomic analysis contaminating microorganisms other than the desired PLU6-type strains. Methods for assessing contamination by metagenome analysis can be adapted from various disclosed methods for use in assessing contamination of laboratory reagents (e.g., Salter et al., BMC Biology, 2014, 12:87 (doi.org/10.1186/s12915-014-0087-z)).

Monocultures of the desired PLU6-type strains that are essentially free of contaminating organisms can be obtained by culturing an uncontaminated isolate of the strain under axenic conditions. Such axenic conditions can be achieved by sterilizing culture media by methods that include heat and pressure treatment (e.g., in an autoclave), filtration (e.g., in a filter having a pore size of 0.45 micrometers or less), irradiation, plasma treatment, and any combination of such techniques.

In certain embodiments, compositions comprising the PLU6-type strains can further comprise additional desirable microorganisms or viruses. Such desirable microorganisms or viruses include: (a) microorganisms that inhibit the same insect pest or class of insect pests as the PLU6-type strains by a different mode-of-action; (b) microorganisms or viruses that inhibit wholly distinct insect pests or classes of insect pests (e.g., Coleopteran, Lepidopteran, and/or Hymenopteran insect pests) or other plant pathogenic or pathogenic bacteria, fungi, or nematodes; and/or (c) microorganisms that improve plant yield (e.g., nitrogen-fixing bacteria such as *Rhizobium* or *Bradyrhizobium*). Microorganisms or viruses that inhibit the same insect pest or class of insect pests as the PLU6-type strains by a different mode-of-action; (b) microorganisms that inhibit wholly distinct insect pests or classes of insect pests (e.g., Coleopteran, Lepidopteran, and/or Hymenopteran insect pests) or other plant pathogenic or pathogenic bacteria, fungi, or nematodes include various microorganisms disclosed in US Patent Application publication US20180049435, which is incorporated herein by reference in its entirety. Useful microorganisms or viruses with insecticidal, acaricidal, molluscidal and/or nematicidal activity include *Agrobacterium radiobacter*, *Bacillus* sp., (e.g., *B. cereus*, *B. firmus*, *B. thuringiensis*, *B. thuringiensis* ssp. *aizawai*, *B. t.* ssp. *israelensis*, *B. t.* ssp. *galleriae*, *B. t.* ssp. *kurstaki*, *B. t.* ssp. *tenebriones*), *Beauveria bassiana*, *B. brongniartii*, *Burkholderia* sp., *Chromobacterium subtsugae*, *Cydia pomonella granulovirus* (CpGV), *Cryptophlebia leucotreta granulovirus* (CrleGV), *Flavobacterium* sp., *Helicoverpa armigera nucleopolyhedrovirus* (HearNPV), *Helicoverpa zea nucleopolyhedrovirus* (HzNPV), *Helicoverpa zea* single capsid nucleopolyhedrovirus (HzSNPV), *Heterorhabditis bacteriophora*, *Isaria fumosorosea*, *Lecanicillium longisporum*, *L. muscarium*, *Metarhizium anisopliae*, *Metarhizium anisopliae* var. *anisopliae*, *M anisopliae* var. *acridum*, *Nomuraea rileyi*, *Paecilomyces fumosoroseus*, *P. lilacinus*, *Paenibacillus popilliae*, *Pasteuria* sp., *P. nishizawae*, *P. penetrans*, *P. ramosa*, *P. thornea*, *P. usgae*, *Pseudomonas fluorescens*, *Spodoptera littoralis nucleopolyhedrovirus* (SpliNPV), *Steinernema carpocapsae*, *S. feltiae*, *S. kraussei*, *Streptomyces galbus*, and *S. microjlavus*. Useful microorganisms or viruses with fungicidal, bactericidal, viricidal and/or plant defense activator activity that can be combined with the PLU6-type strains include *Ampelomyces quisqualis*, *Aspergillus flavus*, *Aureobasidium pullulans*, *Bacillus* sp. (e.g. *B. altitudinis*, *B. amyloliquefaciens*, *B. megaterium*, *B. mojavensis*, *B. mycoides*, *B. simplex*, *B. solisalsi*, *B. subtilis*, *B. subtilis* var. *amyloliquefaciens*), *Candida oleophiia*, *C. saitoana*, *Clavibacter michiganensis* (bacteriophages), *Coniothyrium minitans*, *Cryphonectria parasitica*, *Cryptococcus albidus*, *Dilophosphora alopecuri*, *Fusarium oxysporum*, *Clonostachys rosea* f. *catenulate* (also named *Gliocladium catenulatum*), *Gliocladium roseum*, *Lysobacter antibioticus*, *L. enzymogenes*, *Metschnikowia fructicola*, *Microdochium dimerum*, *Microsphaeropsis ochracea*, *Muscodor albus*, *Paenibacillus alvei*, *Paenibacillus polymyxa*, *Pantoea vagans*, *Penicillium bilaiae*, *P. steckii*, *Phlebiopsis gigantea*, *Pseudomonas* sp.,

*Pseudomonas chloraphis, Pseudozyma jlocculosa, Pichia anomala, Pythium oligandrum, Sphaerodes mycoparasitica, Streptomyces griseoviridis, S. lydicus, S. violaceusniger, Talaromyces jlavus, Trichoderma asperelloides, T. asperellum, T. atroviride, T. fertile, T. gamsii, T. harmatum, T. harzianum, T. polysporum, T. stromaticum, T. vixens, T. viride, Typhula phacorrhiza, Ulocladium oudemansii*, and *Verticillium dahlia*. In certain embodiments, useful microorganisms or viruses with activity against Dipteran insects (e.g., *Aedes* sp., *Culex* sp., or *Anopheles* sp. *Mosquitos*, a *Ceratitis* sp., *Delia* sp., a *Glossina* sp., a *Musca* sp., *Cochliomyia* sp., *Chrysops* sp., *Simulium* sp., *Phlebotomus* sp., *Culicoides* sp., or *Dermatobia* sp.) are combined with the PLU6-type strains. In certain embodiments, PLU6-type strains are combined with a Dipteran active *Bacillus thuringiensis* (B. t) strain (e.g. B. t. subsp. *israelensis* (Bti) and/or a *Lysinibacillus sphaericus* (Ls) strain. In certain embodiments, PLU6-type strains are combined with a dipteran active *Bacillus thuringiensis* (B.t) strain which expresses a Cry1Ab, Cry1Ca, Cry2Aa, Cry4Aa, Cry4Ba, Cry11 Aa, Cry11B, Cry16A, Cyt1Aa, and/or Cyt2Aa protein. In certain embodiments, PLU6-type strains are combined with a dipteran active *C. bifermentans* subsp. *malaysia* strains expressing a dipteran insect inhibiting Cry 17A, Cry 18A, and/or Cry 19A protein. Microorganisms that express dipteran active toxins are disclosed in Schnepf, et al. Microb. Molec. Biol Rev. 1998; 62(3):775-806, at 791. In certain embodiments, the PLU6-type strains are combined with a Dipteran active *B. sphaericus* strains, including those expressing a binary toxin. Useful Dipteran active *B. sphaericus* strains that can be combined with the PLU6-type strains include the binary toxin expressing strains that have been disclosed, variants thereof, and related *B. sphaericus* strains (Porter et al. Microbiological Reviews, 1993, 57(4): 838-861).

In certain embodiments, compositions comprising the PLU6-type strains can further comprise insect inhibitory compounds. Insect inhibitory compounds that can be combined with the PLU6-type strains include organophosphate, pyrethroid, carbamate, chlorinated hydrocarbon, pyrethroid, spinosyn, spinosoid, nicotinoid, pyrazole, or pyrrole insecticides.

Compositions provided herein can include certain adjuvants and/or excipients. Such adjuvants are components added to the composition that can preserve and/or potentiate the insect inhibitory activity of the PLU6-type strains. Contemplated adjuvants include those that are naturally occurring and those that are non-naturally occurring. Broad categories of adjuvants that can be used include agents that promote distribution or retention of the composition or insect inhibitory activity of the composition onto or within a treatment target (e.g., standing water, soil, and/or a plant part). Surfactants that can be used as adjuvants include anionic, cationic, nonionic and amphoteric surfactants, block polymers, polyelectrolytes, and mixtures thereof. Such surfactants can serve as an emulsifier, dispersant, solubilizer, wetter, penetration enhancer, and/or protective colloid in compositions comprising the PLU6-type bacteria or monocultures provided herein. Anionic surfactants that can be used include alkali, alkaline earth or ammonium salts of sulfonates (e.g., alkylarylsulfonates, diphenylsulfonates, alpha-olefin sulfonates, lignin sulfonates, sulfonates of fatty acids and oils, sulfonates of ethoxylated alkylphenols, sulfonates of alkoxylated arylphenols, sulfonates of condensed naphthalenes, sulfonates of dodecyl- and tridecylbenzenes, sulfonates of naphthalenes and alkylnaphthalenes, sulfosuccinates, sulfosuccinamate-sulfates, or combinations thereof), sulfates (e.g., sulfates of fatty acids and oils, of ethoxylated alkylphenols, of alcohols, of ethoxylated alcohols, or of fatty acid esters), phosphates (e.g., phosphate esters), carboxylates (e.g. alkyl carboxylates, carboxylated alcohol ethoxylates, or carboxylated alkylphenol ethoxylates), and mixtures thereof. Other useful adjuvants include sticking agents (e.g., binders or tackifiers) particularly in embodiments where the composition is for application to a plant part (e.g., foliage, seed, roots, and the like) or soil. Sticking agents include polyvinylpyrrolidones, polyvinylacetates, polyvinyl alcohols, polyacrylates, biological or synthetic waxes, and cellulose ethers.

Other categories of adjuvants include components that increase shelf-life of the composition comprising the PLU6-type bacteria and/or whole cultures thereof (e.g., PLU6-type bacteria and fermentation broth). In certain embodiments, the shelf-life is extended by including desiccants and/or other agents that provide for maintaining the composition in a state that is essentially free of water. Such compositions that are essentially free of water include those with a water content of less than about 1%, 0.5%, 0.2%, or 0.1% by weight. In certain embodiments, the water content of a composition that is essentially free of water is about 1%, 0.5%, or 0.2% to about 0.1%, 0.05%, 0.02%, or 0.01% by weight. In certain embodiments, the compositions, including those that are essentially free of water, can include a lyophilized (i.e., freeze-dried) PLU6-type bacteria. Useful adjuvants used in such compositions comprising lyophilized PLU6-type bacterial cultures include various cryoprotectants (e.g., disaccharides such as sucrose, trehalose, proteins such as Bovine Serum Albumin and the like, glycine betaine, and combinations thereof).

Compositions comprising the PLU6-type bacteria provided herein can include certain excipients. In certain embodiments, such excipients are components added to the composition that are essentially inert and serve as bulking agents. In certain embodiments, a component of the composition can serve an excipient and an adjuvant. Examples of excipients used herein include mineral earths (e.g., silicates, silica gels, talc, kaolins, limestone, lime, chalk, clays, dolomite, diatomaceous earth, bentonite, calcium sulfate, magnesium sulfate, magnesium oxide), polysaccharides (e.g., cellulose, starch); and various plant products (e.g., bagasse, wood chips, or any other lignocellulosic biomass) and mixtures of any of the foregoing materials.

In certain embodiments, compositions comprising the PLU6-type bacteria can be an aqueous liquid, a non-aqueous liquid, or an emulsion comprising an aqueous and an immiscible and/or partially miscible non-aqueous liquid. Non-aqueous liquids that are used alone or in emulsions include mineral oils (e.g., kerosene and/or diesel oil); animal oils, plant oils (e.g., corn, soy, castor, rapeseed and/or any other oilseed oil, and the like); aliphatic, cyclic and aromatic hydrocarbons (e.g., toluene, paraffin, tetrahydronaphthalene, and/or alkylated naphthalenes); alcohols (e.g., propanol, butanol, benzylalcohol, and/or cyclo-hexanol); glycols; dimethyl sulfoxide (DMSO); ketones (e.g., cyclohexanone; esters (e.g., lactates, carbonates, fatty acid esters, gamma-butyrolactone); saturated and/or unsaturated fatty acids (e.g., stearic, palmitic, linolenic, linoleic, oleic, and the like); phosphonates; amines; amides (e.g., N-methylpyrrolidone, fatty acid dimethylamides); and mixtures of any of the foregoing materials. In certain embodiments, the emulsion can contain an emulsion stabilizer (e.g., any amphipathic of other agent which promotes dispersal of a non-aqueous liquid in an aqueous liquid to maintain an emulsion).

Various methods for inhibiting insect pests of plants are provided herein. In certain embodiments of such methods, the compositions comprising the PLU6-type bacteria can be applied to plants, plant parts (e.g., seeds, leaves, roots, and/or stems), or soil to which a plant is growing or is to be grown in to inhibit insect pest of the plants. Insect pests of plants that can be controlled by such applications include *Ceratitis* sp., *Delia* sp., *Mayetolia* sp., *Rhagoletis* sp., and/or *Anastrepha* sp. Application to the plant or plant part can be achieved by spraying, soaking, distribution of granulated formulations of the compositions, or otherwise applying the composition. In certain embodiments, applications can be performed serially at suitable intervals (e.g., daily, weekly, bi-weekly, monthly, or bi-monthly). Application to the soil can be achieved by a soil soak or drench, by in furrow applications, and the like. In certain embodiments, any of the aforementioned applications of the composition will provide for ingestion by the insect and/or contacting any surface of the insect with the composition. Turf grasses, crop plants, ornamental plants, vegetables, as well as nut- and fruit-bearing trees and plants can be treated with the aforementioned compositions or by the aforementioned methods. Plants and plant parts treated by the aforementioned compositions include maize, wheat, rye, barley, oats, buckwheat, sorghum, rice, onion, grass, sunflower, canola, peas, beans, soybean, cotton, linseed, cauliflower, asparagus, lettuce, tobacco mustard, sugar beet, potato, sweet potato, carrot, turnip, celery, tomato, eggplant, cucumber, squash, apple, apricot, peach, pear, plum, orange, blackberry, blueberry, strawberry, cranberry and lemon. Also provided herein are plant parts (e.g., seeds, leaves, stems, roots, tubers, and the like) that are coated or partially coated with the compositions comprising the PLU6-type bacteria. In certain embodiments, such aforementioned applications are at a rate of at least $3\times10^4$, $1\times10^5$, $3\times10^5$, $1\times10^6$, or $3\times10^6$ CFU of the PLU6-type bacteria per gram fresh weight plant tissue or soil.

Additional methods for inhibiting insect pests of humans, animals, and/or plants are also provided herein. In certain embodiments of such methods, the compositions comprising the PLU6-type bacteria are applied to soil, standing water, or any materials that will retain water, especially when or before such soil, water, materials contain insects (e.g., eggs, larvae, pupa, and/or adults), and/or to the insects. Insects that can be inhibited by such applications include dipteran insects (e.g., *Aedes* sp., *Anopheles* sp., *Culex* sp., *Ceratitis* sp., *Delia* sp., *Glossina* sp., *Musca* sp. *Mayetolia* sp., *Rhagoletis* sp., *Anastrepha* sp. a *Glossina* sp., a *Musca* sp., *Cochliomyia* sp., *Chrysops* sp., *Simulium* sp., *Phlebotomus* sp., *Culicoides* sp., or *Dermatobia* sp.). In certain embodiments, an *Aedes aegypti, Aedes aboriginis, Aedes albopictus, Aedes atlanticus, Aedes atropalpus, Aedes aurifer, Aedes bicristatus, Aedes bimaculatus, Aedes brelandi, Aedes camptorhynchus, Aedes cantator, Aedes cataphylla, Aedes cinereus, Aedes clivis, Aedes cretinus, Aedes deserticola, Aedes dupreei, Aedes epactius, Aedes fulvus, Aedes grossbecki, Aedes hensilli, Aedes hesperonotius, Aedes infirmatus, Aedes intruders, Aedes melanimon, Aedes mitchellae, Aedes notoscriptus, Aedes polynesiensis, Aedes sollicitans, Aedes squamiger, Aedes taeniorhynchus, Aedes vexans,* or *Aedes vigilax* larva is inhibited by the applications. In certain embodiments, application of the composition will provide for ingestion by the insect and/or contacting any surface of the insect with the composition. Application sites include pools, ditches, irrigation channels, tanks, pits, ponds, blocked or unblocked drains, marshes, fields with standing water, and the like. In certain embodiments, applications can be performed serially at suitable intervals (e.g., daily, weekly, bi-weekly, or monthly). Application of the compositions can be achieved by spraying, soaking, distribution of powdered, granulated, and/or encapsulated formulations of the compositions, or otherwise applying the composition. In certain embodiments, the compositions comprising the PLU6-type bacteria are applied when or before such soil, water, or materials contain mosquitos (e.g, *Aedes* sp., *Anopheles* sp., and/or *Culex* sp.), and especially when or before such soil, water, or materials contain mosquito eggs or larvae. Suitable formulations used to control *Anopheles larvae* in standing water include formulations that promote floating at the surface of the water where such larvae typically feed. Such floating or other useful formulations can be adapted from those disclosed in Aly et al., 1987, J. Am. Mosquito Control Assoc. 3:583-588; Cheung et al., 1985, Appl. Environ. Microbiol. 50:984-988, 1985; Lacey and Undeen, 1984, J. Econ. Entomol. 77:412-418. In certain embodiments, the formulations can comprise a slow-release formulation. In certain embodiments, the formulations can comprise a UV radiation blocking agent. In certain embodiments, such aforementioned applications are at a rate where the insects in a liquid matrix (e.g., water, including any standing or any other aforementioned bodies of water) are exposed to at least $3\times10^4$, $1\times10^5$, $3\times10^5$, $1\times10^6$, or $3\times10^6$ CFU of the PLU6-type bacteria per milliliter of the liquid matrix. In certain embodiments, such aforementioned applications are at a rate where the insects in a solid or semi-solid matrix (e.g., soil) are exposed to at least $3\times10^4$, $1\times10^5$, $3\times10^5$, $1\times10^6$, $3\times10^6$, $1\times10^7$, $3\times10^7$, or $1\times10^8$ CFU of the PLU6-type bacteria per gram of the solid or semi-solid matrix.

Also provided herein are methods of making the compositions comprising PLU6-type bacteria or monocultures thereof. In certain embodiments, such methods can comprise combining any of the aforementioned PLU6-type bacteria or monocultures thereof with at least one adjuvant and/or excipient, including any of the aforementioned adjuvants and/or excipients. In certain embodiments, the monoculture of the PLU6-type bacteria is obtained by steps which comprise inoculating sterile bacterial growth media with the PLU6-type bacteria, growing the *Chryseobacterium* in the growth media in the essential absence of contaminating microorganisms, and harvesting a bacterial monoculture of the PLU6-type bacteria that is essentially free of contaminating microorganisms. Growing can be in bacterial growth media suitable for growth of *Chryseobacterium* strains. Examples of such growth media include rich media such as Nutrient Yeast Salt Medium (NYSM), Nutrient Broth (3 g/L beef extract; 5 g/L peptone OR 8/L nutrient broth powder), MOPS EZ Defined Media, the formulation of which is shown below (e.g., Teknova cat #M2105), and the like.

MOPS EZ Rich Defined Media Kit (part # M2105)

| Component | 1× Concentration |
|---|---|
| MOPS | 40 mM |
| Tricine | 4 mM |
| Iron Sulfate | 0.01 mM |
| Ammonium Chloride | 9.5 mM |
| Potassium Sulfate | 0.276 mM |
| Calcium Chloride | 0.5 μM |
| Magnesium Chloride | 0.525 mM |
| Sodium Chloride | 50 mM |
| Ammonium Molybdate | $2.92\times10^{-7}$ mM |
| Boric Acid | $4.00\times10^{-5}$ mM |
| Cobalt Chloride | $3.02\times10^{-6}$ mM |

-continued

| MOPS EZ Rich Defined Media Kit (part # M2105) | |
|---|---|
| Component | 1× Concentration |
| Cupric Sulfate | $9.62 \times 10^{-7}$ mM |
| Manganese Chloride | $8.08 \times 10^{-6}$ mM |
| Zinc Sulfate | $9.74 \times 10^{-7}$ mM |
| Potassium Phosphate Dibasic Anhydrous | 1.32 mM |
| Glucose | 0.20% |
| Potassium Hydroxide | 1.5 mM |
| Adenine | 0.199 mM |
| Cytosine | 0.199 mM |
| Uracil | 0.199 mM |
| Guanine | 0.199 mM |
| L-Alanine | 0.8 mM |
| L-Arginine HCl | 5.2 mM |
| L-Asparagine | 0.4 mM |
| L-Aspartic Acid, Potassium Salt | 0.4 mM |
| L-Glutamic Acid, Potassium Salt | 0.6 mM |
| L-Glutamine | 0.6 mM |
| L-Glycine | 0.8 mM |
| L-Histidine HCl $H_2O$ | 0.2 mM |
| L-Isoleucine | 0.4 mM |
| L-Proline | 0.4 mM |
| L-Serine | 10 mM |
| L-Threonine | 0.4 mM |
| L-Tryptophan | 0.1 mM |
| L-Valine | 0.6 mM |
| L-Leucine | 0.8 mM |
| L-Lysine HCl | 0.4 mM |
| L-Methionine | 0.2 mM |
| L-Phenylalanine | 0.4 mM |
| L-Cysteine HCl | 0.1 mM |
| L-Tyrosine | 0.2 mM |
| Thiamine HCl | 0.01 mM |
| Calcium Pantothenate | 0.01 mM |
| para-Amino Benzoic Acid | 0.01 mM |
| para-Hydroxy Benzoic Acid | 0.01 mM |
| 2,3-diHydroxy Benzoic Acid | 0.01 mM |

Suitable growth conditions include both fed-batch and continuous fermentation processes. Cultures are typically subjected to aeration in the media at a temperature of about 30° C. (e.g., about 26° C. or 28° C. to about 32° C. or 34° C.). In certain embodiments, PLU6-type bacteria can be harvested by separation from the fermentation broth by centrifugation and/or filtration. In certain embodiments, harvested PLU6-type bacteria are harvested with the fermentation broth (e.g., as a whole culture comprising both bacteria and the fermentation broth) or components of the fermentation broth for use in the composition. In certain embodiments, the whole broth is concentrated by partial or complete removal of water. In certain embodiments, the whole broth or a concentrate thereof is lyophilized to obtain a dried monoculture that is essentially free of water for use in preparing the composition. In certain embodiments, the compositions made by the aforementioned methods comprise PLU6-type bacteria at a concentration of least $1 \times 10^6$, $2 \times 10^6$, $5 \times 10^6$, $1 \times 10^7$, $2 \times 10^7$, $5 \times 10^7$, $1 \times 10^8$, $2 \times 10^8$, or $5 \times 10^8$ colony forming units (CFU) per milliliter of the composition or at a titer of at least $1 \times 10^6$, $2 \times 10^6$, $5 \times 10^6$, $1 \times 10^7$, $2 \times 10^7$, $5 \times 10^7$, $1 \times 10^8$, $2 \times 10^8$, or $5 \times 10^8$ colony forming units (CFU) per gram of the composition. In certain embodiments, the compositions made by the aforementioned methods comprise PLU6-type bacteria at a concentration of $1 \times 10^6$, $2 \times 10^6$, $5 \times 10^6$, $1 \times 10^7$, or $2 \times 10^7$ to about $5 \times 10^7$, $1 \times 10^8$, $2 \times 10^8$, or $5 \times 10^8$ colony forming units (CFU) per milliliter of the composition or at a titer of $1 \times 10^6$, $2 \times 10^6$, $5 \times 10^6$, $1 \times 10^7$, or $2 \times 10^7$, to about $5 \times 10^7$, $1 \times 10^8$, or $5 \times 10^8$ colony forming units (CFU) per gram of the composition.

In some embodiments, organisms (e.g., PLU6, a PLU6-type organism, biosimilar organisms, etc.) are characterized by shotgun metagenomic sequencing. Techniques and systems to obtain genetic sequences from multiple organisms in a sample, such as an environmental or clinical sample, are well known by persons skilled in the art. For example, Zhou et al. (Appl. Environ. Microbiol. (1996) 62:316-322) provides a robust nucleic acid extraction and purification. This protocol may also be modified depending on the experimental goals and environmental sample type, such as soils, sediments, and groundwater. Many commercially available DNA extraction and purification kits can also be used. Samples with lower than 2 pg purified DNA may require amplification, which can be performed using conventional techniques known in the art, such as a whole community genome amplification (WCGA) method (Wu et al., Appl. Environ. Microbiol. (2006) 72, 4931-4941). Techniques and systems for obtaining purified RNA from environmental samples are also well known by persons skilled in the art. For example, the approach described by Hurt et al. (Appl. Environ. Microbiol. (2001) 67:4495-4503) can be used. This method can isolate DNA and RNA simultaneously within the same sample. A gel electrophoresis method can also be used to isolate community RNA (McGrath et al., J. Microbiol. Methods (2008) 75:172-176). Samples with lower than 5 pg purified RNA may require amplification, which can be performed using conventional techniques known in the art, such as a whole community RNA amplification approach (WCRA) (Gao et al., Appl. Environ. Microbiol. (2007) 73:563-571) to obtain cDNA. In some embodiments, environmental sampling and DNA extraction are conducted as previously described (DeSantis et al., Microbial Ecology, 53(3):371-383, 2007).

Isolated nucleic acids can be subject to a sequencing method to obtain sequencing data. Sequencing methods can be broadly divided into those that typically use template amplification and those that do not. Amplification-requiring methods include pyrosequencing commercialized by Roche as the 454 technology platforms (e.g., GS 20 and GS FLX), Life Technologies/Ion Torrent, the Solexa platform commercialized by Illumina, GnuBio, and the Supported Oligonucleotide Ligation and Detection (SOLiD) platform commercialized by Applied Biosystems. Non-amplification approaches, also known as single-molecule sequencing, are exemplified by the HeliScope platform commercialized by Helicos BioSciences, and emerging platforms commercialized by VisiGen, Oxford Nanopore Technologies Ltd., and Pacific Biosciences, respectively. Accordingly, metagenomic shotgun sequencing comprises, in some embodiments, pyrosequencing, sequencing-by-ligation, single molecule sequencing, sequence-by-synthesis (SBS), semiconductor sequencing, nanopore sequencing, massive parallel clonal, massive parallel single molecule SBS, massive parallel single molecule real-time, massive parallel single molecule real-time nanopore technology, etc. Morozova and Marra provide a review of some such technologies in Genomics, 92: 255 (2008), herein incorporated by reference in its entirety. Those of ordinary skill in the art will recognize that because RNA is less stable in the cell and more prone to nuclease attack experimentally RNA is usually reverse transcribed to DNA before sequencing.

Specific descriptions of some DNA sequencing techniques include fluorescence-based sequencing methodologies (See, e.g., Birren et al., Genome Analysis: Analyzing DNA, 1, Cold Spring Harbor, N.Y.; herein incorporated by reference in its entirety); automated sequencing techniques; parallel sequencing of partitioned amplicons (PCT Publication No: WO2006084132 to Kevin McKernan et al., herein incorporated by reference in its entirety); and sequencing by parallel oligonucleotide extension (See, e.g., U.S. Pat. No. 5,750,341 to Macevicz et al., and U.S. Pat. No. 6,306,597 to Macevicz et al., both of which are herein incorporated by reference in their entireties). Additional descriptions of sequencing techniques include the Church polony technology (Mitra et al., 2003, Analytical Biochemistry 320, 55-65; Shendure et al., 2005 Science 309, 1728-1732; U.S. Pat. Nos. 6,432,360, 6,485,944, 6,511,803; herein incorporated by reference in their entireties), the 454 picotiter pyrosequencing technology (Margulies et al., 2005 Nature 437, 376-380; US 20050130173; herein incorporated by reference in their entireties), the Solexa single base addition technology (Bennett et al., 2005, Pharmacogenomics, 6, 373-382; U.S. Pat. Nos. 6,787,308; 6,833,246; herein incorporated by reference in their entireties), the Lynx massively parallel signature sequencing technology (Brenner et al. (2000). Nat. Biotechnol. 18:630-634; U.S. Pat. Nos. 5,695, 934; 5,714,330; herein incorporated by reference in their entireties), and the Adessi PCR colony technology (Adessi et al. (2000). Nucleic Acid Res. 28, E87; WO 00018957; herein incorporated by reference in its entirety). See also, e.g., Voelkerding et al., Clinical Chem., 55: 641-658, 2009; MacLean et al., Nature Rev. Microbiol., 7: 287-296; each herein incorporated by reference in its entirety).

Data collected during the experiments described herein indicated that PLU6, PLU6-type organisms, and organisms having insecticidal activity similar to PLU6 and PLU6-type organisms had insecticidal activity. In some embodiments, the insecticidal organism is a member of the genus *Chryseobacterium*, e.g., a *Chryseobacterium* species such as, e.g., *Chryseobacterium gleum*. See also FIGS. 9 and 10.

Data collected during the experiments described herein indicated that diindolylalkane compounds had insecticidal activity. Accordingly, the technology described herein provides an insecticidal compound having the structure as follows:

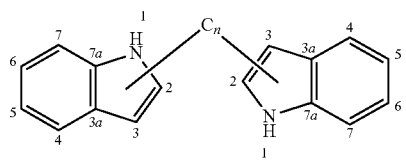

In this structure, $C_n$ is a linker that comprises an alkylene group or equivalent (e.g., an alkyl chain having 1 to 12 carbon atoms). Exemplary, non-limiting insecticidal compounds are 3,3-diindolylmethane and 3-((1H-indol-2-yl) methyl)-1H-indole. As indicated by these exemplary compounds, the insecticidal compounds provided herein comprise two indole moieties linked by a linker comprising an alkylene chain (e.g., methylene (—$CH_2$—)) attached at the position 2 or 3 carbon of each indole group. The linker between the two indole groups may be any chemical linker provided that it does not substantially inhibit the killing activity of the insecticidal compound.

Furthermore, data collected during the experiments described herein indicated that PLU6, PLU6-type organisms, organisms having insecticidal activity similar to PLU6 and PLU6-type organisms, and/or diindolylalkane compounds were insecticidal against insects in the taxonomic orders Diptera and Lepidoptera. Further, data collected during the experiments described herein indicated that PLU6, PLU6-type organisms, organisms having insecticidal activity similar to PLU6 and PLU6-type organisms, and/or diindolylalkane compounds were insecticidal against insects in the taxonomic families Culicidae, Noctuidae, Tortricidae, Crambidae, and Erebidae. Data collected during the experiments described herein indicated that PLU6, PLU6-type organisms, organisms having insecticidal activity similar to PLU6 and PLU6-type organisms, and/or diindolylalkane compounds were insecticidal against *Ae. aegpyti, C. quinquefasciatus, H viriscens, T ni, S. exigua, C. includens, H zea, S. eridania, S. frugiperda, D. saccharalis, D. grandiosella*, and *A. gemmetalis*. These species represent a broad variety of insects including moths and other caterpillars, borers, armyworms, and mosquitos.

In some embodiments, the technology relates to a transgenic plant comprising a heterologous nucleic acid, which can be introduced into a plant cell in a number of art-recognized ways. Those skilled in the art will appreciate that the choice of method might depend on the type of plant targeted for transformation. In some embodiments, the vector is maintained episomally. In other embodiments, the vector is integrated into the genome. A polynucleotide can be introduced into a cell by a variety of methods well known to those of ordinary skill in the art. For example, the polynucleotide can be introduced into a plant cell using a direct gene transfer method such as electroporation or microprojectile mediated transformation, or using *Agrobacterium* mediated transformation. See, e.g., Hinchee et al. (1988) Biotechnology, 6:915; Ishida et al. (1996) Nature Biotechnology 14:745, all of which are herein incorporated by reference).

Although the disclosure herein refers to certain illustrated embodiments, it is to be understood that these embodiments are presented by way of example and not by way of limitation.

EXAMPLES

Example 1

*Chryseobacterium* PLU6 cultures were grown aerobically in sterile Nutrient Yeast Salt Medium (NYSM). The NYSM contained 8 g/L nutrient broth powder, 0.5 g/L yeast extract, 1 mM $MgCl_2$, 700 μM $CaCl_2$, 50 μM $MnCl_2$. Growth was at 30° C. and 200-250 rpm on a rotary shaker. PLU6 was sampled after 2 days of growth for application to multiple species of mosquito larvae.

*Ae. aegypti* eggs were purchased from Benzon Research (Carlisle, PA). Eggs were hatched under vacuum into sterile water. *Culex quinquefasciatus* and *Anopheles quadrimaculatus* larvae (first or second instar) were also purchased from Benzon Research (Carlisle, PA). Larvae were reared at approximately 22° C. in trays containing water at an approximate larval density of 2 larvae/mL and fed crushed TETRAMIN fish food tablets, powdered Enterra Protein (Enterra, Langley, BC, Canada), or powdered cricket protein (Bud's Cricket Protein Powder, Harrison Food Group).

*Culex quinquefasciatus* and *Anopheles quadrimaculatus* larvae (first or second instar) were also purchased from Benzon Research (Carlisle, PA). Larvae were reared to third instar at approximately 22° C. in trays containing water at an approximate larval density of 2 larvae/mL and fed crushed TETRAMIN fish food tablets or powdered Enterra Protein (Enterra, Langley, BC, Canada).

Third instar larvae were used for all assays. Larvae were washed once in sterile water before transfer to assay plates. Assays were performed in 12-well assay plates, with wells containing 2 mL sterile water and five (5) larvae per well. Bacterial culture was applied to each assay well. Larval mortality was scored at indicated timepoints after application.

To test whether the larvicidal activity of whole culture of PLU6 was associated with the cell pellet or supernatant fractions, we fractionated whole culture via centrifugation. PLU6 cultures were grown aerobically in sterile Nutrient Yeast Salt Medium (NYSM) [8 g/L nutrient broth powder, 0.5 g/L yeast extract, 1 mM $MgCl_2$, 700 µM $CaCl_2$, 50 µM $MnCl_{2]}$ at 30° C. and 250 rpm. Cultures were sampled at indicated timepoints for application to Ae. aegypti larvae. To separate cell pellet and supernatant fractions of PLU6, 200 microliters of whole culture was centrifuged at 4000 rpm for 10 minutes. Supernatants were filtered through a 0.22 µm sterile centrifugal filter to eliminate any remaining bacterial cells and applied to larvae. Cell pellets were resuspended in 200 microliters fresh NYSM media and applied to third instar Ae. aegypti larvae. Larval mortality was assessed at 72 hours.

Bacillus thuringiensis subspecies israelensis strains were used as positive and negative controls. Larvicidal positive control Bacillus thuringiensis subspecies israelensis was sourced from a commercially available product comprising Bacillus thuringiensis subspecies israelensis (SUMMIT MOSQUITO DUNKS/BTI Briquets, Summit Chemical Company, Baltimore, Maryland). Bacillus thuringiensis subspecies israelensis strain 4Q7 from the Bacillus Genetic Stock Center (Ohio State University, Columbus, OH) is a strain of Bacillus thuringiensis subspecies israelensis from which the plasmid encoding the larvicidal toxin has been removed and was used as a negative control for larvicidal activity. NYSM media was also used as a negative control in the larvicide activity assays.

Chryseobacterium strain ATCC29898 [Chryseobacterium sp. (ATCC29898)] was used as a negative control for larvicidal activity. ATCC29898 was reclassified as Chryseobacterium taihuense. The taxonomic classification of the negative control as Chryseobacterium taihuense was confirmed by recovering the 16S sequence after whole genome sequencing and aligning it with known 16S sequences. Chryseobacterium strain ATCC29898 was purchased from the American Type Culture Collection (ATCC, Manassas, VA).

Results

Figure 1:
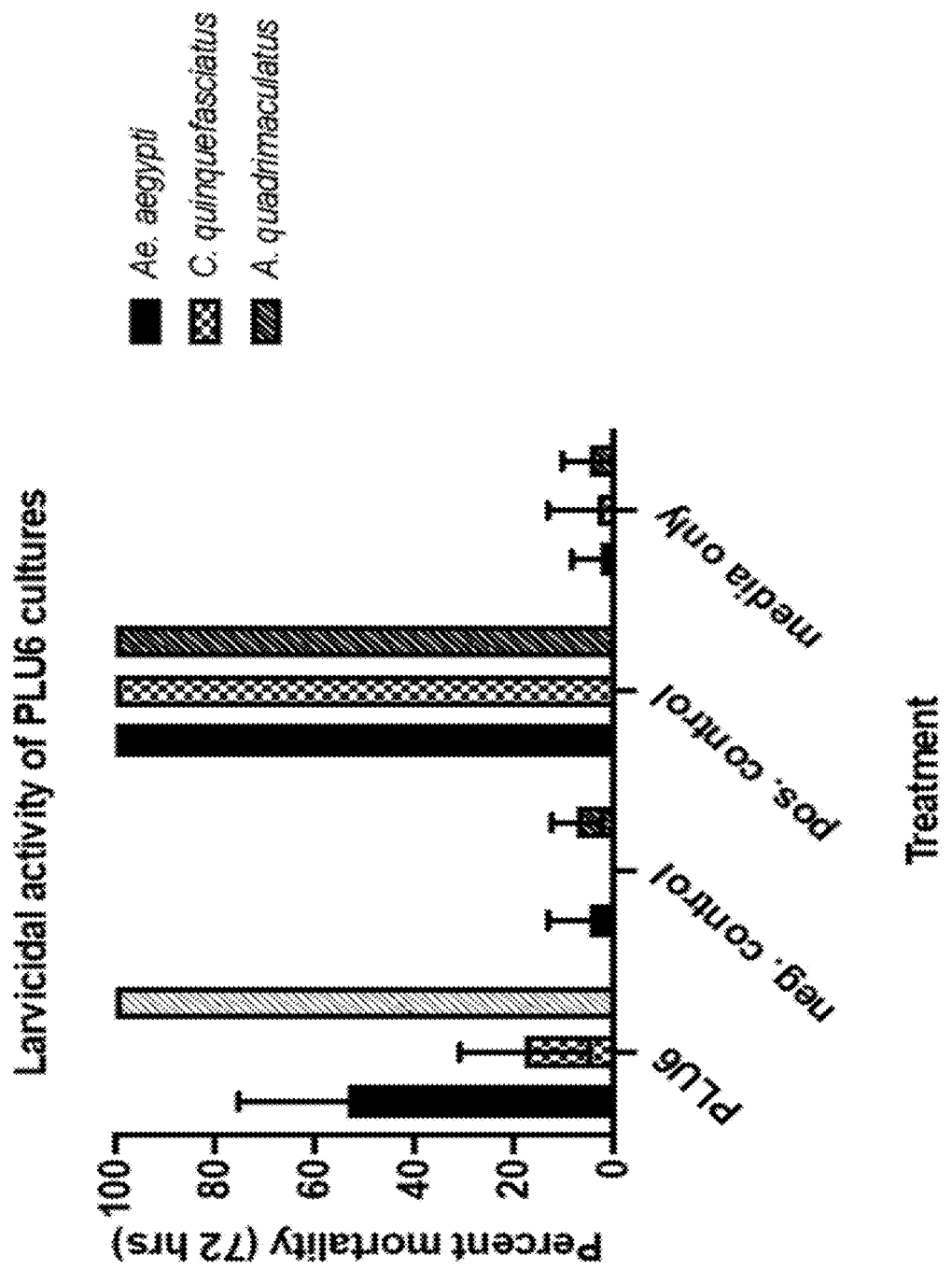

As shown in FIG. 1, Chryseobacterium strain PLU6 isolated from soil has larvicidal activity against various species of mosquito larvae (Aedes aegypti, Culex quinquefasciatus, and Anopheles quadrimaculatus). PLU6 was most active against Anopheles quadrimaculatus and had minimal activity against Culex quinquefasciatus. These results suggest that the mechanism of action of PLU6 is not specific to a genus or species of mosquito.

Figure 2:
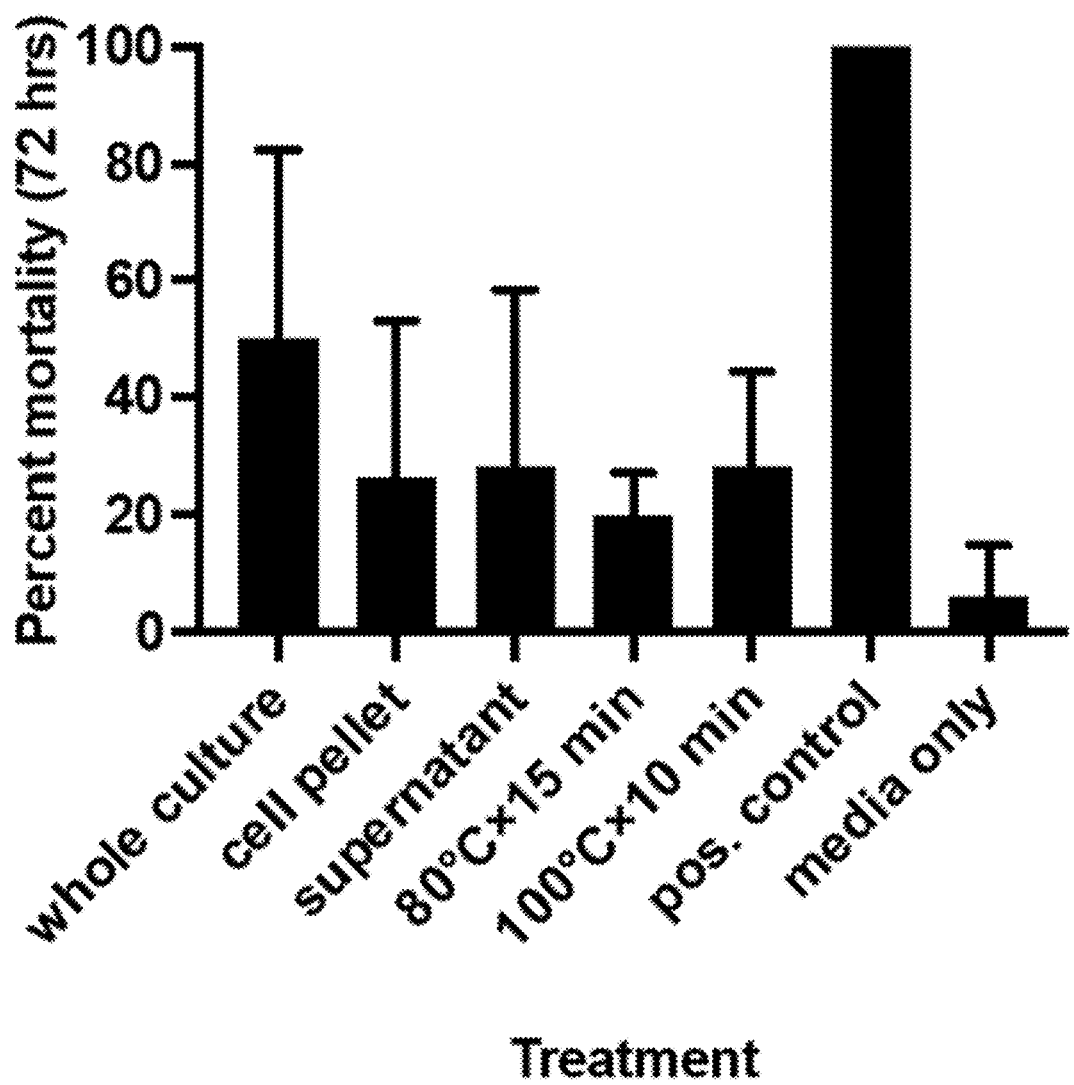

As shown in FIG. 2, larvicidal activity for PLU6 is greatest when applied as a whole culture. Activity is associated with both the cell pellet and supernatant fractions but may be reduced upon fractionation or may be due to the presence of multiple active components. PLU6 activity displays intermediate heat sensitivity as whole culture.

Figure 3:
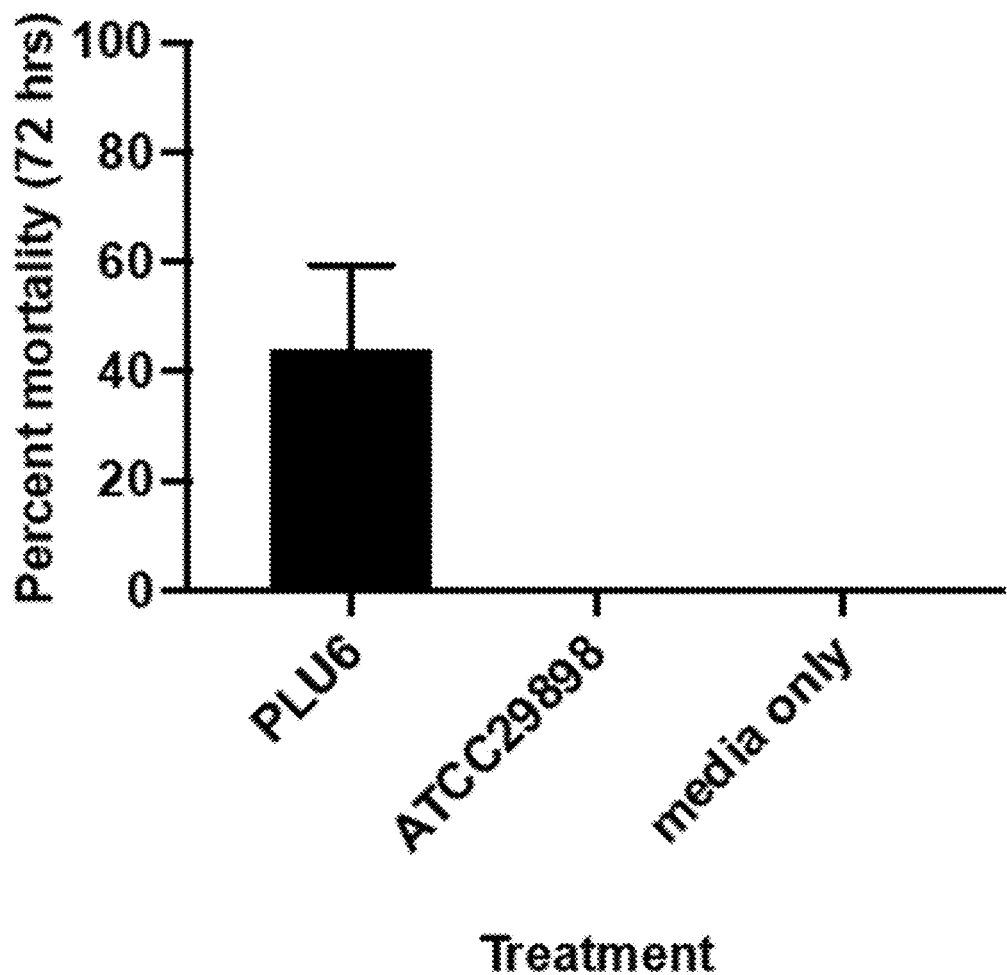

As shown in FIG. 3, larvicidal activity observed in PLU6 is not conserved amongst all Chryseobacterium and may be specific to PLU6 or C. gleum. Genes unique to PLU6 when compared to ATCC29898 may contribute to or be responsible for larvicidal activity.

Figure 4:
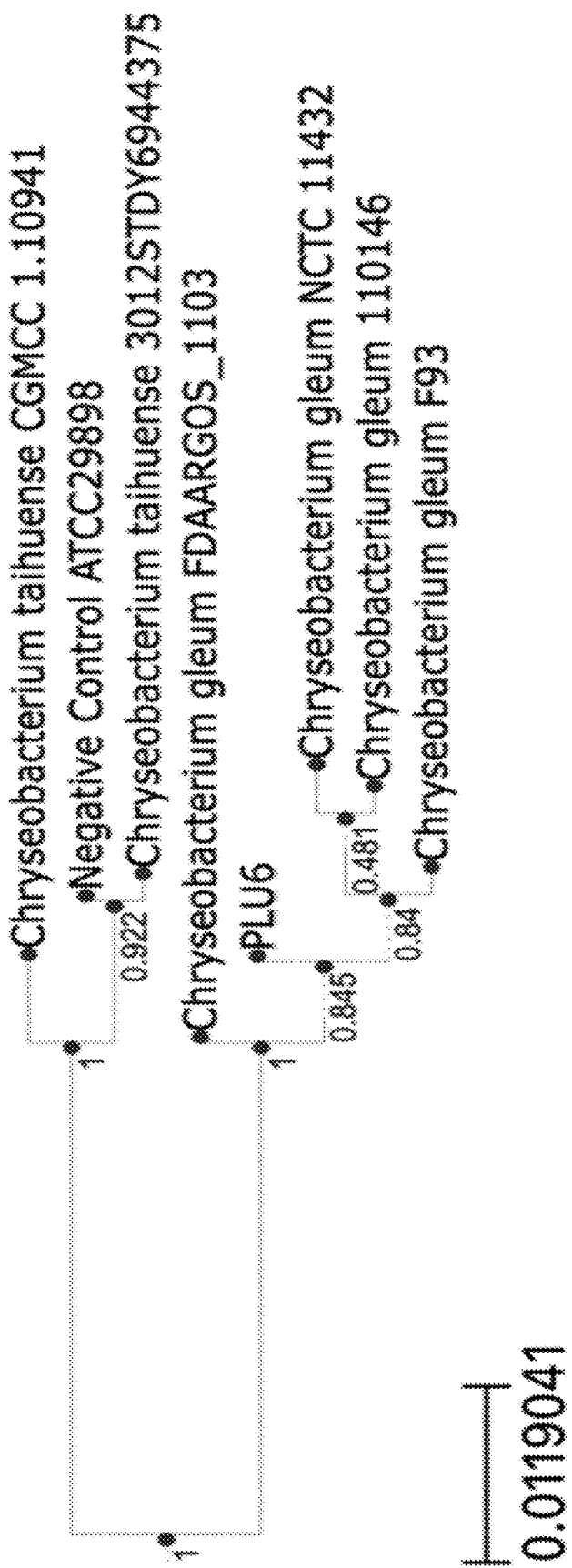
Figure 5:
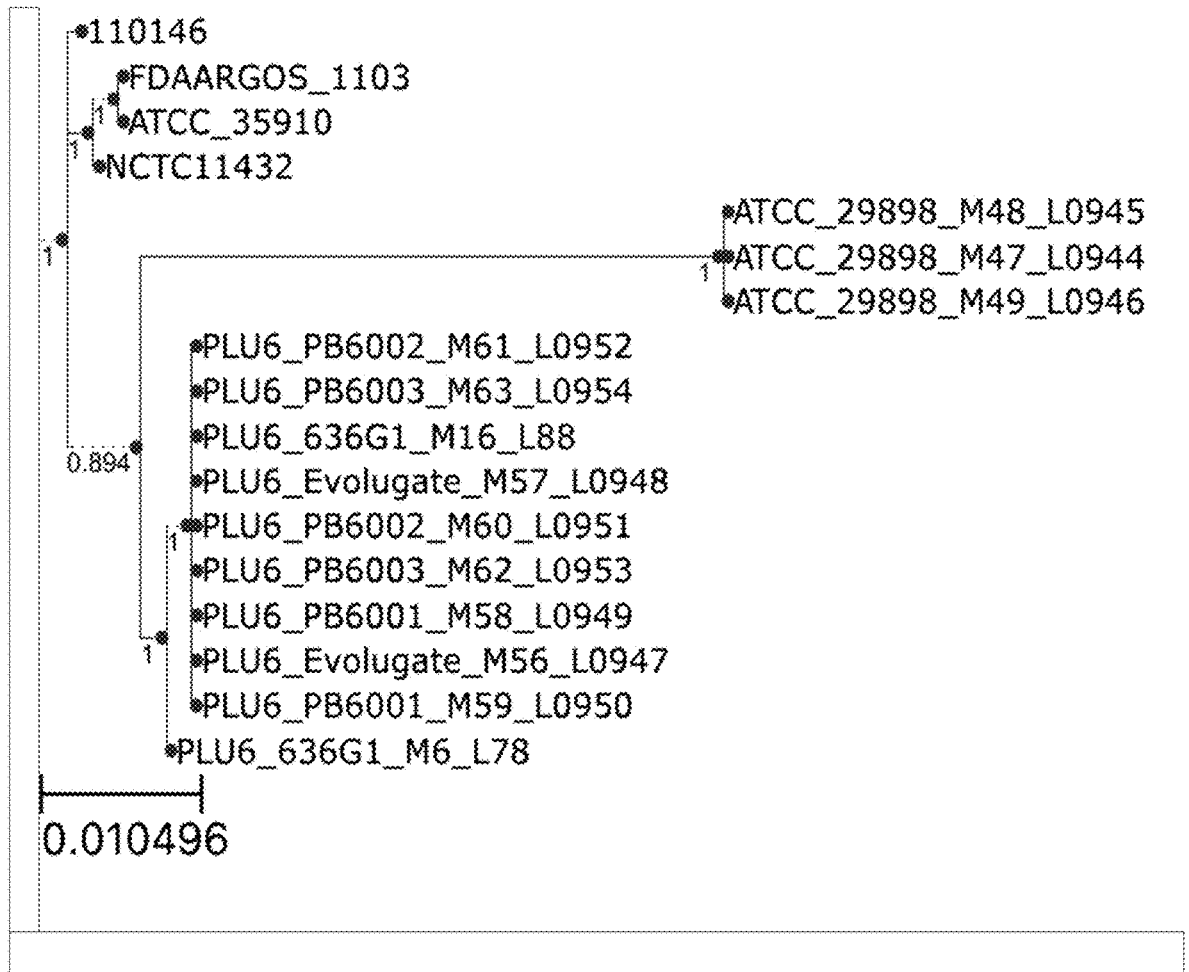

FIG. 4 shows that PLU6 is characterized as Chryseobacterium gleum and the negative control is characterized as Chyseobacterium taihuense. Alignment of 16S genes is a golden standard within the field used primarily to classify taxonomy of bacterial strains.

Table 1 provided herewith and which is incorporated by reference in its entirety herein, provides a summary of the sequences provided in the accompanying sequence listing (SEQ ID NOs: 851-1202) as well as the accession number and name of a related sequence found in the Pfam protein families database (Finn et al. Nucleic Acids Research (2016) Database Issue 44:D279-D285; https internet site "pfam.xfam.org").

One way to identify the genes critical for a given activity is to use comparative genomics. Table 2 provided herewith and which is incorporated by reference in its entirety herein, identifies genes that were only in strains that had insecticidal activity, representing 402 coding regions. Without being bound by theory, it is contemplated that at least some of these genes are involved in insecticidal activity.

Example 2

During the development of embodiments of the technology described herein, experiments were conducted to test the insecticidal activity of cultures comprising PLU6 and PLU6-type organisms, compositions prepared from cultures comprising PLU6 and PLU6-type organisms, small molecules produced by PLU6 and PLU6-type organisms, and/or small molecules related to small molecules produced by PLU6 and PLU6-type organisms.

Production of cell-free supernatants from bacterial cultures. Cells from a cryostock were streaked on an NYSM agar plate and incubated at 30° C. overnight. A single colony was used to inoculate 5 milliliters of NYSM broth in a 50 mL conical tube, which was incubated at 30° C. and 200 rpm overnight. A new 5-mL culture was then inoculated with 10 microliters of the "starter culture" and was incubated at the same temperature and shaking frequency as above. After 24 hours of incubation, the overnight culture was centrifuged at 5100 rcf for 15 minutes. The supernatant was then pipetted into a new 50 mL conical tube and filter sterilized using a Steri-flip 0.2-µm vacuum filter (MILLIPORESIGMA catalog #SCGP00525).

Measuring potency of 3,3-diindolylmethane and 3-((1H-indol-2-yl)methyl)-1H-indole. 3,3'-Diindolylmethane (also called arundine, CAS number: 1968-05-4) was purchased from MILLIPORESIGMA (cat #74601) and Cayman Chemical (catalog #15927). 3-((1H-indol-2-yl)methyl)-1H-indole (CAS number: 114648-66-7) was purchased from Ambeed (catalog #A735658). Compounds were resuspended in dimethyl sulfoxide (DMSO). For collecting data to construct dose curves for 3,3-diindolylmethane and 3-((1H-indol-2-yl)methyl)-1H-indole, a series of twenty 1:2 dilutions was made to test in bioassays, establish a dose curve, and determine the $LC_{50}$ value.

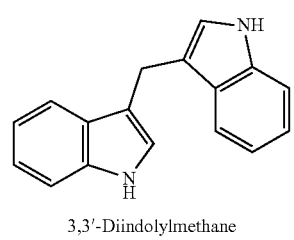

3,3'-Diindolylmethane

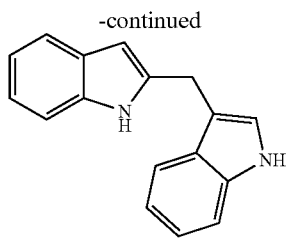

3-((1H-indol-2-yl)methyl)-1H-indole

*Aedes aegypti* bioassays with compounds. Assays were performed using second or third instar larvae, with biological replication. Larvae were washed with sterile water before transfer to 24-well assay plates containing 1 mL of sterile water in each well. Each well contained 5 larvae. Compound dilutions were made in DMSO, topped with sterile NYSM broth and applied to each assay well. The final DMSO concentration was 1% in each assay well. Larval mortality was scored for each well at 24-hour timepoints after application.

*Culex quinquefasciatus* bioassays with compounds. First or second instar *Culex quinquefasciatus* larvae were purchased from Benzon Research, Inc. (Carlisle, PA). Assays were performed with third instar larvae. Larvae were washed with sterile water before transfer to 24-well assay plates containing 1 mL of sterile water in each well. Each well contained 5 larvae. Compound dilutions were made in DMSO, topped with sterile NYSM broth and applied to each assay well. The final DMSO concentration was 1% in each assay well. Larvae mortality was scored for each well at 24-hour timepoints after application.

Lepidopteran bioassays. Lepidopteran bioassays were performed at Benzon Research, Inc. (Carlisle, PA). 3,3'-Diindolylmethane samples were solubilized in dimethyl sulfoxide (DMSO). Samples were then frozen and shipped to Benzon. Samples were resuspended with 9× volumes of water before application to the assay well. The final DMSO concentration in the assay well was 2%. PLU6 extract samples were prepared as a series of three 1:5 dilutions in dimethyl sulfoxide. Samples were then further diluted with fresh NYSM broth, then shipped to Benzon Research for use in a diet overlay assay. Assays were performed using neonate larvae of 14 different Lepidopteran species (*Anticarsia gemmatalis* (velvetbean caterpillar), *Diatraea grandiosella* (southwestern corn borer), *Diatraea saccharalis* (sugarcane borer), *Ostrinia nubilalis* (European corn borer), *Trichoplusia ni* (cabbage looper), *Chrysodeixis includens* (soybean looper), *Spodoptera exigua* (beet armyworm), *Spodoptera frugiperda* (fall armyworm), *Spodoptera eridania* (southern armyworm), *Chloridia virescens* (tobacco budworm), *Helicoverpa zea* (corn earworm), *Agrotis ipsilon* (black cutworm), *Cydia pomonella* (codling moth), *Plutella xylostella* (diamondback moth) with an N=16 or N=32, apart from *P. xylostella*, for which third instar larvae were used. A diet-surface overlay format was used, in which 500 microliters of diet was placed in each well. One hundred microliters of sample was then pipetted into each well and allowed to dry. A DMSO control was included with each set of samples. An internal Btk (*Bacillus thurengiensis kurstaki*) standard at a concentration of 1000 ppm was used as a positive control, and water was used as a negative control.

Heat treatments. Samples were heated in 1.5-mL microfuge tubes in a standard laboratory heat block at the indicated temperature and time.

Preparation and characterization of larvicidal metabolites. Chemicals were purchased from Sigma-Aldrich or Merck unless otherwise specified. Analytical-grade solvents were used for solvent extractions. Solvents used for HPLC, UPLC, and HPLC-MS purposes were of HPLC grade supplied by Labscan or Sigma-Aldrich and filtered/degassed through 0.45 μm polytetrafluoroethylene (PTFE) membrane prior to use. Deuterated solvents were purchased from Cambridge Isotopes (Tewksbury, MA, USA). Nutrient broth culture medium was obtained from EM science chemicals. Preparative and semi-preparative HPLCs were performed using Shimadzu LC-20AT HPLC instruments with corresponding detectors, fraction collectors, and software, inclusively. Electrospray ionization mass spectra (ESIMS) were acquired using a Schimadzu LC-20AD separations module equipped with a Schimadzu LCMS-2020 Series mass detector in both positive and negative ion modes under the following conditions: Phenomenex kinetex Phenylhexyl 5 μm column, 100×4.6 mm, eluting with 1.0 mL/min of isocratic 90% $H_2O$/MeCN for 1 min followed by gradient elution to 100% MeCN (with isocratic 0.1% HCOOH modifier) over 15 min, at 210 and 254 nm. UHPLC-QTOF analysis was performed on an UHPLC-QTOF instrument comprising an Agilent 1290 Infinity II UHPLC (Phenomenex Kinetex 1.7 μm phenylhexyl column, 50×2.1 mm, eluting with 0.4 mL/min of isocratic 90% $H_2O$/MeCN for 1 min followed by gradient elution to 100% MeCN over 6 min (with isocratic 0.1% formic acid modifier) coupled to an Agilent 6545 LC/Q-TOF-MS system operating in positive mode, monitoring a mass range of 100 to 2000 amu. NMR spectra were obtained on an Agilent 600 NMR spectrometer ($^1$H: 600 MHz, 13C: 150 MHz) equipped with a 5 mm DB AUTOX PFG broadband probe and a Varian NMR System console, with automatic tuning and matching in the solvents indicated and referenced to residual signals ($\delta_H$ 3.31 and $\delta_C$ 49.0 ppm for MeOH) in deuterated solvents. All data analysis was performed using MestReNova NMR software.

Biosimilar *Chryseobacterium* and *Flavobacterium* strains were isolated from soil samples, streaked for isolation on solid media, and their genera verified using their 16S rRNA gene sequences and bioinformatic tools known in the art.

Figure 7:
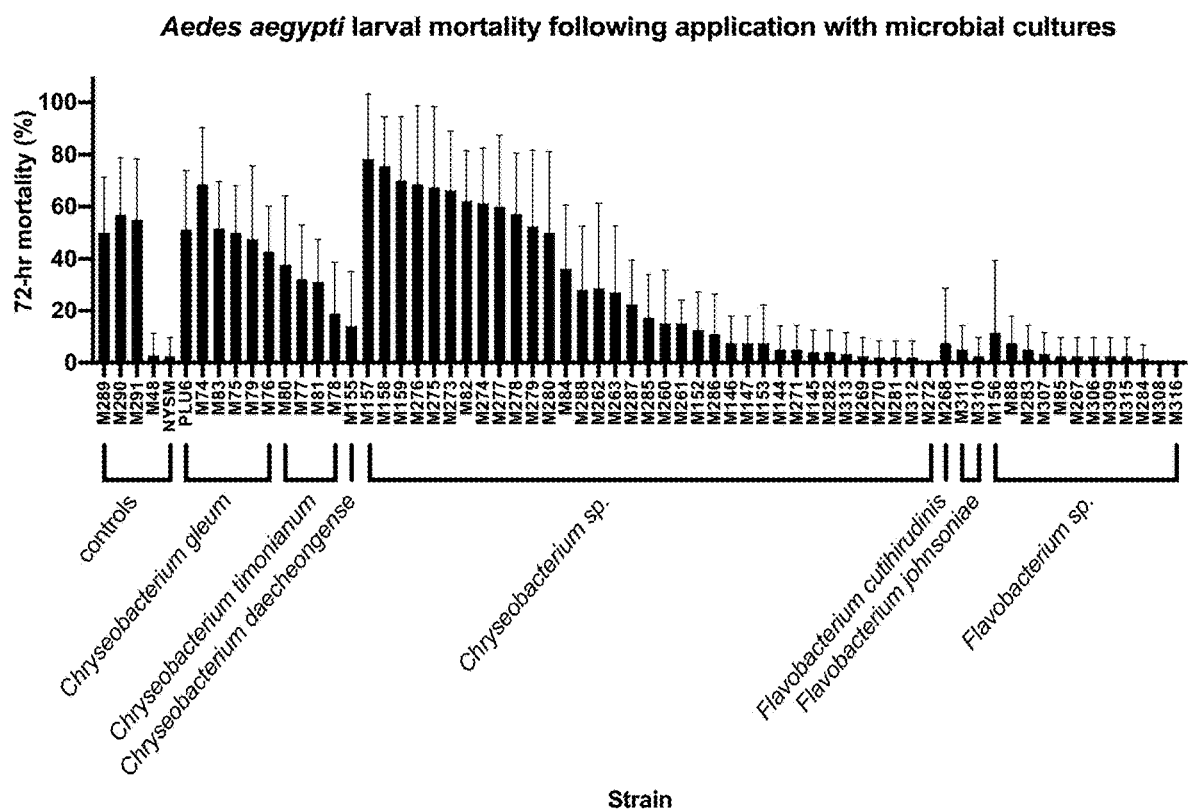

During the development of embodiments of the technology described herein, experiments were conducted to test the larvicidal activity of *Chryseobacterium* strains related to PLU6 ("biosimilars") isolated from environmental sources. During these experiments, data were collected indicating that *Chryseobacterium* species exhibit larvicidal activity against *Ae. aegypti* larvae (FIG. 7). Cultures were applied at 10% v/v. Strains M289, M290, M291, and M48 are control strains sourced from the American Type Culture Collection. M289, M290, and M291 are clones of ATCC29897 (*C. indologenes*). Strain M48 is a clone of ATCC29898 (*C. taihuense*). NYSM represents the negative control (media, no bacterial cells). Isolated *Flavobacterium* strains are also shown. Error bars represent standard deviations calculated from at least three independent replicates. As shown by FIG. 7, distinct *Chryseobacterium* species have larvicidal activity against *Ae. aegypti* larvae.

Figure 8:
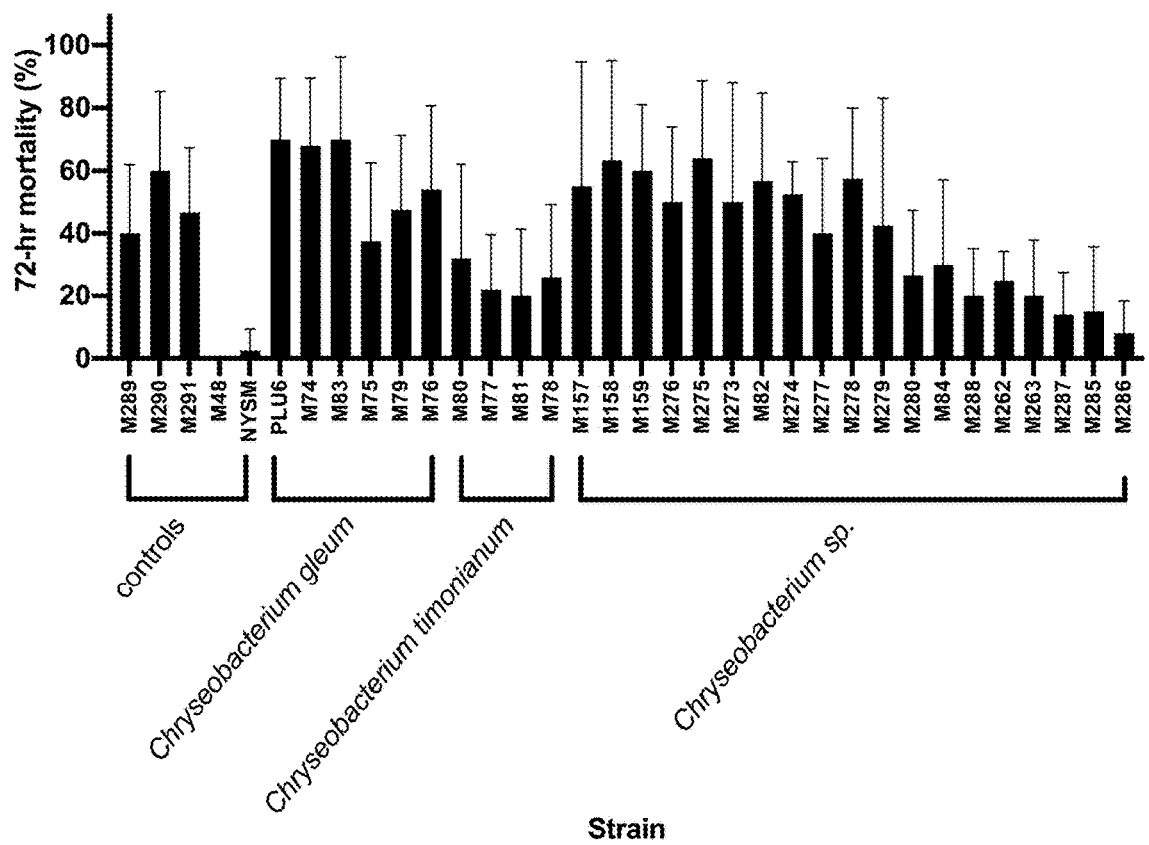

During the development of embodiments of the technology described herein, experiments were conducted to test the larvicidal activity of cell-free supernatants derived from *Chryseobacterium* strains biosimilar to PLU6. During these experiments, data were collected indicating that a component (e.g., a compound or compound(s)) excreted into culture media by PLU6 and related biosimilar strains have larvicidal activity (FIG. 8). Cell-free culture supernatants were applied at 10% v/v. Strains M289, M290, M291, and M48 are control strains sourced from the American Type Culture Collection. M289, M290, and M291 are clones of ATCC29897 (*C. indologenes*). Strain M48 is a clone of ATCC29898 (*C. taihuense*). NYSM represents the negative control (media, no bacterial cells). Error bars represent standard deviations calculated from at least three independent biological replicates.

Figure 9A:
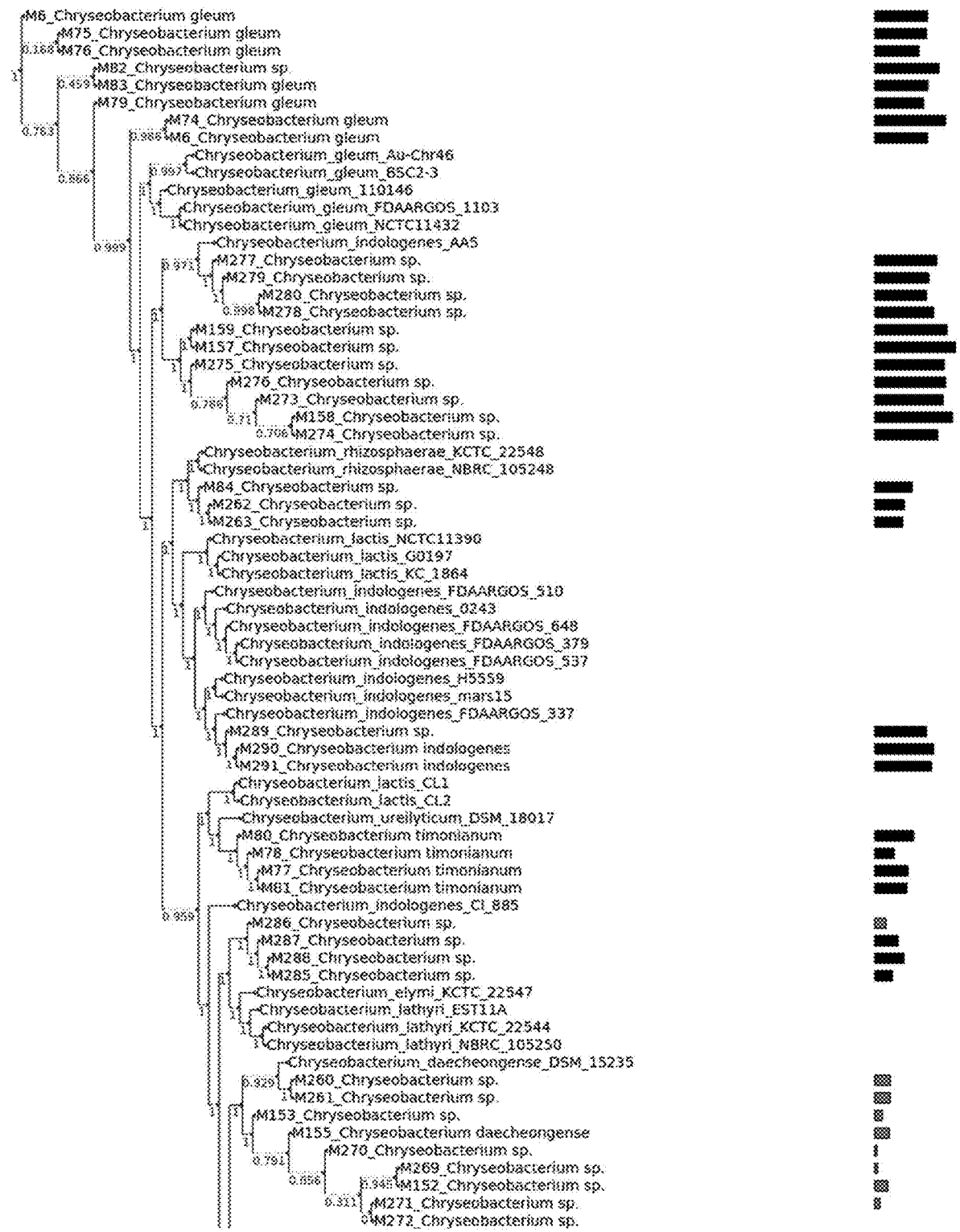
Figure 9B:
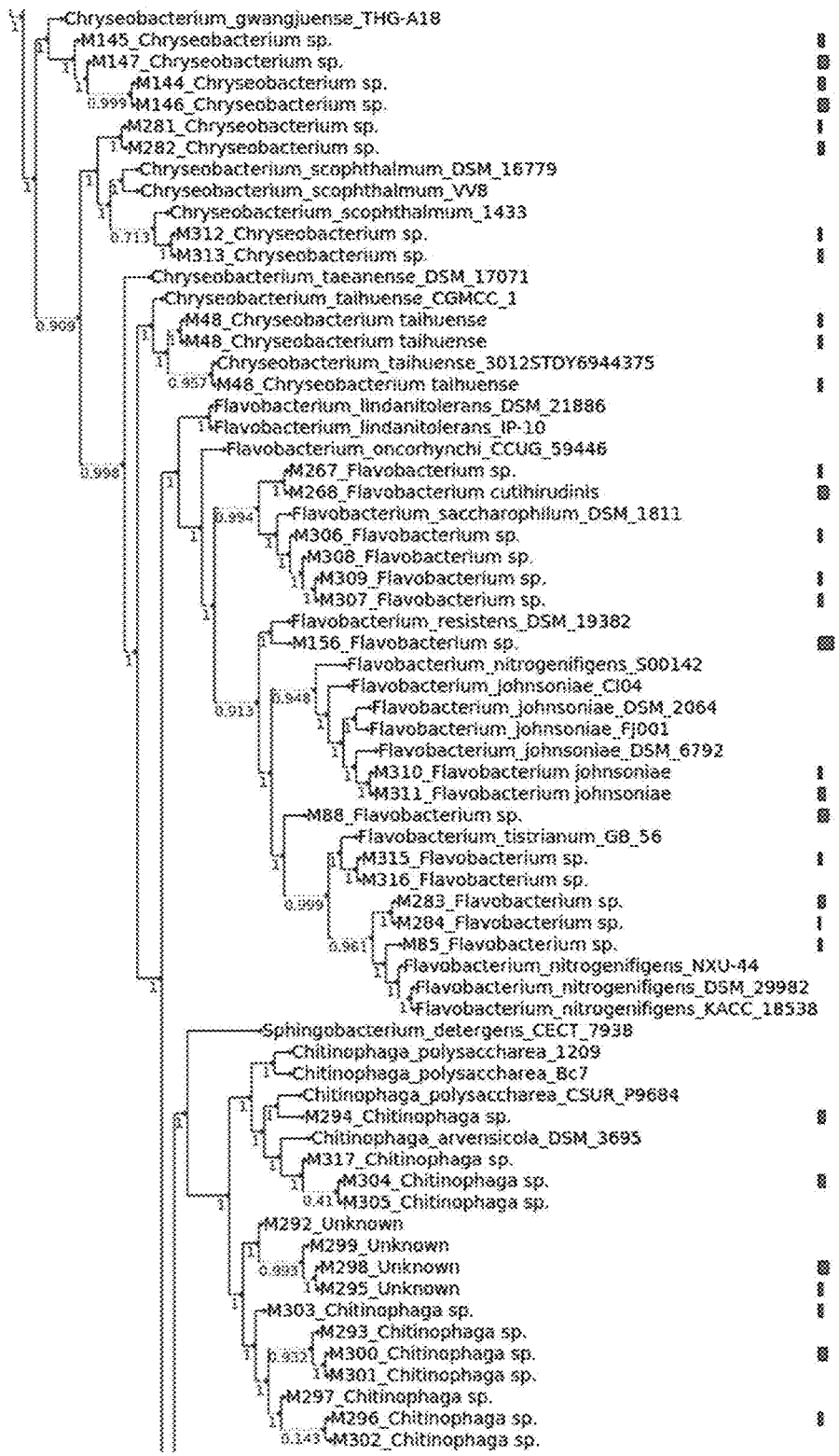
Figure 9C:
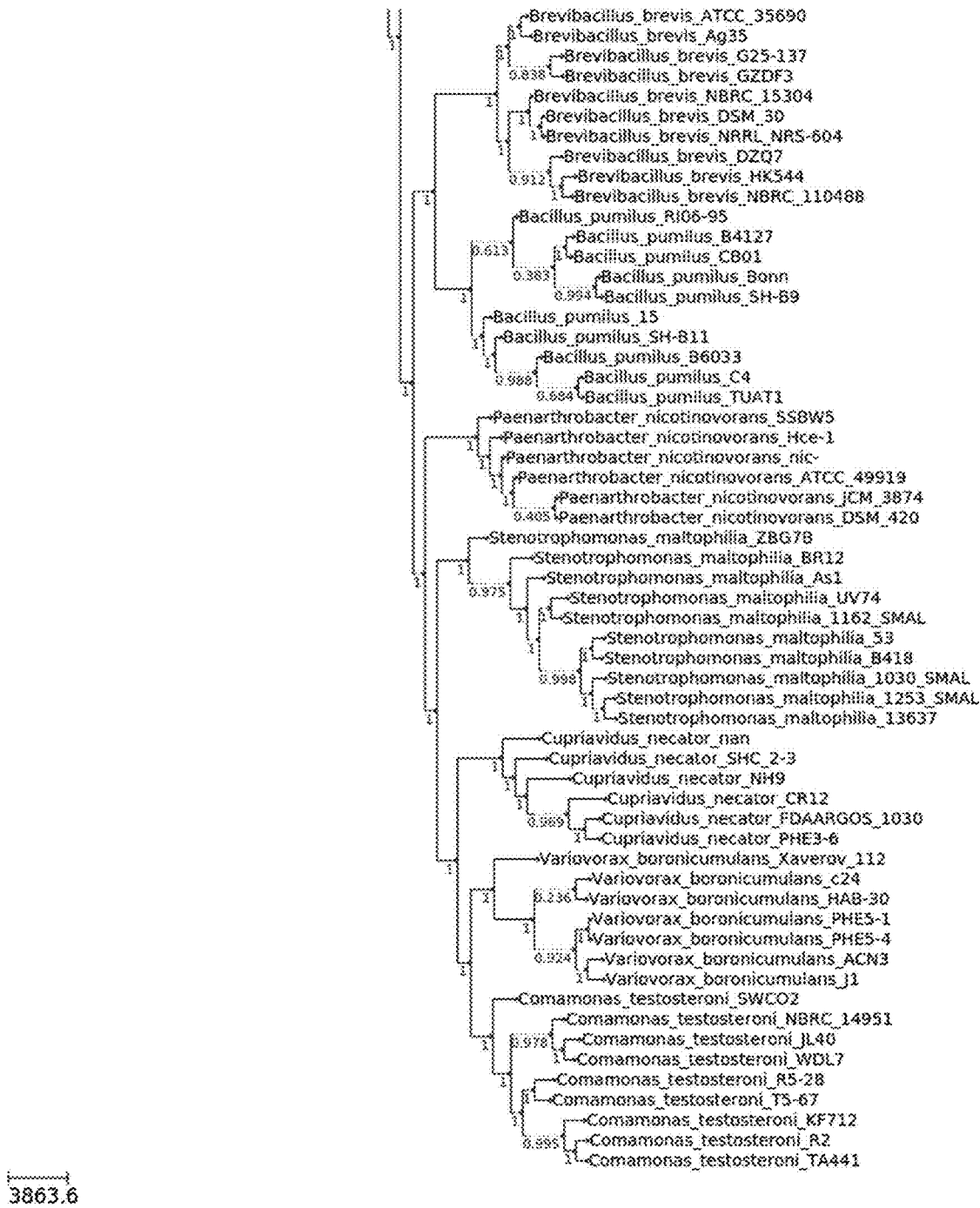
Figure 10A:
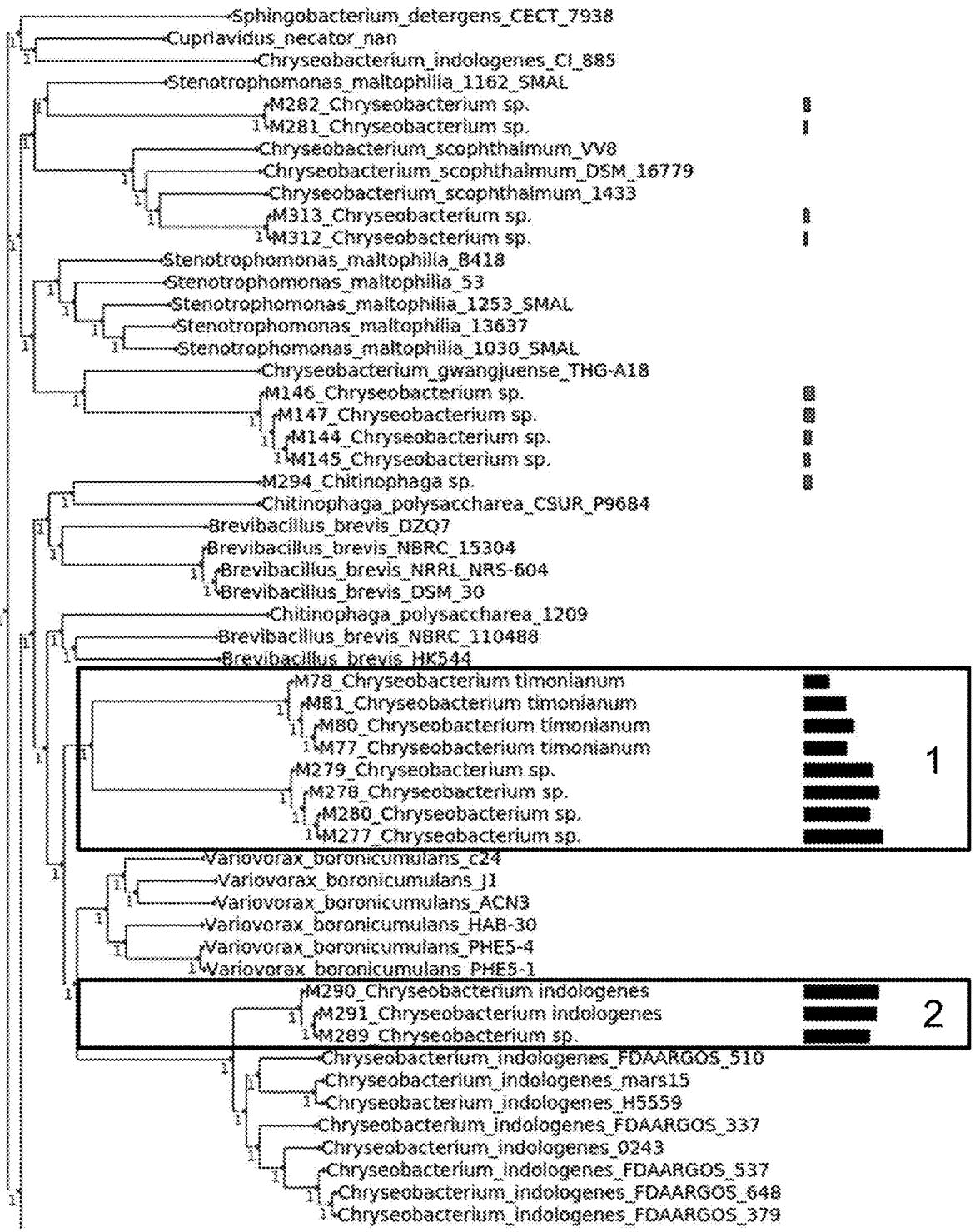
Figure 10B:
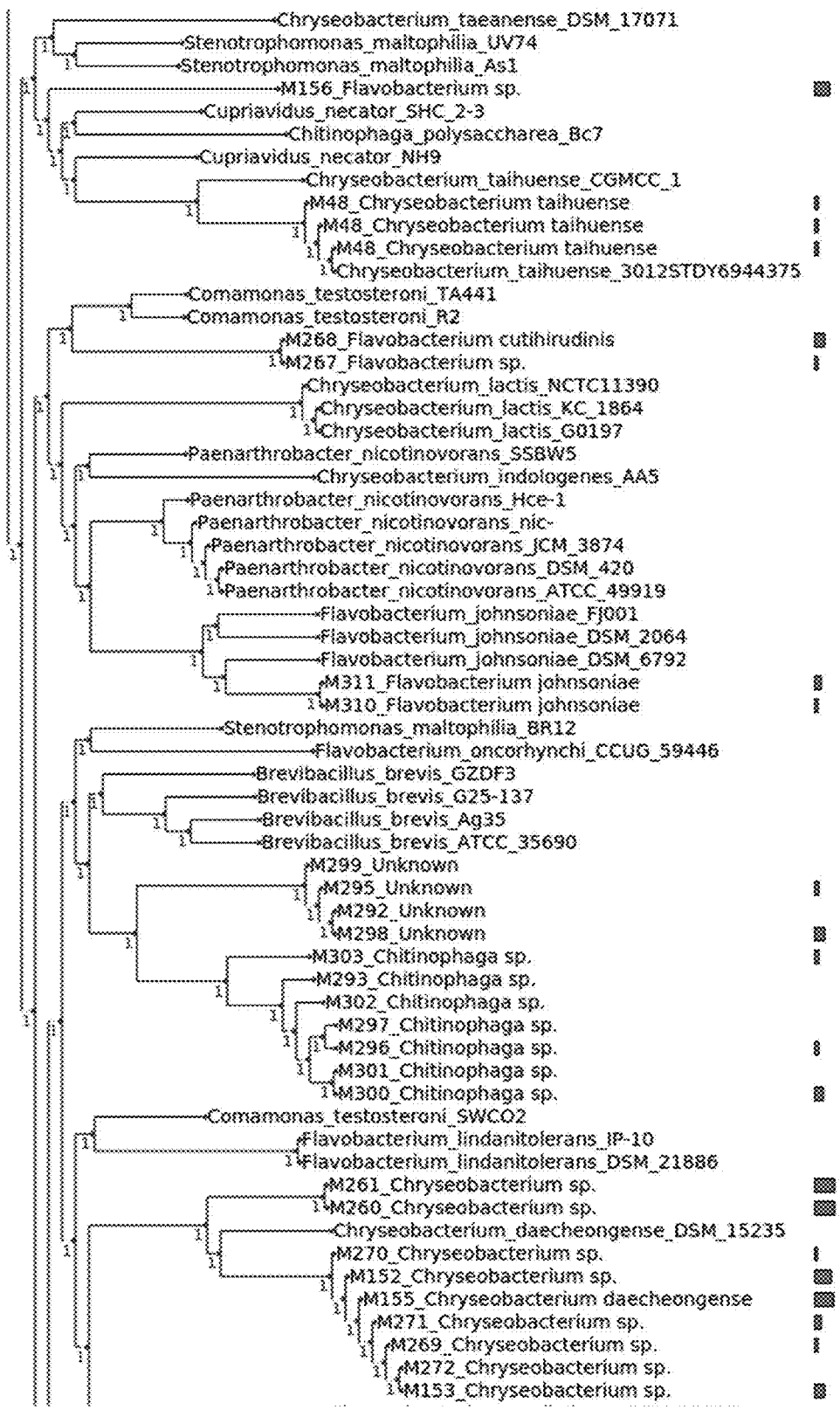
Figure 10C:
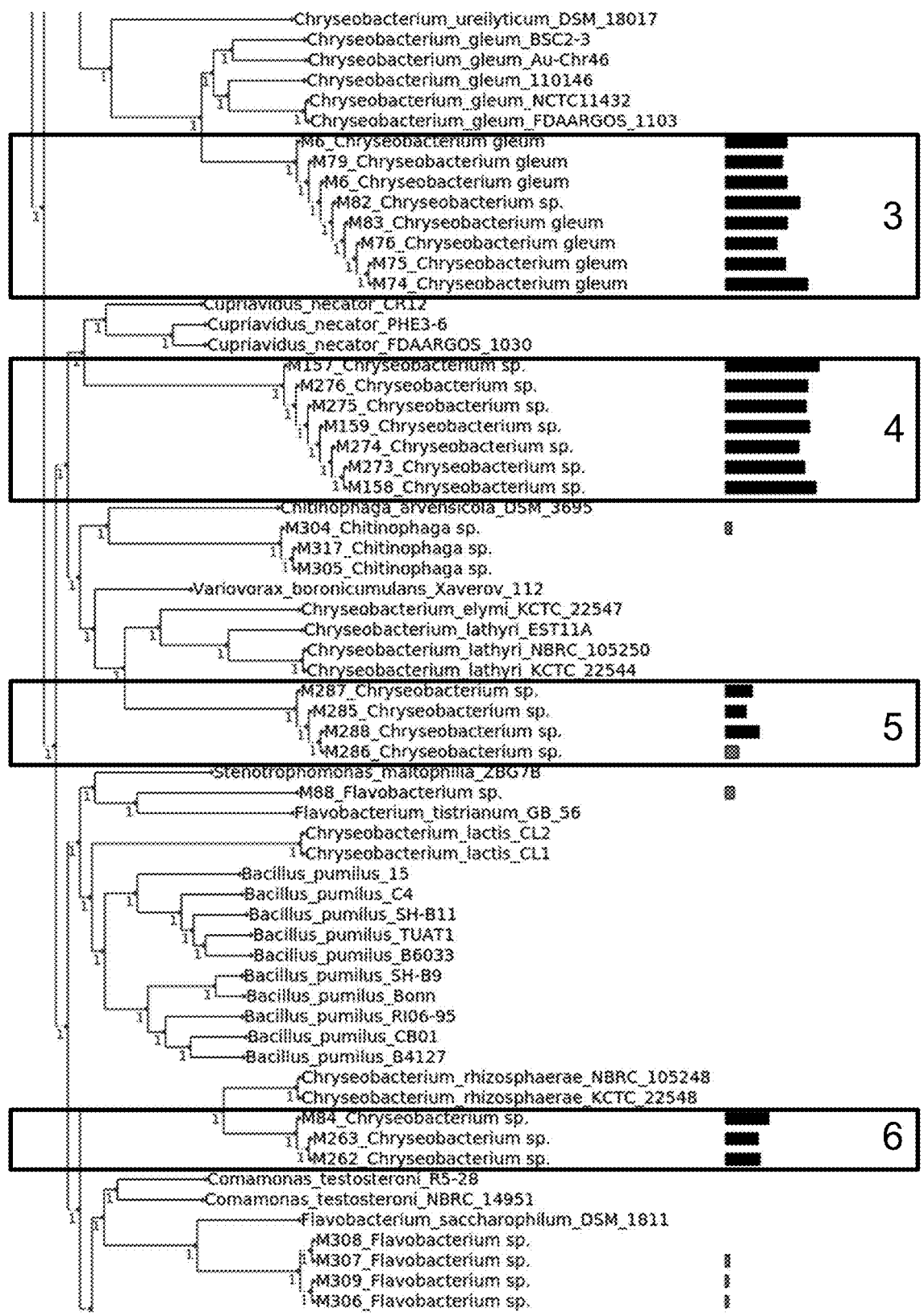
Figure 10D:
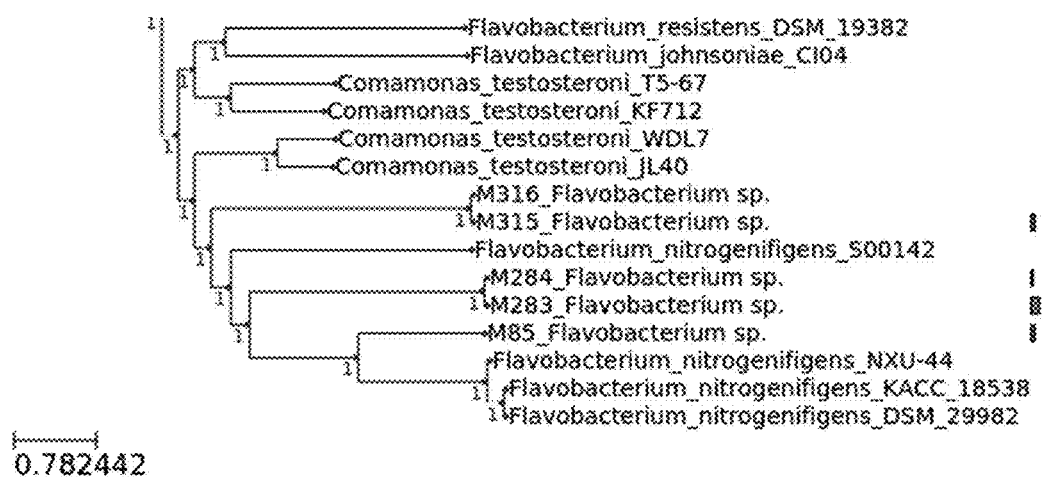

During the development of embodiments of the technology described herein, whole-genome phylogenetic trees were constructed using the whole genomes of the organisms tested for insecticidal activity and the whole genomes of related organisms. Related organisms were identified using complete genomes or chromosome assemblies available in the NCBI database and were chosen using 16S ribosomal RNA gene sequence or whole genome average nucleotide identity. FIG. 9 shows a phylogeny of organisms based on the presence and absence of genes. FIG. 10 is a phylogeny based on SNP variation in genes that were represented in at least 60% of the organisms. Both trees (FIG. 9 and FIG. 10) were built using PEPPAN v 1.0.5, which draws trees using a RapidNJ algorithm. The trees were visualized and annotated using the Environment for Tree Exploration (ETE) python package. In FIG. 9, the bars represent the average 72 hour mortality of *Aedes aegypti* following application of microbial cultures. Black bars represent *Aedes aegypti* mortality rates above 15%, and grey bars represent *Aedes aegypti* mortality rates below 15%. In FIG. 10, bars represent the average 72 hour mortality of *Aedes aegypti* following application of microbial cultures. Black bars represent *Aedes aegypti* mortality rates above 15%, and grey bars represent *Aedes aegypti* mortality rates below 15%.

Figure 11A:
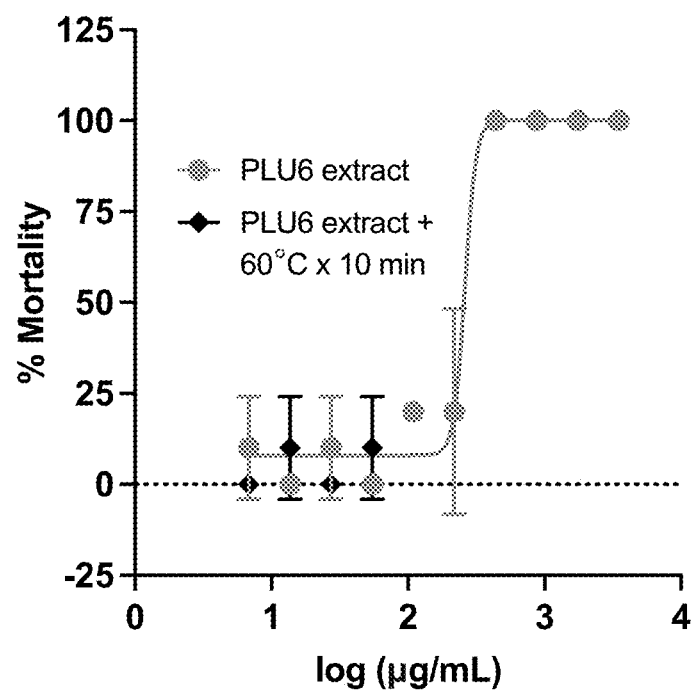
FIG. 11C shows preparative HPLC (210 nm and 254 nm) chromatograms of PLU6 ethyl acetate extract. Numbers on the chromatogram indicate fractions collected.
FIG. 11D shows a semipreparative HPLC (220 nm) chromatogram of fraction 19 indicated in FIG. 11C.
FIG. 11E is a comparison of the HPLC (210 nm) chromatograms of fractions 17-19 indicated in FIG. 11C of the PLU6 ethyl acetate extract (bottom trace) and an arundine (3,3'-diindolylmethane) standard (top trace).
FIG. 11F is a comparison of the $^1$H NMR (600 MHz, MeOD-$d_4$) spectra of fractions 17-19 indicated in FIG. 11C of the PLU6 ethyl acetate extract (bottom trace) and an arundine (3,3'-diindolylmethane) standard (top trace).
FIG. 11G is a mass spectrum of metabolite 2 described herein.
FIG. 11H is a tri-indole chemical structure of the metabolite 2 compound.
FIG. 11I is a mass spectrum of metabolite 3 described herein.
FIG. 11J is a tetra-indole chemical structure of the metabolite 3 compound.
Figure 11B:
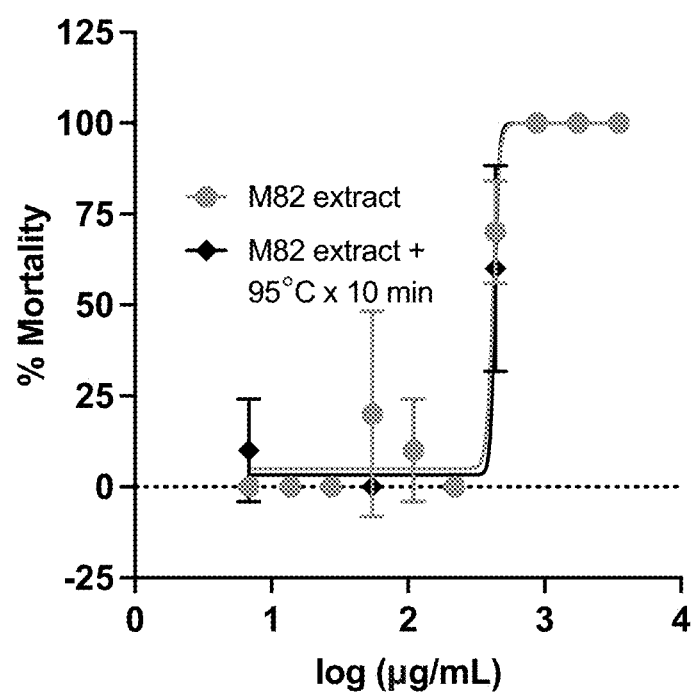
Figure 11C:
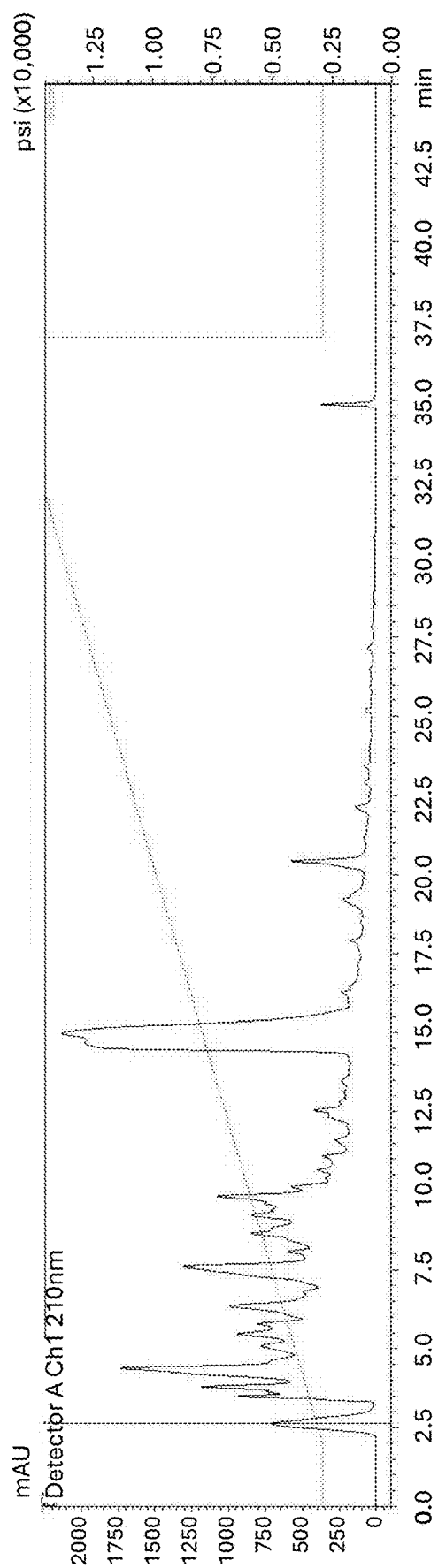
Figure 11D:
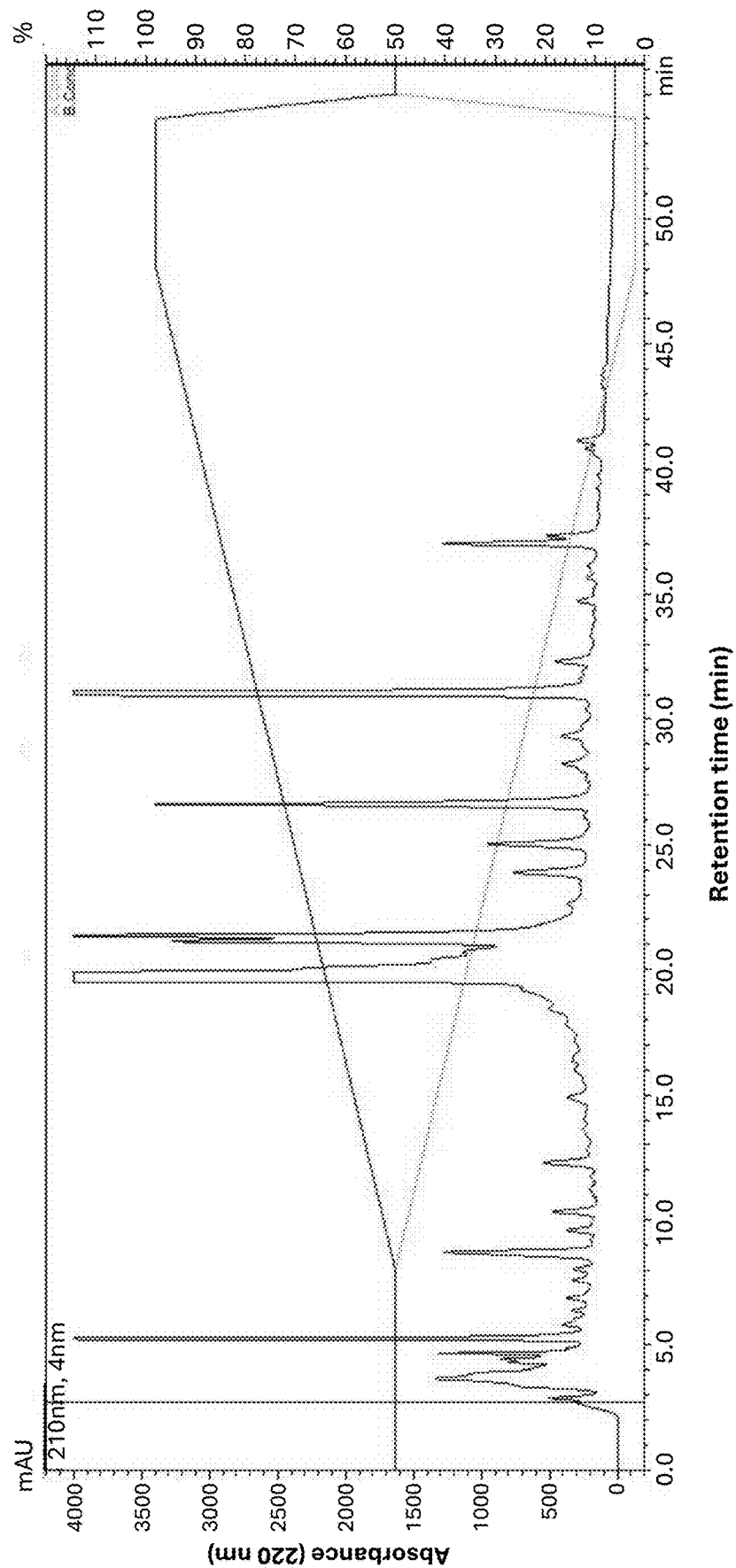
Figure 11E:
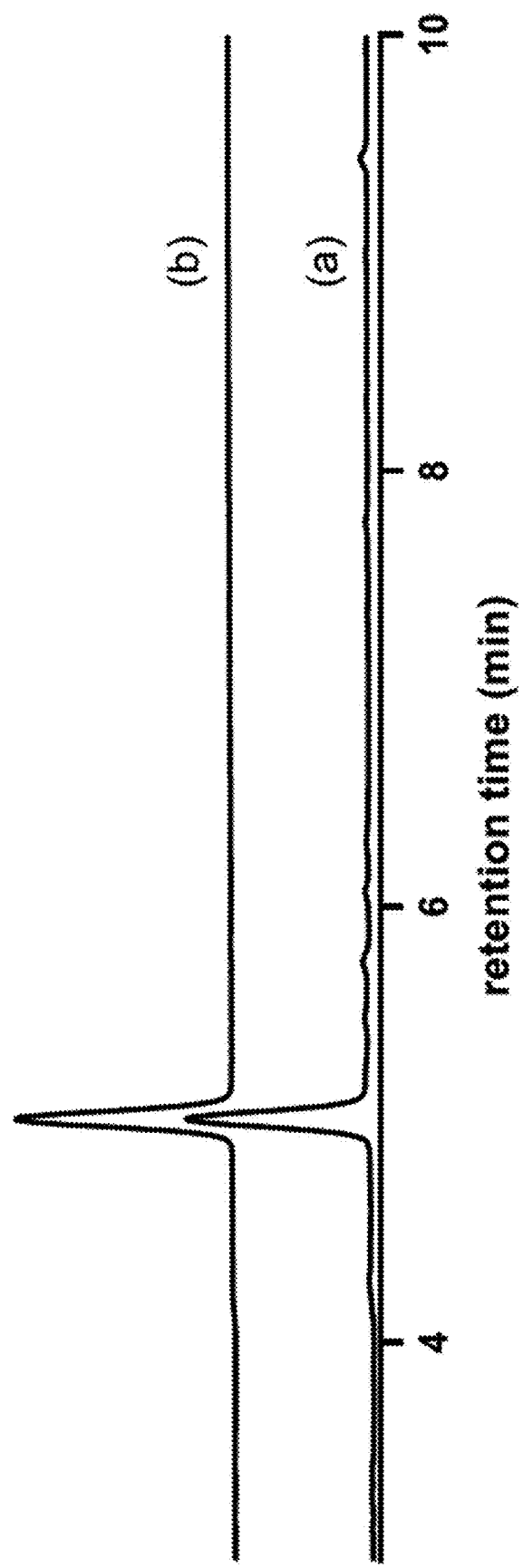
Figure 11F:
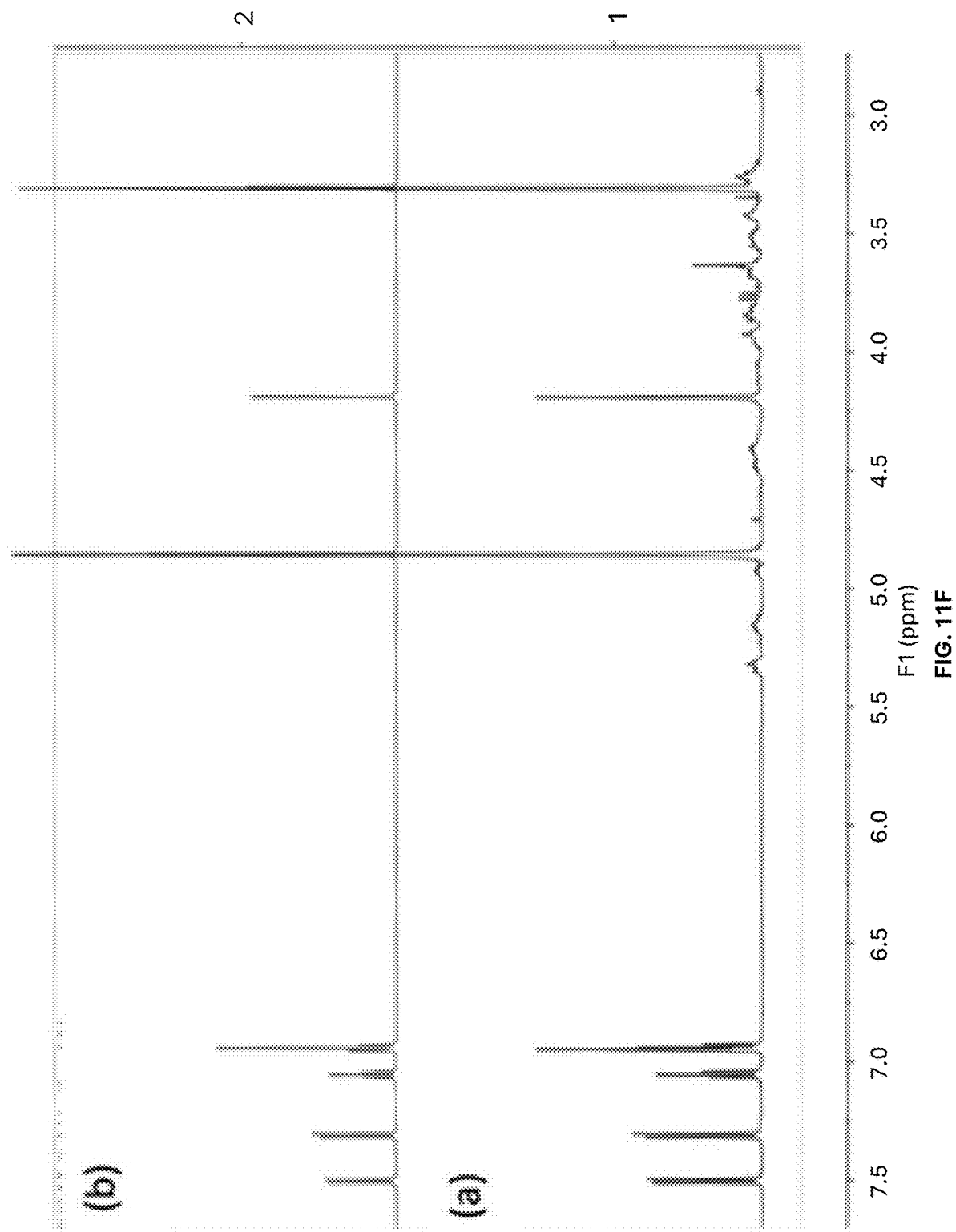

Upon extracting the common ancestors for the clades in which the killing (e.g., insecticidal (e.g., larvicidal)) activity was greater than 15%, all organisms identified as having killing activity (e.g., detected to cause insecticidal (e.g., larvicidal) mortality of at least 15%) have at least one coding region encoding a protein with at least 95% sequence identity across the entire length of SEQ ID NO: 1 (MKCIGJBJ_03627 DNA gyrase subunit A), at least 95% sequence identity across the entire length of SEQ ID NO: 2 (MKCIGJBJ_03079 DNA topoisomerase 1), at least 95% sequence identity across the entire length of SEQ ID NO: 3 (MKCIGJBJ_00500 DNA-directed RNA polymerase subunit beta), at least 95% sequence identity across the entire length of SEQ ID NO: 4 (MKCIGJBJ_00499 DNA-directed RNA polymerase subunit beta'), and/or at least 95% sequence identity across the entire length of SEQ ID NO: 5 (MKCIGJBJ_02095 DNA-directed RNA polymerase subunit alpha).

During the development of embodiments of the technology described herein, experiments were conducted to test the activity of organic extracts prepared from supernatants of PLU6 and M82 cultures against *Ae. aegypti* larvae (FIG. 11A and FIG. 11B). Data were collected indicating that small molecules (e.g., organic molecules) derived from cultures of two independent *Chryseobacterium* strain cultures (PLU6 and M82) displayed larvicidal activity. Activity of small molecule extracts were stable at 60° C. (FIG. 11A) and 95° C. (FIG. 11B), indicating that at least one active molecule in these extracts is heat stable. Further, data collected during these experiments indicated that the activity is dose-dependent. FIG. 11A and FIG. 11B show dose curves for PLU6 (FIG. 11A) and M82 (FIG. 11B) extracts applied to *Ae. aegypti* larvae. Mortality data were plotted against $\log_{10}$-transformed compound concentrations. Inhibitory dose-response curves were fitted using GraphPad Prism software. Error bars represent standard deviations calculated from two technical replicates (assay wells). The mean $LC_{50}$ s calculated for PLU6 extract and PLU6 extract treated at 60° C. for 10 minutes were 253±11 μg/mL and 249±17 μg/mL, respectively. The mean $LC_{50}$s calculated for M82 extract and M82 extract treated at 95° C. for 10 minutes were 340±113 μg/mL and 271±227 μg/mL, respectively. Standard deviations were calculated from two independent replicate dose curves for which the curve fit $R^2$ values were ≥0.75.

Furthermore, data indicated that extracts prepared from *Chryseobacterium* strains cause mortality in a variety of insects (e.g., across multiple taxonomic groups). In particular, treatment with extracts from *Chryseobacterium* strains causes mortality in cabbage looper (*Trichoplusia ni*) neonates (FIG. 12). Assay used N=16 larvae per concentration. The negative controls (no extract) displayed 0% mortality.

Further, during the development of embodiments of the technology described herein, experiments were conducted to isolate and characterize metabolites produced by PLU6. PLU6 was inoculated on NB agar and incubated for 2 days at 30° C. Seed cultures were prepared by inoculating 50 mL falcon tubes (31×), each containing NB broth medium (5 mL), with a single colony of the bacterial isolate and shaking at 200 rpm at 30° C. for one day. The seed culture (5 mL) was transferred into a 2.8 L unbaffled Fernbach flask containing 1 L (31×) of NB broth and incubatedat 200 rpm at 30° C. for two days. After incubation, an aliquot of methanol (100 mL) and 22 g of Amberlite XAD16N resin contained within a polypropylene mesh bag were added to each 1 L culture and incubated for 2 hours on a rotary shaker at 200 rpm. Resin bags were removed and washed with copious amounts of $H_2O$ to remove any water-soluble media components. The washed resin bags were then extracted with ethyl acetate (EtOAc), followed by methanol (MeOH). The organic fractions were combined and concentrated to dryness in vacuo to yield the crude extract. The crude extract was then subjected to liquid-liquid partitioning between EtOAc and $H_2O$. The EtOAc fraction was dried over anhydrous $Na_2SO_4$ and concentrated to dryness in vacuo to yield 1627 mg of product.

The EtOAc fraction was redissolved in MeOH and subjected to chromatographic fractionation (FIG. 11C) using preparative reversed-phase HPLC (Phenomenex Luna phenylhexyl, 21.2 mm×15 cm, 5 μm, 20 mL/min, isocratic elution with 80% $H_2O$/MeCN for 2 min followed by gradient elution from 80% $H_2O$/MeCN to 100% MeCN over 30 min then isocratic elution with 100% MeCN for 5 min) to yield 30 fractions. The preparative HPLC fractions (at concentrations of 200 μg/mL and 20 μg/mL) were tested against *Aedes aegypti*. Fractions 18-20 all showed 100% mortality at 72 hours at a concentration of 200 μg/mL. Fractions 18, 19, and 20 showed 80%, 100%, and 40% mortality, respectively, at 72 hours at a concentration of 20 μg/mL.

Fraction 19 was subjected to chromatographic purification using semipreparative reversed phase HPLC (Phenomenex Luna phenylhexyl, 10 mm×25 cm, 5 μm, 4 mL/min, isocratic elution with 50% $H_2O$/MeCN for 8 min followed by gradient elution from 50% $H_2O$/MeCN to 2% $H_2O$/MeCN over 40 min then isocratic elution with 2% $H_2O$/MeCN for 6 min). Chromatographic purification of Fraction 19 yielded several peaks (FIG. 11D). Fraction 17 (FIG. 11D) from the chromatographic purification of Fraction 19 identified above (FIG. 11C) was further characterized.

HPLC and $^1H$ NMR (MeOD-$d_4$) analysis of Fraction 17 (F17) showed the presence of a metabolite (1) as a principal component. Detailed analysis of NMR data suggested 1 to be arundine (3,3'-diindolylmethane), which was confirmed by comparing the HPLC profile and $^1$H NMR data of metabolite 1 with a commercial standard (FIGS. 11E and 11F).

Figure 11G:
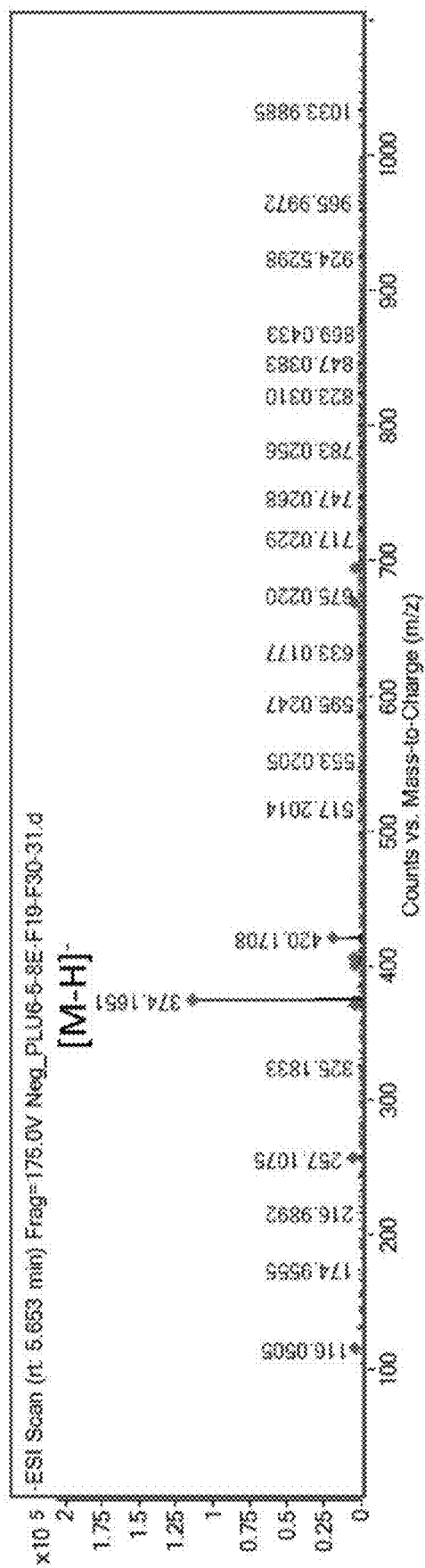
Figure 11H:
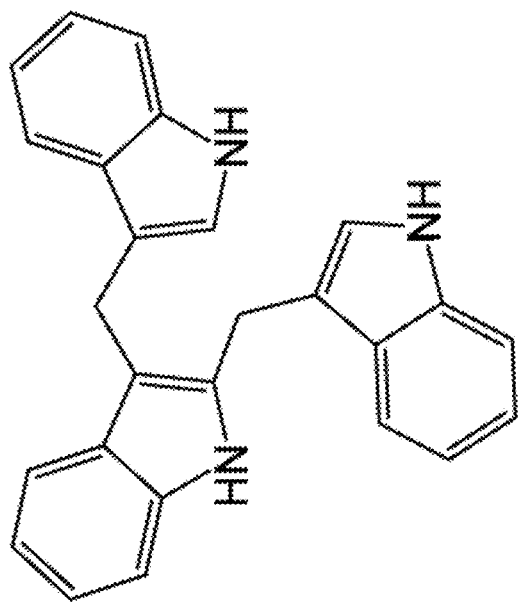

Fractions 30 and 31 from the chromatographic purification of Fraction 19 identified above (FIG. 11C) were pooled and further characterized, and a second metabolite (metabolite 2) was identified. HRESI(−)MS analysis of 2 revealed a quasi-molecular ion ([M-H]$^-$) corresponding to a molecular formula $C_{26}H_{21}N_3$ (Δppm −3.1) (FIG. 11G). The UV-vis spectrum indicated the presence of an indole chromophore and was quite similar to arundine. $^1$H and 2D HSQC NMR analysis suggested the structure of 2 to be an indole trimer as shown in FIG. 11H.

Figure 11I:
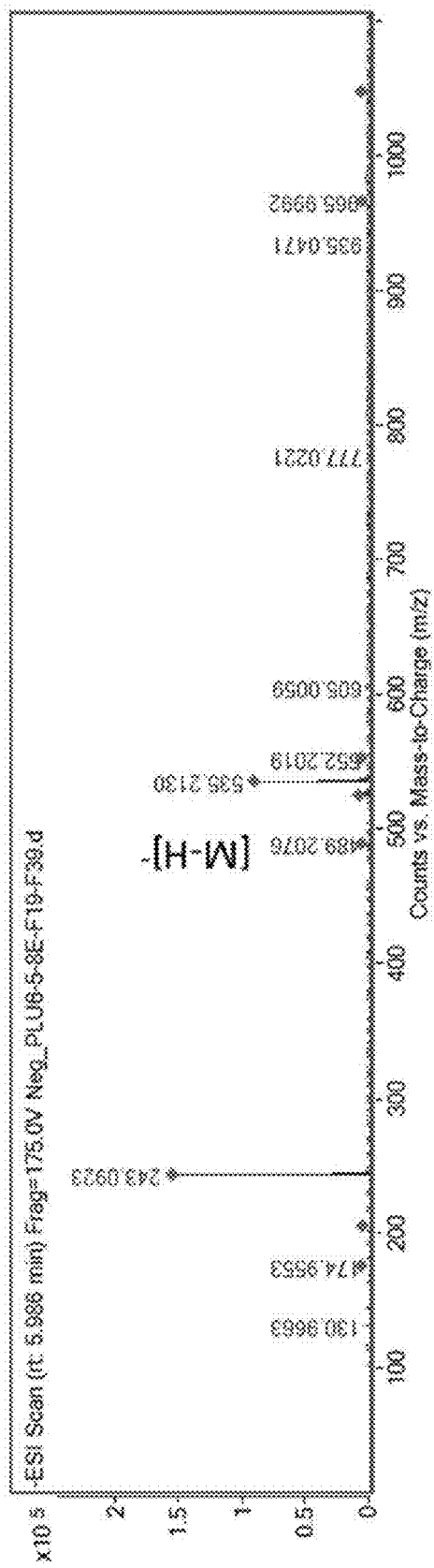
Figure 11J:
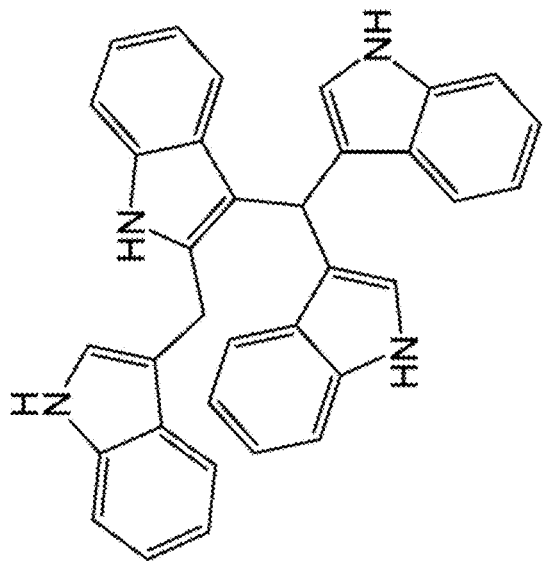

Fraction 39 from the chromatographic purification of Fraction 19 identified above (FIG. 11C) was characterized and a metabolite was identified in this fraction (metabolite 3). HRESI(−)MS analysis of 3 revealed a quasi-molecular ion ([M-H]−) corresponding to a molecular formula $C_{34}H_{26}N_4$ (Δppm −1.78) (FIG. 11I). The UV-vis spectrum indicated the presence of an indole chromophore and was quite similar to arundine. $^1$H and 2D HSQC NMR analysis suggested the structure to be an indole trimer as shown in FIG. 11J.

During the development of embodiments of the technology described herein, experiments were conducted to test the larvicidal activity of metabolites 1-3 against *Aedes aegypti*. Data collected during these experiments indicated that metabolites 2 and 3 (e.g., the tri-indole and tetra-indole compounds, respectively, as shown in FIGS. 11H and 11J, respectively) did not kill larvae at a concentration up to 80 μg/mL. However, diindole compounds (e.g., arundine (1)) exhibited larvicidal activity against *Ae. aegypti*.

In particular, data indicated that a diindole compound (e.g., 3,3'-diindolylmethane) produced by PLU6 is active against *Aedes aegypti* larvae in a dose-dependent manner (FIG. 13). To produce a dose curve, the compound 3,3'-diindolylmethane was applied to *Ae. aegypti* larvae, mortality data were collected, the mortality data were plotted against $\log_{10}$-transformed compound concentrations, and an inhibitory dose-response curve was fitted using GraphPad Prism software (FIG. 13). The representative curve fit shown corresponds to a 3,3'-diindolylmethane $LC_{50}$ of 10.2 μg/mL (95% CI [7.3, 14.2]). Error bars represent standard deviations calculated from four technical replicates (assay wells). The mean $LC_{50}$ calculated for 3,3'-diindolylmethane was 7.5±3.0 μg/mL (standard deviation calculated from five independent replicate dose curves for which the curve fit $R^2$ values were ≥0.75. Significant outlier $LC_{50}$ values were identified using Grubb's test with P<0.01 and were not included in calculating the mean $LC_{50}$). Mortality in the negative control was not subtracted but was <10% for all assays.

Further, data indicated that the diindole compound (e.g., 3,3'-diindolylmethane) produced by strain PLU6 is active against *Culex quinquefasciatus* larvae in a dose-dependent manner (FIG. 14). To produce a dose curve, the compound 3,3'-diindolylmethane was applied to *C. quinquefasciatus* larvae, mortality data were collected, the mortality data were plotted against $\log_{10}$-transformed compound concentrations, and an inhibitory dose-response curve was fitted using GraphPad Prism software (FIG. 14). The representative curve fit shown corresponds to a 3,3'-diindolylmethane $LC_{50}$ of 7.5 μg/mL (95% CI [4.5, 13.3]). Error bars represent standard deviations calculated from four technical replicates (assay wells). Mortality in the negative control was 0%.

Further, 3,3'-diindolylmethane is active against *Spodoptera frugiperda*, *Trichoplusia ni*, and *Heliothis virescens* in a dose-dependent manner. Experiments were conducted in which mortality of lepidopteran larvae was measured after 7 days of diet overlay treatment with 3,3'-diindolylmethane at the concentrations indicated in Table 3. Mean mortalities and standard deviations were calculated from three independent experiments (each N=16). For each experiment, mortalities were corrected using Abbott's formula (Abbott (1987) "Method of computing the effectiveness of an insecticide" J. American Mosquito Control Association 2: 302-03, incorporated herein by reference). For all species except *Plutella xylostella*, neonates were used. For *P. xylostella*, third instar larvae were used. The positive control used was 1000 ppm of *Bacillus thuringiensis* kurstaki.

TABLE 3

Activity of 3,3'-Diindolylmethane against lepidoptera

| Treatment | Spodoptera frugiperda (fall armyworm) | Trichoplusia ni (cabbage looper) | Ostrinia nubilalis (European corn borer) | Heliothis virescens (tobacco budworm) | Plutella xylostella (diamondback moth) |
|---|---|---|---|---|---|
| 2500 μg/mL | 95.70 ± 3.73% | 93.25 ± 6.90% | 4.17 ± 3.61% | 83.33 ± 14.43% | 43.35 ± 15.85% |
| 625 μg/mL | 85.08 ± 3.85% | 44.60 ± 26.25% | 6.25 ± 6.25% | 93.75 ± 6.25% | 15.72 ± 5.24% |
| 156.25 μg/mL | 79.03 ± 25.96% | 22.95 ± 23.12% | 4.17 ± 3.61% | 85.15 ± 13.34% | 7.39 ± 1.98% |
| 39.06 μg/mL | 2.15 ± 6.71% | 3.00 ± 13.24% | 2.08 ± 3.61% | 40.93 ± 35.89% | 1.07 ± 1.86% |
| 9.77 μg/mL | 4.10 ± 12.69% | −1.15 ± 3.79% | 2.08 ± 3.61% | 3.16 ± 3.13% | 1.01 ± 4.82% |
| 0 μg/mL | 2.15 ± 6.71% | 8.04 ± 14.31% | 4.17 ± 7.22% | 11.69 ± 11.31% | 1.01 ± 4.82% |
| positive control | 100.00 ± 0.00% | 100.00 ± 0.00% | 100.00 ± 0.00% | 100.00 ± 0.00% | 100.00 ± 0.00% |
| negative control | 0.00 ± 0.00% | 0.00 ± 0.00% | 0.00 ± 0.00% | 0.00 ± 0.00% | 0.00 ± 0.00% |

Further, 3,3'-Diindolylmethane displays activity against a variety of lepidopteran species in a dose-dependent manner (Table 4). In Table 4, species abbreviations are as follows: CM, *Cydia pomonella* (codling moth); ECB, *Ostrinia nubilalis* (European corn borer); SCB, *Diatraea saccharalis* (sugarcane borer); SWCB, *Diatraea grandiosella* (southwestern corn borer); CL, *Trichoplusia ni* (cabbage looper); BAW, *Spodoptera exigua* (beet armyworm); DBM, *Plutella xylostella* (diamondback moth); SBL, *Chrysodeixis includens* (soybean looper); VBC, *Anticarsia gemmatalis* (velvetbean caterpillar); CEW, *Helicoverpa zea* (corn earworm); BCW, *Agrotis ipsilon* (black cutworm); SAW, *Spodoptera eridania* (southern armyworm); TBW, *Chloridia virescens* (tobacco budworm); and FAW, *Spodoptera frugiperda* (fall armyworm). Activity is low or not observed in several species, including *O. nubilalis*, *P. xylostella*, and *A. ipsilon*, which indicates that 3,3'-diindolylmethane displays species specificity in its activity.

TABLE 4

Activity of 3,3'-Diindolylmethane

| | Mortalities (%) after 7 days of treatment (Abbott's Correction) | | | | | | |
|---|---|---|---|---|---|---|---|
| Treatment | CM | ECB | SCB | SWCB | CL | BAW | DBM |
| 2500 μg/mL | 39.3 | −7.7 | 100.0 | 83.3 | 93.1 | 71.9 | 19.4 |
| 625 μg/mL | 50.0 | −15.4 | 100.0 | 90.0 | 72.4 | 93.8 | 6.5 |
| 156.25 μg/mL | 21.4 | −23.1 | 100.0 | 46.7 | 41.4 | 71.9 | 19.4 |
| 0 μg/mL | −7.1 | −15.4 | 27.6 | 13.3 | 10.3 | 12.5 | 0.0 |

TABLE 4-continued

Activity of 3,3'-Diindolylmethane

| | | | | | | | |
|---|---|---|---|---|---|---|---|
| positive control | 100.0 | 100.0 | 100.0 | 100.0 | 100.0 | 100.0 | 100.0 |
| negative control | 0.0 | 0.0 | 0.0 | 0.0 | 0.0 | 0.0 | 0.0 |

| | Mortalities (%) after 7 days of treatment (Abbott's Correction) | | | | | | |
|---|---|---|---|---|---|---|---|
| Treatment | SBL | VBC | CEW | BCW | SAW | TBW | FAW |
| 2500 µg/mL | 80.0 | 96.7 | 90.6 | 20.0 | 100.0 | 87.1 | 96.7 |
| 625 µg/mL | 50.0 | 70.0 | 50.0 | 26.7 | 100.0 | 74.2 | 63.3 |
| 156.25 µg/mL | 26.7 | 100.0 | 40.6 | 0.0 | 22.6 | 74.2 | 40.0 |
| 0 ug/mL | −6.7 | 10.0 | 9.4 | −3.3 | 9.7 | 3.2 | 3.3 |
| positive control | 100.0 | 100.0 | 100.0 | 100.0 | 100.0 | 100.0 | 100.0 |
| negative control | 0.0 | 0.0 | 0.0 | 0.0 | 0.0 | 0.0 | 0.0 |

During the development of embodiments of the technology described herein, experiments were conducted to assess the dose-dependent activity of 3,3'-diindolylmethane against lepidopteran species. Data collected indicated that 3,3'-diindolylmethane is active against *Trichoplusia ni* (cabbage looper), *Spodoptera exigua* (beet armyworm), *Chloridia virescens* (tobacco budworm), *Spodoptera frugiperda* (fall armyworm), and *Anticarsia gemmatalis* (velvetbean caterpillar) in a dose-dependent manner (FIG. 15). Data were obtained from bioassay measurements performed with N=32 neonates in a diet overlay format. Data are corrected using Abbott's Correction. Positive control samples (1000 ppm *Bacillus thuringiensis kurstaki*) produced 100% mortality for all five species.

Figure 17:
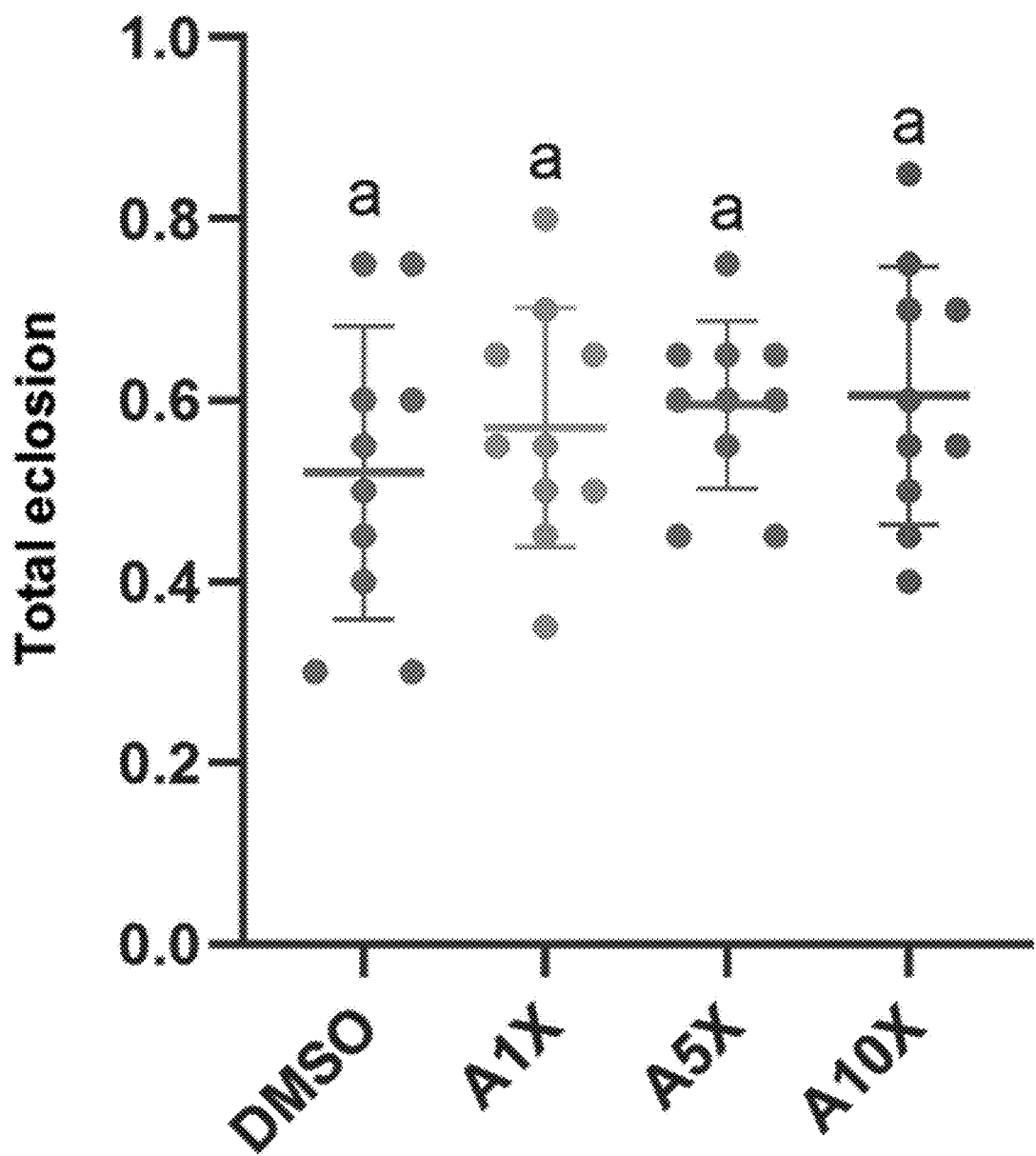
Figure 18:
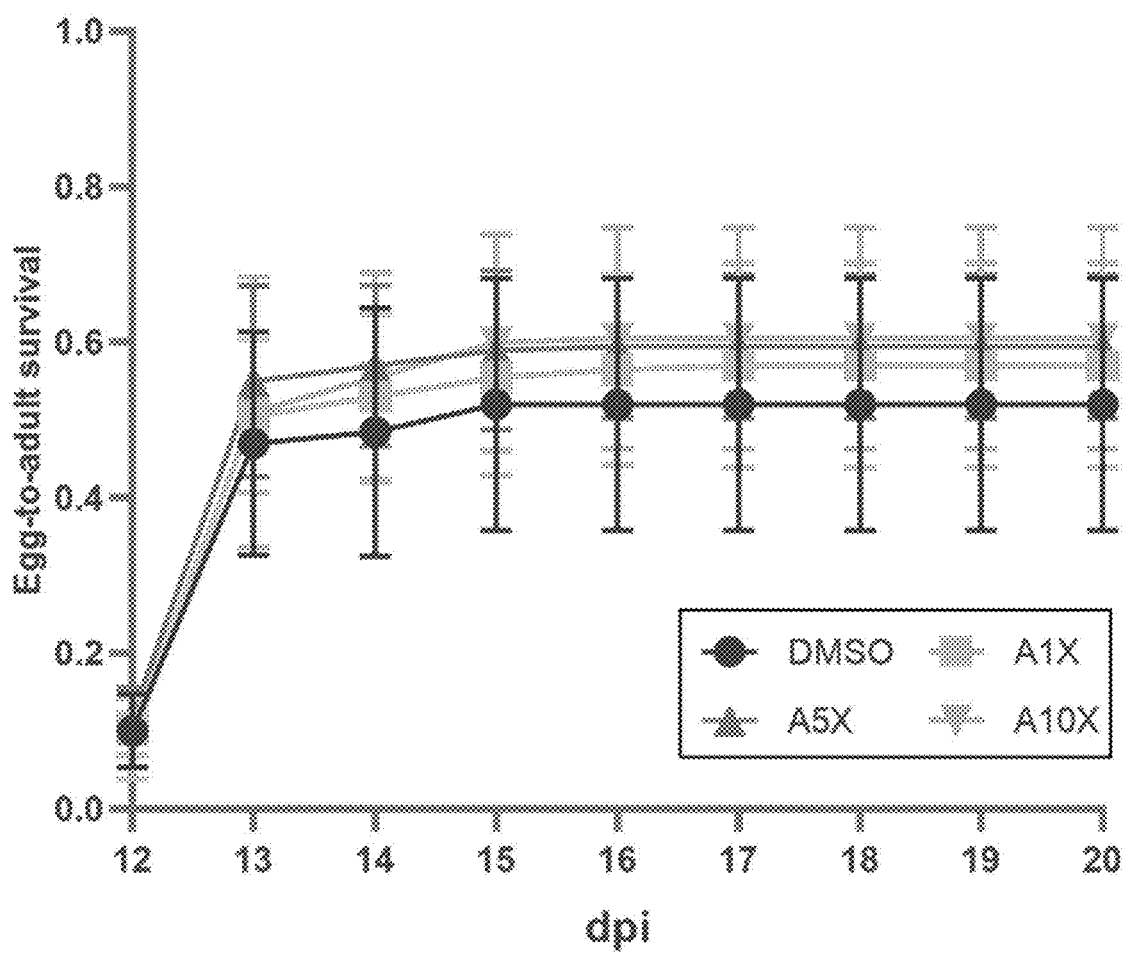

During the development of embodiments of the technology described herein, experiments were conducted to assess the activity of 3,3'-diindolylmethane against *Drosophila suzukii*. Data collected indicated that the pupation rate of *Drosophila suzukii* (spotted wing *Drosophila*) was not affected by 3,3'-diindolylmethane treatment when added to diet (FIG. 16). A1X=100 µg/mL; A5X=500 µg/mL; A10X=1000 µg/mL. Each concentration was tested with 10 vials containing 20 *D. suzukii* L2 larvae. Pupation rates were not significantly different, as measured by a one-way ANOVA (alpha=0.05). Further, data collected indicated that the eclosion rate of *Drosophila suzukii* (spotted wing *Drosophila*) was not affected by 3,3'-diindolylmethane treatment when added to diet (FIG. 17). A1X=100 µg/mL; A5X=500 µg/mL; A10X=1000 µg/mL. Each concentration was tested with 10 vials containing 20 *D. suzukii* L2 larvae. Treatments labeled with the same letter are not significantly different, as measured by a one-way ANOVA (alpha=0.05). And, data collected indicated that the egg-to-adult survival of *Drosophila suzukii* (spotted wing *Drosophila*) was not affected by 3,3'-diindolylmethane treatment when added to diet (FIG. 18). A1X=100 µg/mL; A5X=500 µg/mL; A10X=1000 µg/mL. Each concentration was tested with 10 vials containing 20 *D. suzukii* L2 larvae. "Dpi" indicates days post infestation (0 dpi is the day of egg-laying). Accordingly, as shown by FIGS. 16, 17, and 18, 3,3'-diindolylmethane did not display insecticidal activity against the agricultural pest spotted wing *Drosophila*, indicating that the compound is specific for certain insect targets.

Figure 19:
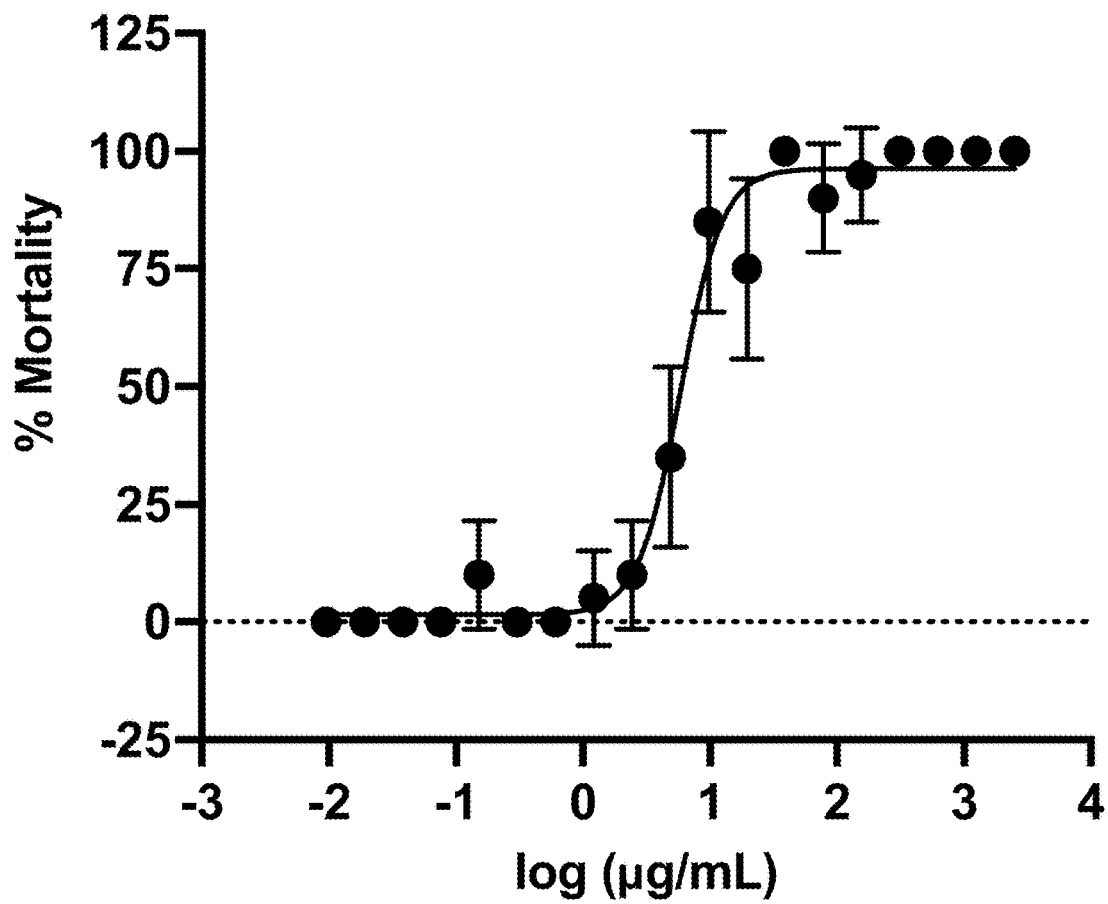

During the development of embodiments of the technology described herein, experiments were conducted to test the activity of a synthetic diindole compound (e.g., 3-((1H-indol-2-yl)methyl)-1H-indole) against *Aedes aegypti* larvae. Data collected indicated that 3-((1H-indol-2-yl)methyl)-1H-indole exhibits larvicidal activity against *Ae. aegypti* in a dose-dependent manner (FIG. 19). FIG. 19 shows a representative dose curve for 3-((1H-indol-2-yl)methyl)-1H-indole applied to *Ae. aegypti* larvae. Mortality data were plotted against $\log_{10}$-transformed compound concentrations. An inhibitory dose-response curve was fitted using GraphPad Prism software. The representative curve fit shown corresponds to a 3-((1H-indol-2-yl)methyl)-1H-indole $LC_{50}$ of 5.8 µg/mL (95% CI [5.1, 6.8]). Error bars represent standard deviations calculated from four technical replicates (assay wells). The mean $LC_{50}$ calculated for 3-((1H-indol-2-yl)methyl)-1H-indole was 6.3±2.1 µg/mL (standard deviation was calculated from four independent replicate dose curves for which the curve fit $R^2$ values were ≥0.75. Significant outlier $LC_{50}$ values were identified using Grubb's test with P<0.01 and were not included in calculating the mean $LC_{50}$). Mortality in the negative control was not subtracted but was <10% for all assays.

Figure 20:
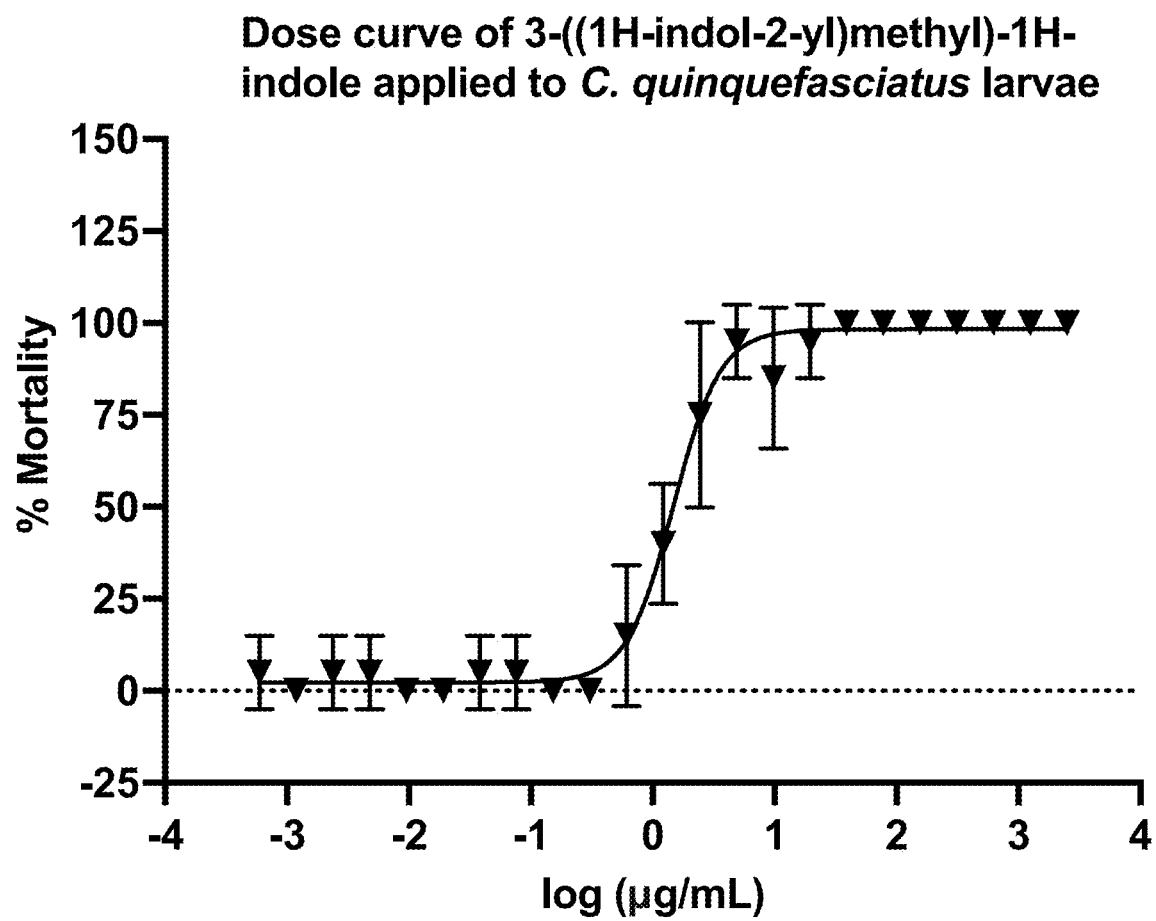

Further, experiments were conducted to test the activity of the synthetic diindole compound (e.g., 3-((1H-indol-2-yl)methyl)-1H-indole) against *Culex quinquefasciatus* larvae. The data collected indicated that 3-((1H-Indol-2-yl)methyl)-1H-indole exhibits larvicidal activity against *C. quinquefasciatus* in a dose-dependent manner (FIG. 20). FIG. 20 shows a representative dose curve for 3-((1H-indol-2-yl)methyl)-1H-indole applied to *C. quinquefasciatus* larvae. Mortality data were plotted against $\log_{10}$-transformed compound concentrations. An inhibitory dose-response curve was fitted using GraphPad Prism software. The representative curve fit shown corresponds to a 3-((1H-indol-2-yl)methyl)-1H-indole $LC_{50}$ of 1.5 µg/mL (95% CI [1.3, 1.7]). Error bars represent standard deviations calculated from four technical replicates (assay wells). The mean $LC_{50}$ calculated for 3-((1H-indol-2-yl)methyl)-1H-indole was 0.95±0.75 µg/mL (standard deviation calculated from two independent replicate dose curves for which the curve fit $R^2$ values were ≥0.75. Mortality in the negative control was not subtracted but was <10% for all assays.

Figure 21:
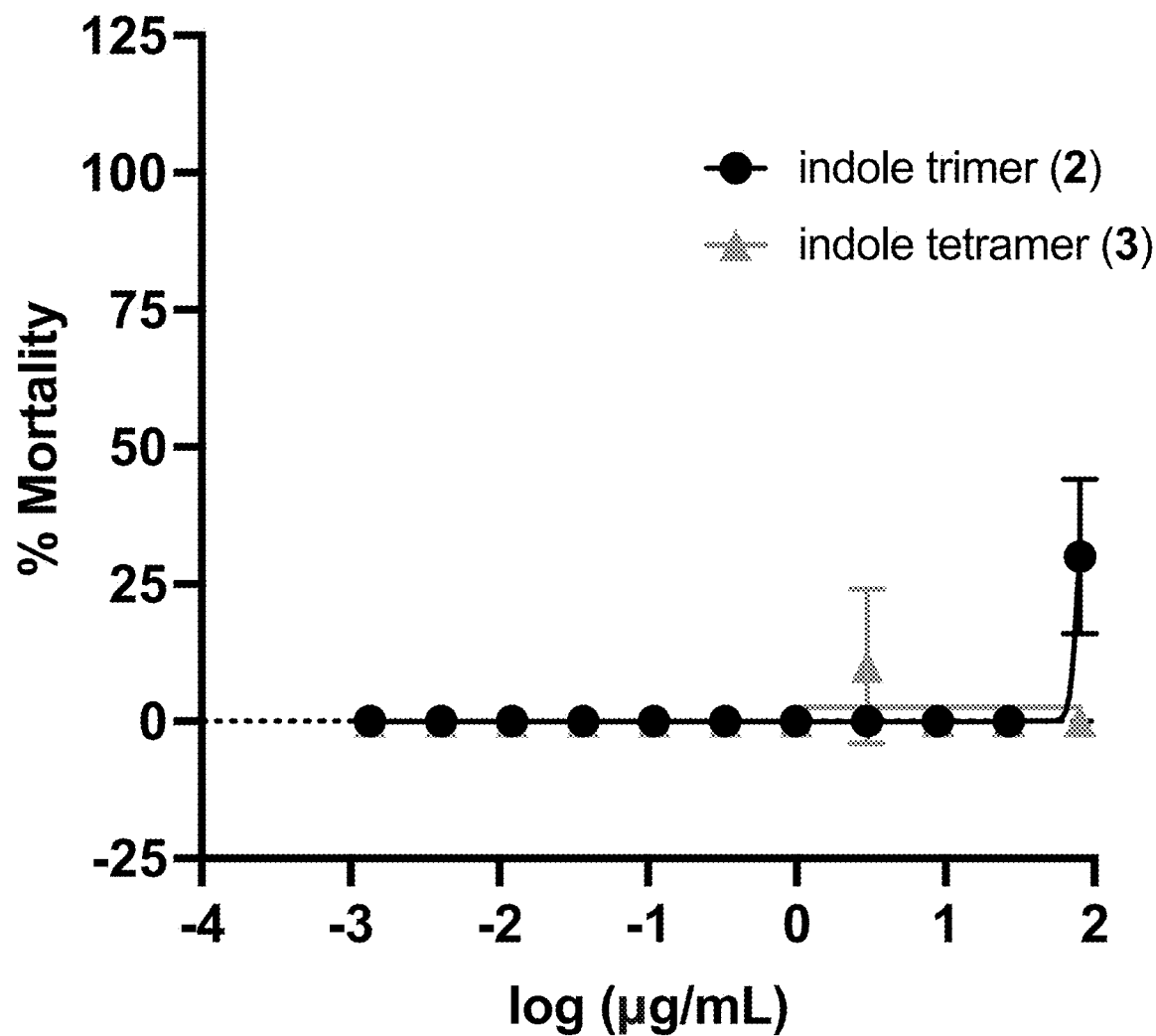

During the development of embodiments of the technology described herein, experiments were conducted to test the activity of indole trimer and indole tetramer compounds shown in FIG. 11H and FIG. 11J, respectively, against *Ae. aegypti*. Data collected indicated that the tri-indole and tetra-indole compounds have no activity against *Aedes aegypti* larvae compared to diindole compounds (FIG. 21). Error bars represent standard deviations calculated from two technical replicates (assay wells). Thus, indole compounds having more than two indole groups do not display activity in an *Ae. aegypti* bioassay, indicating that the diindole structure is important for killing activity.

The breadth and scope of the present disclosure should not be limited by any of the above-described exemplary embodiments, but should be defined only in accordance with the following claims and their equivalents. All publications and patents mentioned in the above specification are herein incorporated by reference in their entirety for all purposes. Various modifications and variations of the described compositions, methods, and uses of the technology will be apparent to those skilled in the art without departing from the scope and spirit of the technology as described. Although the technology has been described in connection with specific exemplary embodiments, it should be understood that the invention as claimed should not be unduly limited to such specific embodiments. Indeed, various modifications of the described modes for carrying out the invention that are obvious to those skilled in the art are intended to be within the scope of the following claims.

>MKCIGJBJ_03627 DNA gyrase subunit A
SEQ ID NO: 1
MTTEEYSHEGESLKKVSGLYKDWFLDYASYVILDR
AIPSIYDGLKPVQRRIMHSMRELEDGRYNKVANIV
GNTMKYHPHGDASITDAMVQIGQKELLIDTQGNWG
NIYTGDSAAAARYIEARLTPFALEVVFNPKTTEWT
KSYDGRNNEPIDLPVKFPLLLAQGVEGIGVGLSTK
ILPHNFNELINASVAYLKGKKFELYPDFLTAGYLD
VSEYNDGHRGGKVRARAKITQTDKHTLVISELPYS
KTTTDLIDSILKANEKGKIKIKKIEDNTSDKVEIL
IHIHNDVSPDKTIDALYAFTDCQVTISPNACVIVG
DKPMFMNVSEILKMNTDHTVSLLKKELEIELHELQ
ESWHFSSLERIFIENRIYHDIEEVKTWEDVLKTID
AGLKPHTKHLLRAVTEEDILKLTEIRIKRISRFDL
DKFKENIASLEGKIEQVKYNLENLIAYAIDYYLNI
QKKYGKDKQRRTELRIFDTIDATKVAVANEKFYAN
FEEGFIGTSLKKDQYLFDCSDIDDIITFRKDGSMK
VVKVEAKTFIGKDILHVAVWKKNDKRTVYNMIYRE
GREGPYYMKRFSVTGVTRNTDYPLASDKKGSETLY
FSANPNGEAETVTVLLKPNPRIRKNKMEINFSDLA
IKGRDSKGNLVTKYAVKKVDLKEEGVSTLAPRKIW
PDDTVRRLNADARGTLLGSFKGDDKILTINTNGEV
KLVSFDLGNRFDDEYLVLEKWKPEQPITCIYYDGE
KDIYFIKRFLLENTVNVQTFMPSEHPKSFIENVIV
ANDATAEIIFAKDKGKEREPEVVNIDEFIAVKGIK
AIGNQFTKFKVKAINITIPEPVEEEPEAYEDPEPT
GDLDEDGGMIGDLFQDDGNNENE >MKCIGJBJ_03079 DNA topoisomerase 1
SEQ ID NO: 2
MSKNLVIVESPAKAKTIQKYLGKDFEVKSSFGHIR
DLPKKGMGIDLATFNPDYEVSADKKKLVTELKAAV
KKADMVWLASDEDREGEAIAWHLADELKLKPENRK
RIVFHEITKNAILKAIDNPRDIDQNLVNAQQARRV
LDRIVGFEMSPVLWKKVKPGLSAGRVQSVAVRLIV
EREKEIREFIPKASFKLDGIFLNKTEQEIAAKLKK
DFEKEEDAEKFLEQAKTTEFKVLNVETKPGTRSAS
APFTTSTLQQEASSRLGYNVTNTMRLAQRLYEEGY
ITYMRTDSVNLSQEAIEGAKKQIISEYGTEYSSPR
NYTTKSASAQEAHEAIRPTDFGVKSIGDAQLNKLY
QLIYRRTLASQMANAKIEKTVIEIGNTSLPHHFEA
QGEVIIFDGFLKAYGIVKTEDDDEENNDKLLPKVS
VGEVLSYKTITATEKFTRPSARYTEAGLVRKLEEL
GIGRPSTYAPTIQTIQNREYVDKREIEPQTREVIK MSLVKDKIKKVVLEEKFGGDKNKFVPTDIGEVVND
FLTDNFREILDYGFTARVEESFDEIASGDQKWKEM
MTNFYSKFHPRIEDVEENADRATGDRLLGVDPKTG
KNVHARIGRFGAMIQIGETDDEEKPIFASLMAGQN
IATITFEEALELFKLPFDLNTVDGQPVSVGVGRFG
PYVKWGETYISIPKGEDPLSVDQKRAEEIISEKKI
ADAPIATYKGEPVTKGSGRFGPFIKYKDIFVNVPK
RYDFENLSQSDINELIDAKLEKEANRYIQQWEKEK
ISIENGRWGPFIKFGKAMFKIPKKADDTKYEAEEL
KELSLDEVKKWITDQDPKAFAEKKKPAAKKATTTK
KTTAAKKPAAKKK >MKCIGJBJ_00500 DNA-directed RNA
polymerase subunit beta
SEQ ID NO: 3
MSKTKSTTQGNPRINFSSAKGKIITPDFLDIQIES
FREFFQLDTLPEARKTEALYKTFQENFPITDSRNQ
FVLEFLDYLVDSPRYSIDECVERGLTYSVPLKARL
KLYCTDPEHEDFQTVVQDVYLGPVPYMTPSGSFII
NGAERVIVTQLHRSPGVFFGQTYHANGTKLYYSRI
IPFKGSWMEFTTDINSVMYAYIDRKKKLPTTLLR
AIGYESDKDILQIFDLAEEVKVSKAALKKVEGRTL
AARVLNTWFEDFVDEDTGEVVSIERNEIILDRETI
LEKEHLDLILDAGVKSILIHKENSNEFSIIQNTLQ
KDPTNSEKEAVEYIYRQLRNADPPDEETARGIIEK
LFFSEQRYSLGEVGRYRLNKKLGLNIPTTTEVLTK
EDIIAIVRHLIELVNSKAEVDDIDHLSNRRIKTVG
EQLAGQFGVGLSRIARTIKERMNVRDNEIFTPLDL
VNAKTLTSVINSFFGTNQLSQFMDQTNPLSEITHK
RRLSALGPGGLSRERAGFEVRDVHHTHYGRICPIE
TPEGPNIGLISSLGIYAKINNLGFIETPYRKVEGG
KVDLNADPIYLNAEDEEAKVIAQANVELSDNGDFE
TDRIIARLDGDYPVVEPNQVDLIDVAPNQISGISA
SLIPFLEHDDANRALMGSNMMRQAVPLLKPQAPIV
GTGLEQQVARDSRILINAEGTGTVQYVDADKIVIK
YERSEDEDLVQFESATKTYNLTKFRKTNQSTTITL
RPNVRVGDVVEKGQVLCDGYATEKGELALGRNLVV
AFMPWKGYNFEDAIVINEKVVREDWFTSIHVDEYS
LEVRDTKLGMEELTADIPNVSEEATKDLDENGMIR
IGAEVKPGDIMIGKITPKGESDPTPEEKLLRAIFG
DKAGDVKDASLKADSSLRGVVINKKLFSRNIKDKK
KRTEEKLKLEEIENTYKAKFDELRNTLIEKLNTLV
SGKTSQGVHNDLDEEIIGKGVKFTHKLLTSVEDYV -continued

NVSGSDWTVDADKNELIKQLIHNYKIKYNDIQGVK

NREKFAISIGDELPAGIMKLAKVYIAKKRKLNVGD

KMAGRHGNKGIVSRIVREEDMPFLEDGTPVDIVLN

PLGVPSRMNIGQIYETVLGWAGQKLGMKFATPIFD

GATLDQITEYTDKAGLPKFGHTYLYDGGTGERFTQ

AATVGVIYMLKLGHMVDDKMHARSIGPYSLITQQP

LGGKAQFGGQRFGEMEVWALEAFGASNILREILTV

KSDDVIGRAKTYEAIAKGESMPEPGIPESFNVLLH

ELQGLGLDVRLEE

>MKCIGJBJ_00499 DNA-directed RNA polymerase subunit beta'
SEQ ID NO: 4
MSNKNKSSRFNKITIGLASPESILQDSRGEVLKPE

TINYRTHKPERDGLFCEKIFGPVKDYECACGKYKR

IRYKGIVCDRCGVEVTEKKVRRERIGHINLVVPIA

HIWYFRSLPNKIGYLLGIPSKKLDMIIYYERYVVI

QQGIAKKLDGSDFENMEFLTEEEYLDIMETLPVEN

QYLDDSDPNKFIARMGAEAVEDLLKRIDLDALSFD

LRHKAHNEGSKQRRTEALKRLNVVEALRGANTRMI

NRPEWMIMRVLPVIPPELRPLVPLDGGRFATSDLN

DLYRRVIIRNNRLKRLLEIKAPEVILRNEKRMLQE

SVDSLFDNTRKSSAVKSESNRPLKSLSDSLKGKQG

RFRQNLLGKRVDYSARSVIVVGPNLQLHECGIPKD

MAAELYKPFIIRKLIERGIVKTVKSAKRIIDRKEP

VVYDILENVMKGHPVLLNRAPTLHRLGIQAFQPKM

IEGKAIQLHPLVTTAFNADFDGDQMAVHLPLGPEA

ILEAQLLMLGSQNILNPANGSPITVPSQDMVLGLY

FMTKELSSTETMKVKGEGLAFYSPEEAEIAYAEGK

VSLNAKVRCKLPVKENGEIVTRLIETTVGRILFNQ

IVPKQVGYINELLTKKSLRNVIGKILADTDFPTTV

KFLDAMKDLGYSNAFKGGLSFSLGDIVVPVEKKQM

IAQSIETVDEIRANYNMGLITDTERYNQVIDVWTN

TNAGLTEMIMSRMKTDQGGFNSVYMMLDSGARGSK

EQIRQLSGMRGLMAKPQKAGSTGAEIIENPILANF

KEGLSILEYFISTHGARKGLADTALKTADAGYLTR

RLVDVAQDVIVTEDDCGTLRGTEVTALKKNDEIVE

KISERILGRVSLHNVYDPETDELITEADQVITEQL

AKRIEEAGLEAVEVRSPLTCEAKKGICAKCYGRNL

ATGKMIHMGEAVGVIAAQSIGEPGTQLTLRTFHQG

GTAGNVSENPSIVARRDGIVEMDEVRTITSEDENG

NTAEVVVSRSTEFRLVADNESRTPLMVANVPYGSI

LSVKPGDKVKKGDTICRWDPYNAVIIAETSGKVEY

EDIIQGISFQLEIDEQTGFEEKVISESRNKKAVPT

LKVVDSKGVEQKAYNLPVGAHLMVNDGEKIKAGKV

LIKIPRKSAKAGDITGGLPRVTELFEARNPSNPAV

VTEIDGVVSYGKIKRGNRELIVEAKTGERKIYLVK

LSNQILVQENDFVRAGSPLSDGSITPEDILRIKGP

TAVQEYLVNEIQEVYRLQGVKIDDKHFEIIVRQMM

TKVSIVDGGDTQFLEGALEHKYDFLEENNRVFGLK

VVVDAGDSKEFKPGQMITARELRDENSKLKREDLA

LVEVREALPATATPVLQGITRAALQTKSFMSAASF

QETTKVLNEAAVAGKIDDLNGLKENVIVGHRIPAG

TGLKEYQNVIVGSKKEFEDLN

>MKCIGJBJ_02095 DNA-directed RNA polymerase subunit alpha
SEQ ID NO: 5
MAILQFIKPDKVILLNSDEFKGQFEFRPLEPGFGL

TIGNALRRVLLSSLEGYAISSIKIEGVEHEFSTIP

GVIEDVTEIILNLKQVRLKAAAEGQANEQVVAKVS

GQTVITAGDLGKSINGFEVLNPDLVICNLNTDVTF

EITFNIEKGRGYVPSEQNKSNNAPVGTIAIDSIFT

PIKKVQYSIENYRVEQKTDYEKLVLDIETDGSISP

QNALTEASKILIYHFMLFSDERITLETEAVKASIQ

YDEETLHTRQLLKSKLADMDLSVRALNCLKAAEVE

TLGELVSYSKSDLMKFRNFGKKSLTELEELVHSKG

LNFGFDVAKYKLDADK

In certain embodiments, the *Chryseobacterium* strain can comprise at least one gene and/or nucleic acid comprising a sequence with at least 80%, 90%, 95%, 98%, 99%, 99.5%, 99.8%, 99.9%, or 100% sequence identity across the entire length of a sequence of:
16S_rRNA::NODE_21_length_5280_cov_261.657869: 97-1610(+) (SEQ ID NO: 78);
23S_rRNA::NODE_21_length_5280_cov_261.657869: 2222-4962(+) (SEQ ID NO: 79;
5S_rRNA::NODE_21_length_5280_cov_261.657869: 5140-5238(+) (SEQ ID NO: 80);
5S_rRNA::NODE_15_length_76839_cov_37.026828:6-85(+) (SEQ ID NO: 81); and/or
5S_rRNA::NODE_1_length_739711_cov_38.316888: 739626-739705(−) (SEQ ID NO: 82).

>16S_rRNA::NODE_21_length_5280_cov_261.657869:97-1610(+)
SEQ ID NO: 78
ATGGAGAGTTTGATCCTGGCTCAGGATGAACGCTA

GCGGGAGGCCTAACACATGCAAGCCGAGCGGTAGA

GATCTTTCGGATCTTGAGAGCGGCGTACGGGTGC

GGAACACGTGTGCAACCTGCCTTTATCAGGGGGAT

AGCCTTTCGAAAGGAAGATTAATACCCCATAATAT

ATTGAGTGGCATCACTTAATATTGAAAACTCCGGT

-continued

GGATAGAGATGGGCACGCGCAAGATTAGATAGTTG

GTGAGGTAACGGCTCACCAAGTCTGCGATCTTTAG

GGGGCCTGAGAGGGTGATCCCCCACACTGGTACTG

AGACACGGACCAGACTCCTACGGGAGGCAGCAGTG

AGGAATATTGGACAATGGGTGCGAGCCTGATCCAG

CCATCCCGCGTGAAGGACGACGGCCCTATGGGTTG

TAAACTTCTTTTGTATAGGGATAAACCTACTCTCG

TGAGAGTAGCTGAAGGTACTATACGAATAAGCACC

GGCTAACTCCGTGCCAGCAGCCGCGGTAATACGGA

GGGTGCAAGCGTTATCCGGATTTATTGGGTTTAAA

GGGTCCGTAGGCGGATCTGTAAGTCAGTGGTGAAA

TCTCACAGCTTAACTGTGAAACTGCCATTGATACT

GCAGGTCTTGAGTGTTGTTGAAGTAGCTGGAATAA

GTAGTGTAGCGGTGAAATGCATAGATATTACTTAG

AACACCAATTGCGAAGGCAGGTTACTAAGCAACAA

CTGACGCTGATGGACGAAAGCGTGGGGAGCGAACA

GGATTAGATACCCTGGTAGTCCACGCCGTAAACGA

TGCTAACTCGTTTTTGGGCTTTCGGGTTCAGAGAC

TAAGCGAAAGTGATAAGTTAGCCACCTGGGGAGTA

CGAACGCAAGTTTGAAACTCAAAGGAATTGACGGG

GGCCCGCACAAGCGGTGGATTATGTGGTTTAATTC

GATGATACGCGAGGAACCTTACCAAGGCTTAAATG

GGAAATGACAGGCTTAGAAATAGGCTTTTCTTCGG

ACATTTTTCAAGGTGCTGCATGGTTGTCGTCAGCT

CGTGCCGTGAGGTGTTAGGTTAAGTCCTGCAACGA

GCGCAACCCCTGTCACTAGTTGCCATCATTAAGTT

GGGGACTCTAGTGAGACTGCCTACGCAAGTAGAGA

GGAAGGTGGGGATGACGTCAAATCATCACGGCCCT

TACGCCTTGGGCCACACACGTAATACAATGGCCGG

TACAGAGGGCAGCTACACTGCGAAGTGATGCAAAT

CTCGAAAGCCGGTCTCAGTTCGGATTGGAGTCTGC

AACTCGACTCTATGAAGCTGGAATCGCTAGTAATC

GCGCATCAGCCATGGCGCGGTGAATACGTTCCCGG

GCCTTGTACACACCGCCCGTCAAGCCATGGAAGTC

TGGGGTACCTGAAGTCGGTGACCGTAACAGGAGCT

GCCTAGGGTAAAACAGGTAACTAGGGCTAAGTCGT

AACAAGGTAGCCGTACCGGAAGGTGCGGCTGGAAC

ATCTCATT

>23S_rRNA::NODE_21_length_5280_cov_
261.657869:2222-4962 ( +)
SEQ ID NO: 79

TCGTTAAGGGCGTATGGCGGATGCCTAGGCTTTCA

GAGGCGACGAAGGACGTGGTAAGCTGCGAAAAGCT

GCGGGGATTGGCACACACGAATTGATCCGCAGATA

TCCGAATGGGGCAACCCGGCATATTGAAGATATGT

CACCTCGTAAGAGGAGCAAACCCGGAGAACTGAAA

CATCTAAGTACCCGGAGGAAAAGAAATCGAAGAGA

TTCCGTAAGTAGTGGCGAGCGAAAGCGGATTAGCC

CAAAAGCTTTTATATGTTTAATAGAATGTTCTGGA

AAGAACAGCCATAGAGGGTGATAGCCCCGTATATG

AAAGGCATATTTGAGTGATAAATGAGTAGGGCGGG

ACACGTGAAATCCTGTCTGAATATGGGGGGACCAT

CCTCCAAGGCTAAATACTCCTGAAAGACCGATAGT

GAACAAGTACTGTGAAGGAAAGGTGAAAAGCACTT

CGAATAGAAGGGTGAAATAGAACCTGAAACCGTAC

GCCTACAAGCGGTCGGAGCAGCGTAATGCTGTGAC

GGCGTGCCTTTTGCATAATGAGCCTACGAGTTAAT

TTTACTAGCGAGGTTAAGGTATTAAGTACCGGAGC

CGAAGCGAAAGCGAGTCTGAATAGGGCGGTTAGTT

AGTAGGATTAGACGCGAAACCTTGTGATCTACCCA

TGGGCAGGTTGAAGCTCTGGTAACACAGAGTGGAG

GACCGAACCGGTTGACGTTGAAAAGTCTTCGGATG

ACCTGTGGGTAGGGGTGAAAGGCCAATCAAACTGG

GAGATAGCTCGTACTCTCCGAAATGCATTTAGGTG

CAGCGTCGATGTTAAGTTTATTAGAGGTAGAGCTA

CTGATTGGATGCGGGGGTTTCACCGCCTACCAATT

CCTGACAAACTCCGAATGCTAATAAATGTTCGTCG

GCAGTGAGGGCATGGGTGCTAAGGTCCATGTCCGA

GAGGGAAAGAACCCAGACCAACAGCTAAGGTCCCC

AAATATATGTTAAGTTGAAACAACGCGGTTGGACT

GCATTGACAGCTAGGATGTTGGCTTGGAAGCAGCC

ATTCATTTAAAGAGTGCGTAACAGCTCACTAGTCG

AGCGGTCCGGCATGGATAATAATCGGGCATAAACA

TATTACCGAAGCTATGGATTTATAATTATTATATC

TGGTAGGAGAGCATTCTATTTGCGCCGAAGCAGTA

CTGTGAGGTATTGTGGAGCGGATAGAAAAGAAAAT

GTAGGCATAAGTAACGATAAAGCAGGCGAGAAACC

TGCTCACCGAAAGACCAAGGCTTCCTCAGCCATGC

TAATCAGCTGAGGGTTAGTCGGGACCTAACGCGAA

CCCGAGAGGGGTAGTGGATGGACACAGGGTTAATA

```
TTCCCTGACTTGCTCACAATAAAAGGGGACGGTTG
GATGTATCTGCTGGAGACTGACGGAATAGTCAAGG
CCTAGCCTTCGGGCGAAGCTGCTGTAGAGTAATCT
GATCCAAGAAAAGCCGAAGTGAAGCAACCCGTACC
AAAACCGACACAGGTGGTCGAGGAGAGAATCCTAA
GGTGCTCGAGTGAGTCGTGGCTAAGGAACTAGGCA
AAATAGTCTCGTAACTTCGGAAGAAGAGACGCCAT
CAGCAATGGTGGCCGCAGTGAAGAGGCCCAGGCGA
CTGTTTATCAAAAACACAGGACTCTGCTAAATCGA
AAGATGCTGTATAGGGTCTGACACCTGCCCGGTGC
TGGAAGGTTAAGGAAGGTGCTTAGCGTAAGCGAAG
GCATTGACTGAAGCCCCAGTAAACGGCGGCCGTAA
CTATAACGGTCCTAAGGTAGCGAAATTCCTTGTCG
GGTAAGTTCCGACCTGCACGAATGGTGTAACGATC
TGGGCACTGTCTCAGCCACGAGCTCGGTGAAATTG
TAGTATCGGTGAAGATGCCGATTACCCGCAATGGG
ACGAAAAGACCCTGTGAACCTTTACTATAACTTCG
TATTGACTTTGAGTAAGTAATGTGTAGGATAGGTG
GGAGGCTTTGAAGCAGGCACGCTAGTGTTTGTGGA
GCCGACGTTGAAATACCACCCTTTACTTACTTGGA
GCCTAACTTCTTTCAGAAGGACATTGCGTGGTGGG
TAGTTTGACTGGGGTGGTCGCCTCCAAAAGAGTAA
CGGAGGCTTTCAAAGGTACCCTCAGCACGCTTGGT
AACCGTGCGTAGAGTGTAATGGCATAAGGGTGCTT
GACTGTGAGACCCACAAGTCGATCAGGTGCGAAAG
CAGGACATAGTGATCCGGTGGTTCCGTATGGAAGG
GCCATCGCTCATAGGATAAAAGGTACTCCGGGGAT

AACAGGCTAGTCTCCCCCAAGAGCTCACATCGACG
GGGAGGTTCGGCACCTCGATGTCGGCTCGTCACAT
CCTGGGGCTGGAGAAGGTCCCAAGGGTTGGGCTGT
TCGCCCATTAAAGTGGCACGCGAGCTGGGTTCAGA
ACGTCGTGAGACAGTTCGGTCTCTATCTATTGCGG
GCGTTAGATGTTTGAGAGGGCTTGATTCTAGTACG
AGAGGACCGAATTGAACAAACCTCTGGTGTATCAG
TTGTACCGCCAGGTGCACCGCTGAGTAGCTACGTT
TGGAAGAGATAAGCACTGAAAGCATATAAGTGCGA
AACTCGCCTCAAGATGAGACATCTTTTAAGGGTCG
TTGTAGATGACGACGTTGATAGGCTACAGGTGTAA
AGACAGTAATGTCATAGCCGAGTAGTACTAATTAC
CCGTAGATTT

>5S_rRNA::NODE_21_length_5280_cov_
261.657869:5140-5238 (+)
                                SEQ ID NO: 80
GTGGTTTTAGCGGTGGGGCTCACCTGTTCCCATTC
CGAACACAGAAGTTAAGCCCACCAGCGCCGATGGT
ACTGCTAACGCGGGAGAGTAGGCCGCCG >5S_rRNA::NODE_15_length_76839_cov_
37.026828:6-85(+)
                                SEQ ID NO: 81
TCACCTGTTCCCATTCCGAACACAGAAGTTAAGCC
CACCAGCGCCGATGGTACTGCTAACGCGGGAGAGT
AGGCCGCCG >5S_rRNA::NODE_1_length_739711_cov_
38.316888:739626-739705 (-)
                                SEQ ID NO: 82
TCACCTGTTCCCATTCCGAACACAGAAGTTAAGCC
CACCAGCGCCGATGGTACTGCTAACGCGGGAGAGT
AGGCCGCCG
```

SEQUENCE LISTING (1202 sequences)

SEQ ID NO: 1 - protein, 863 aa, Chryseobacterium sp.
MTTEEYSHEGESLKKVSGLYKDWFLDYASYVILDRAIPSIYDGLKPVQRRIMHSMRELEDGRYNKVANIVGNTMKYHPHGDASITDAMVQIGQKELLIDTQGNWGNIYTGDSAAAARYIEARLTPFALEVVFNPKTTEWTKSYDGRNNEPIDLPVKFPLLLAQGVEGIGVGLSTKILPHNFNELINASVAYLKGKKFELYPDFLTAGYLDVSEYNDGHRGGKVRARAKITQTDKHTLVISELPYSKTTTDLIDSILKANEKGKIKIKKIEDNTSDKVEILIHIHNDVSPDKTIDALYAFTDCQVTISPNACVIVGDKPMFMNVSEILKMNTDHTVSLLKKELEIELHELQESWHFSSLERIFIENRIYHDIEEVKTWEDVLKTIDAGLKPHTKHLLRAVTEEDILKLTEIRIKRISRFDLDKFKENIASLEGKIEQVKYNLENLIAYAIDYYLNIQKKYGKDKQRRTELRIFDTIDATKVAVANEKFYANFEEGFIGTSLKKDQYLFDCSDIDDIITFRKDGSMKVVKVEAKTFIGKDILHVAVWKKNDKRTVYNMIYREGREGPYYMKRFSVTGVTRNTDYPLASDKKGSETLYFSANPNGEAETVTVLLKPNPRIRKNKMEINFSDLAIKGRDSKGNLVTKYAVKKVDLKEEGVSTLAPRKIWFDDTVRRLNADARGTLLGSFKGDDKILTINTNGEVKLVSFDLGNRFDDEYLVLEKWKPEQPITCIYYDGEKDIYFIKRFLLENTVNVQTFMPSEHPKSFIENVIVANDATAEIIFAKDKGKEREPEVVNIDEFIAVKGIKAIGNQFTKFKVKAINITIPEPVEEEPEAYEDPEPTGDLDEDGGMIGDLFQDDGNNENE

SEQ ID NO: 2 - protein, 853 aa, Chryseobacterium sp.
MSKNLVIVESPAKAKTIQKYLGKDFEVKSSFGHIRDLPKKGMGIDLATFNPDYEVSADKKKLVTELKAAVKKADMVWLASDEDREGEAIAWHLADELKLKPENRKRIVFHEITKNAILKAIDNPRDIDQNLVNAQQARRVLDRIVGFEMSPVLWKKVKPGLSAGRVQSVAVRLIVEREKEIREFIPKASFKLDGIFLNKTEQEIAAKLKKDFEKEEDAEKFLEQAKTTEFKVLNVETKPGTRSASAPFTTSTLQQEASSRLGYNVTNTMRLAQRLYEEGYITYMRTDSVNLSQEAIEGAKKQIISEYGTEYSSPRNYTTKSASAQEAHEAIRPTDFGVKSIGDAQLNKLYQLIYRRTLASQMANAKIEKTVIEIGNTSLPHHFEAQGEVIIFDGFLKAYGIVKTEDDDEENNDKLLPKVSVGEVLSYKTITATEKFTRPSARYTEAGLVRKLEELGIGRPSTYAPTIQTIQNREYVDKREIEPQTREVIKMSLVKDKIKKVVLEEKFGGDKNKFVPTDIGEVVNDFLTDNFREILDYGFTARVEESFDEIASGDQKWKEMMTNFYSKFHPRIEDVEENADRATGDRLLGVDPKTGKNVHARIGRFGAMIQIGETDDEEKPIFASLMAGQNIATITFEEALELFKLPFDLNTVDGQPVSVGVGRFGPYVKWGETYISIPKGEDPLSVDQKRAEEIISEKKIADAPIATYKGEPVTKGSGRFGPFIKYKDIFVNVPKRYDFENLSQSDINELIDAKLEKEANRYIQQWEKEKISIENGRWGPFIKFGKAMFKIPKKADDTKYEAEELKELSLDEVKKWITDQDPKAFAEKKKPAAKKATTTKKTTAAKKPAAKKK

SEQ ID NO: 3 - protein, 1273 aa, Chryseobacterium sp.
MSKTKSTTQGNPRINFSSAKGKIITPDFLDIQIESFREFFQLDTLPEARKTEALYKTFQENFPITDSRNQFVLEFLDYLVDSPRYSIDECVERGLTYSVPLKARLKLYCTDPEHEDFQTVVQDVYLGPVPYMTPSGSFIINGAERVIVTQLHRSPGVFFGQTYHANGTKLYYSRIIPFKGSWMEFTTDINSVMYAYIDRKKKLPLTTLLRAIGYESDKDILQIFDLAEEVKVSKAALKKVEGRTLAARVLNTWFEDFVDEDTGEVVSIERNEIILDRETILEKEHLDLILDAGVKSILIHKENSNEFSIIQNTLQKDPTNSEKEAVEYIYRQLRNADPPDEETARGIIEKLFFSEQRYSLGEVGRYRLNKKLGLNIPTTTEVLTKEDIIAIVRHLIELVNSKAEVDDIDHLSNRRIKTVGEQLAGQFGVGLSRIARTIKERMNVRDNEIFTPLDLVNAKTLTSVINSFFGTNQLSQFMDQTNPLSEITHKRRLSALGPGGLSRERAGFEVRDVHHTHYGRICPIETPEGPNIGLISSLGIYAKINNLGFIETPYRKVEGGKVDLNADPIYLNAEDEEAKVIAQANVELSDNGDFETDRIIARLDGDYPVVEPNQVDLIDVAPNQISGISASLIPFLEHDDANRALMGSNMMRQAVPLLKPQAPIVGTGLEQQVARDSRILINAEGTGTVQYVDADKIVIKYERSEDEDLVQFESATKTYNLTKFRKTNQSTTITLRPNVRVGDVVEKGQVLCDGYATEKGELALGRNLVVAFMPWKGYNFEDAIVINEKVVREDWFTSIHVDEYSLEVRDTKLGMEELTADIPNVSEEATKDLDENGMIRIGAEVKPGDIMIGKITPKGESDPTPEEKLLRAIFGDKAGDVKDASLKADSSLRGVVINKKLFSRNIKDKKKRTEEKLKLEEIENTYKAKFDELRNTLIEKLNTLVSGKTSQGVHNDLDEEIIGKGVKFTHKLLTSVEDYVNVSGSDWTVDADKNELIKQLIHNYKIKYNDIQGVKNREKFAISIGDELPAGIMKLAKVYIAKKRKLNVGDKMAGRHGNKGIVSRIVREEDMPFLEDGTPVDIVLNPLGVPSRMNIGQIYETVLGWAGQKLGMKFATPIFDGATLDQITEYTDKAGLPKFGHTYLYDGGTGERFTQAATVGVIYMLKLGHMVDDKMHARSIGPYSLITQQPLGGKAQFGGQRFGEMEVWALEAFGASNILREILTVKSDDVIGRAKTYEAIAKGESMPEPGIPESFNVLLHELQGLGLDVRLEE

SEQ ID NO: 4 - protein, 1421 aa, Chryseobacterium sp.
MSNKNKSSRFNKITIGLASPESILQDSRGEVLKPETINYRTHKPERDGLFCEKIFGPVKDYECACGKYKRIRYKGIVCDRCGVEVTEKKVRRERIGHINLVVPIAHIWYFRSLPNKIGYLLGIPSKKLDMIIYYERYVVIQQGIAKKLDGSDFENMEFLTEEEYLDIMETLPVENQYLDDSDPNKFIARMGAEAVEDLLKRIDLDALSFDLRHKAHNEGSKQRRTEALKRLNVVEALRGANTRMINRPEWMIMRVLPVIPPELRPLVPLDGGRFATSDLNDLYRRVIIRNNRLKRLLEIKAPEVILRNEKRMLQESVDSLFDNTRKSSAVKSESNRPLKSLSDSLKGKQGRFRQNLLGKRVDYSARSVIVVGPNLQLHECGIPKDMAAELYKPFIIRKLIERGIVKTVKSAKRIIDRKEPVVYDILENVMKGHPVLLNRAPTLHRLGIQAFQPKMIEGKAIQLHPLVTTAFNADFDGDQMAVHLPLGPEAILEAQLLMLGSQNILNPANGSPITVPSQDMVLGLYFMTKELSSTETMKVKGEGLAFYSPEEAEIAYAEGKVSLNAKVRCKLPVKENGEIVTRLIETTVGRILFNQIVPKQVGYINELLTKKSLRNVIGKILADTDFPTTVKFLDAMKDLGYSNAFKGGLSFSLGDIVVPVEKKQMIAQSIETVDEIRANYNMGLITDTERYNQVIDVWTNTNAGLTEMIMSRMKTDQGGFNSVYMMLDSGARGSKEQIRQLSGMRGLMAKPQKAGSTGAEIIENPILANFKEGLSILEYFISTHGARKGLADTALKTADAGYLTRRLVDVAQDVIVTEDDCGTLRGTEVTALKKNDEIVEKISERILGRVSLHNVYDPETDELITEADQVITEQLAKRIEEAGLEAVEVRSPLTCEAKKGICAKCYGRNLATGKMIHMGEAVGVIAAQSIGEPGTQLTLRTFHQGGTAGNVSENPSIVARRDGIVEMDEVRTITSEDENGNTAEVVVSRSTEFRLVADNESRTPLMVANVPYGSILSVKPGDKVKKGDTICRWDPYNAVIIAETSGKVEYEDIIQGISFQLEIDEQTGFEEKVISESRNKKAVPTLKVVDSKGVEQKAYNLPVGAHLMVNDGEKIKAGKVLIKIPRKSAKAGDITGGLPRVTELFEARNPSNPAVVTEIDGVVSYGKIKRGNRELIVEAKTGERKIYLVKLSNQILVQENDFVRAGSPLSDGSITPEDILRIKGPTAVQEYLVNEIQEVYRLQGVKIDDKHFEIIVRQMMTKVSIVDGGDTQFLEGALEHKYDFLEENNRVFGLKVVVDAGDSKEFKPGQMITARELRDENSKLKREDLALVEVREALPATATPVLQGITRAALQTKSFMSAASFQETTKVLNEAAVAGKIDDLNGLKENVIVGHRIPAGTGLKEYQNVIVGSKKEFEDLN

SEQ ID NO: 5 - protein, 331 aa, Chryseobacterium sp.
MAILQFIKPDKVILLNSDEFKGQFEFRPLEPGFGLTIGNALRRVLLSSLEGYAISSIKIEGVEHEFSTIPGVIEDVTEIILNLKQVRLKAAAEGQANEQVVAKVSGQTVITAGDLGKSINGFEVLNPDLVICNLNTDVTFEITFNIEKGRGYVPSEQNKSNNAPVGTIAIDSIFTPIKKVQYSIENYRVEQKTDYEKLVLDIETDGSISPQNALTEASKILIYHFMLFSDERITLETEAVKASIQYDEETLHTRQLLKSKLADMDLSVRALNCLKAAEVETLGELVSYSKSDLMKFRNFGKKSLTELEELVHSKGLNFGFDVAKYKLDADK

SEQ ID NO: 6 - DNA, 98946 bp, Chryseobacterium sp.
tctaattcacgattcacttgcgaagcaaaattcacttattgactgtgaaattgtgaatggtcaatcgtcaatacactgcgcttgtcaattcttttatgctataaagaattcacgattcacttgcgaaacaaaattcacttattgagacttctcccctatttctccggcatcactttataagtcgggtcttcctgaatattaatttctactacagcttctgcatttttcagtattttccggcagtcttcactgagatgacgcagatgcaaggttttattctgttgtttgtaacgtctggataacttgtccagtgcatctatagcactcatatctacaatgcggctttctttaaaatccacaaccacttgttcaggatcactcaaaggatcaaatttatctgtaaatgccgttactgacccaaagaacagtggtccgtatatttcgtaaaattttactccattttcatcaatatactttcttgcgcggattcttttggcattatcccaggcaaaaaccaatgcggaaatgattactccaaccaaaacagccaaagccaggttatgtaaaattaccgtaatcaatgctacagtaactccaacgaagatatcagacttcggcattttattcacaatcctgatagatacccattggaatgtactgatggcaaccatcatcatcactccgaccaaagcagccataggaattttctctatcacaggagctccaaccagaatgattatcaaaataagcacagatgccacaattcctgataatcttgctctggaacctgcattcagatttaccaaagtctgtgctaccattgcacagcctcccattccgccaaagaaaccattggtaatattcgccaatccctgtgccactgattctttgttggcgcttccctttgtattggtaatttcatccaccatggatagtgtcagaagagattctataagacctactcctgccataatcaaggcataaggaaaaataatctgtaaagtttccagggaaaaaggaatcttgggaatatgaaaacccggaagattcccactgatatgggcaatatctgcaactgtttttgttggaatattaaatccaagaacaacagcaaatacaatgataatagctacgagagaagcaggaacaacttttgtaattttgggaaagaaataaacgatggcaatcgtcagggcagtcaaacaacccattatatatagaggcatcccttgcaaccagcttacagctccgctgctgtctgttattttaaactgttcaacctgtgccataaaaataataatagctaatccattcagaaacccgtacataacaggctgtgggataagtctcacaaattttcccagcttaaagatccctaccatcatttgaaatatcccggctaatgcaactgtagcaaagagatattctactccatgcgattttatcaaagcaatcaacaccacgatggttgctccggctccaccggaaaccataccgggacgccctcctaaaactgcagtcacaagtcccatcataaaagctgcatacaaacctgtaagaggagacaggccggcaagaatagcaaatgaaagagattcaggaatcatcgtcattgctacagtaaaacctgccagcagttcatttttataattgattttttttgaaaaatcgaataagcttagtgtattcttcattgatatgcaaaggtatgtactgtgcggatggtatacaattttttctttttatgattttatgataaggaagttattgttttaaataattcacacatcagcccttataatatgttaattttaattaaaataaatagataaagtgtaatttttgtatttatgactgtttttacattttatttttgtctacatttgaaagcaaataagcaattatttggtactaattaaagattcaatgtgtataaagctgcttatcaatctatctgcagctttcactcaaagaattgtgtaaaaaccttaataggttatatattatttcacacaaatggcaggaaaaagaagtttgaaaagaagaagaaaaccattgaaaagaatatatcaatacattaaggtaattcctacctacctgttttattgatagttaaaagtcattttctaagatagatagttttattgaatatttttaactattcttcaaacataatttttatttcttataaatttcaaattttcagtaacaatttcctactatataaataatataaatcacctattctcgtttttttatatataagtttaaataaaagaataatattcaagtaaaaatgttatataaagaaatccatattgggaaatttattaaggaaagggttgatgaaattgaaatagcaattgagagaatctgcaagtttttaaacaaagatgaagaaacggttgaaatgatgtatgaaagcagatcaatggatacggatcttcttttaagatggagtaagttgctggaatatgattttttcaggctctacagctcccatttgattttatatgcaccaccctctgccgttaataaaagcaatcaaaagtccgagaaaacaccttatttcaggaaaaatatttatactcaggaaatcaaagacttcattatgaaaaggattctttccggtgaaatgacccaaagcgaggtcattaaagagtattctattcctaaaagtacactgcacagatggcttcagaagagtgataatgtaaacggataaacatataagacatgcgcccaaattacaaaagaatttatcaggatatgctgaagatggaatatcctgaaaagctgaaagatccaaaaatcaaggaacttcttgaaaagcttaacacgagtgaggatgtccttaagtttaatgaaaaactgttcaagcagtccagagaaaatcaaaaactcaaaacctatgacagacagactatgctaaaactgcttcagtaccagaaaaagcatgggcattccacaagctatatgtcgagaaaatataaaataagcagaacaacgctttcaaaatggaaagtcatgtttgaagaagagcttgaagacacaatgaaaaatgccggtaaataattcaccggcaattttttaaaggtaatagtaaggaaaaaacgggctgtacgtatgccggagtcgaaccggataaccttgccggaatgaccggcttcgctattcctcccaattgtggtacgaagaactttttcctgacgacacttcaaacgggtcatataaagaagctggaagtggaaagaagaaaaatggcaagtctgagattcctccgacttaatagaaaattatgatacaaagatctttcaacgttccacttccggcttctaatatgatgaaagcaaggcaataagcaaaaaatgcagtcgtgctctaaccagctgagctactcttcctatatagactgtgtttttttgttgtggaagagacgggattcgaacccgtgaccccgtcgtaatgagcgaagtaacatttttctacggcacttgtttgtttttaaaataaaaaagaggctagattcgaaaagacttgtacaagatcattttcatgaccttctggagtcgaaccaaattaaaccgaagtaggccttttctacggcactctttatgcaaatcaaggtaatatttttcagaatcttccgtgcatttgctctacccgctgagctacctctccttttcgagggaaaaggcaggattcgaacctgcgacccaatgtttactcaatctcgaagtatgattctaagacgacacttgatttttatttttattcatagttattagtttttctttttacgaaattatgtcatattttcatagttgtcattgatggaaattctgaccttttattatcttttcattgatgtgatttaaataaaagaggctagattcaaaaagactttgacaagaacactttcgtgatctgttatggagtcgaaccaatattataccgaagtaagccttttctacggcactcttttatagtatcagggcaaaacggcggaatcttttctttttctcctgctctatcttttgagctacattccgtttacaacaggaatggcaggaattgaacctacatctgaagacttaactcgaagtatgactccaaaacggcacctgatttaatttttccatcggttttttctatatttcttccagtttctctggaactttgtatactttgcattcactacttcataaccgtgtggaaaacagaatgagcatcccatttcatttccacacatcaatctttaaatctgtgttccggaaattttctttggaaagtcaatgagtccatattcattgaatccaaatttttgtcttaatggtgtattttttttcataagtattgagtattaacctcaatacaatgcttcttttaaattggatttataatttttcatagttattagtttttctttttacaaaattatatcgctactgcgcaatctttttacgtagttatttttttattaaaccaagtaacaatgtataagagtttttgattctagtcaaattaaaagtttgatgatggaactcttatgaacgacattggtttactaccgggcaatctcttgaaagactctttcagtttggaatcgaagcaggtctttctaacggcaccgatattattaacattgcaaaattatatgataagtacgcaatctttttacgtaatttgattttattgagaaaataatgatgaaattatttcaaaaagtttaataattcctaatacaggaagtaaaataataaatccaatcaataaaaagattccaatcttgcttagaaaacctgtatgatgttcctgaaacttttctttttctctcgttttagctttaaaaacagggatttgcttggtcgctttgaagctatcttgctcaagctctatgattactttctttgcatgctcatcaagcaaatctttatctcctctgaaaacaatatcttttaaaattgcatttcctgaattgcttaaagactctctgtaaatctctactgctgcttccatttcattattctctggtttagacaacatccagaatttacctgcttcgtcaagaaatcctgcttcaaaataaatctgccctaacttttttctcaaggaaagatcattaggaaactgattgatcatatttcttaatctgtcgcatgcctttttctttctgcctgccttaagatcttgttcaattctgtacaataaattccccatcgttttttacgcagttttattttttatttaatatttgttcgttttgccttgaagcaaaagaaccaaaagttcaagacctggaaactccgactaaaaataacctacactcactaaaaattctaaaacttgcgcgaatgttatattagttcttcgtttcactttctgtgtcgcgcttcaaacaatagaattttcttaacgttcgtatagcttattttcctaacgcctccgtttcctatgtcgcatttctgtcccgctttatttaaaagcagtgccttttacagcactactttatgaatcatttctacagctgactttttatcttccaatgcgttcagcacatcgaaaattttatctgaccagcctgcaataagatgtacatcattttttctgatatcaatcggctgtctgccataacctgccaggtcaaaaatatacagttttgcatgaggagttatagccttgtatttgtcccacagatcatcaaaagagtttctgcttccagtactatcccacatttgggtatcggtgaataacattactttgttcactttttcacctcttttaatcagatcctcaatcactttgtagccattggtagcatatcctacttcaccttcacgtttgtagaaagcgtctacatttcttaaaataccgtttttaggcattggaactctcagccaacggtcaccgaaaatacctgtcacaacatttttacactgtgactgaagaatcatcgacattagcaagccaatatcatacagcagtattttgcttttatgagaaaccggtttctgcatagagcctgagacatctgcagcaattaccactgaagtatcaaaaccaaaacctttaatgtttttagcactcaccacaacagcttcttccagtgcctccaatacggatgacagataaggagaatctatagttttcaattctctgtaagccgccagaaatctgaacggaagctgttttgaattggagactgctctttcatcagaaagatatttacagactttattcattgcatcagcagacactccggcatccagaatatttctcaggtttcgcatggttgccatataacctaatttattactgaaaatcagttcttcccatttgtttttgaaagcaagctttctttctgcatcatcagcaaattttgtctgtcccagaacagaaagttccacttcccaggtataaggagtttctaatgtattatttgcaattttgttgaagaccatttgctggttttcgtcttttgctttcgggtgaaccagaaaaagcgcgtctttcagggttacctctgctttcctgttgtattttgcaaactggtattcatcaaacttgttgaatgatttcaccagacctttctgaatctgcttggatagtttgtttagttttttagtttctgtccttttattggcaagttgataataagccagcaattctgtgatttcatcagctctctgaatgactccatctactgttttgctcaccagatctgttccggaagtctgttttgccaattcggtagttagaaccaaaggaatggaacgcagatacatatctttccttgcgtacaccgccagttttgccacaaattcaggattattttttttgatcagagaccggattctctccaatctgtcatttcccttttcatagttggcatccgacagtcctgttgtaacaacagcactatacaattcttctgcaggtgtcatagcatatgcttttgcaccctcgtagttcagtactactttattttctttttttaaaaaattaaatttcatggttactgttttaatttgttaaacatggagaaggatcgatagttcctccctgatttctgatgcaaagtaaaaacagtattacgcaatctttttgcgtagcaaatttttctttgttttttattttttaacttaagcagttccaaataaatctctccgtatctacagatcttagttttgggtaaagccggatgaatcatgctgtttataagtcggtctaatagattttttcttaccgctgatgtgactgatttatacagatgtttgagaaatacaactcattcatcattcatcattcatcattcatcattcattattcattattcatcattggtcatttacaatcataaaatccttctatcattgaatttcattaaagaaatcgtttacatcattttttttatgcacggttgtctagctttgtcttattaaaattaaagctatgattaaaggactatatgaaacccatgttcaggtgagtgatctggaaaatgcaatacagttttatactgaagtattaggactaaagttggctcacagagacgaaacaagacctattgctttcctatgggttggagaaggaaaagaattcatgttgggattatgggagcagaaggaaaaccttcaaaccagacattttgctttctccagcagtaaggaggatattttaaattactcagtggagtttttagaaaataaaaacttaaaaccatataatttcctgaaaaacggcagtgttaagcctatggtatttgcatggatgcccgcactggctatctactttaatgactcggacggaaaccagcttgaatttatttctatccttgaaggagaaagtaaacctgaattaggagtgcttagctatgatgaatggatgaagcagacaaacaaattatagcagaattccttcagattagataaaaagagacgcaagaaccggtcaaagtttaacaaaacctggtttttgcgtctttgtattttcagtaacaagatatgtatcaaaaatcttattattttttcagaaggagattacagatttttttcaaactggagttttctttccaactgttaattttctctgttatcttgtgatgaacttgcgaatggttgagtgcaagaacttcatgatagatttccagaatttttttcagattggtgactggtctatccatttgaatcaatatattgaaaatcagctcttccaatgcaatattatgatttttactgacattcagcatatgatgctgaataacatctgttaatcttttaacgggtgcccactccaatctttcgtgcagcccgatcacccttcctaaacgggcattatccattatttggccagacacatgttccagccacatatgggccgccgtttcacggatggttttatcactgtcaaggaaaatagttcccaggaacagatacccgatttcatccagcggttttttggtctgataaagtgcattggctgtattcagtaccagacttctttcataaacttcagcaattcctgaatagaaaaggcagtgtttcattacttttaccagagcgtttgccggagtattcggaaaacacagcatcagggcaggtatttcattaagttctttctgttctgccacaaagtattccataaacaagggatctttccttttttcaagatggtattttggaatggtaatgttaagttccgcgggataataagaatttttcctgctgtcaatagttctccacttgtattctcctgaaaggaattctacaggaatattgtcatatccaaaactgctgaatttttcaaatacagtttccggtgaacgtgtaatccccgctgtcatccaccatgaaggatgtttacattcaccttcaggttcagcatttttgccaaagaagaaaagtaataagtctttatattcccctttcagtcttttctccacttctatgatagcttctgaagtattgtctaaagcacaacgctgcaatgccagctgaatatcaagatgattcggttcaataccggcattctgatacgcctccaacctttccaccagtgtaaaaggtgagatccagcatggcgtatgggtaatgggaaacaacagaggaatattgtttccggttttaattttttgaaagacatagatcgcaatctctttaaatgcgcttctggcaggacaatctgctcctacattttctattggccccagttttttctgatagtttaaataagactctctttcagcttcttcttcttgtgtcttccggtagattttttccagatttttaagctgaacaggatattgctcaagcagctctaaaccataattgataatggcattgcacaataagacattcagaaagggaacctcccacttagaaattgtcttacaggctttcagaaatacaggttctaccaatttcaccgaaccggcatcaacatcgccagcgaaacgtataaatcctgccagagcaacatcacaatgatggctgtatgggtcatccatagccaaaggcagataaagcatcagatcttcaaaattctcaaggactttgactgcattttcgggtgttgtcaaatataatttttccgaagctatcacctccagctgcggttgtttctgttcaatatattttgacaaaagaggacgtatatttgtcagtatattatcggaataatgagaaagtgcctcaatcatattttcggaaacaggaatgtatttcaggataatcttagctgcctttgactgtatgccattgtctttacttacaaatgccgtacataaagccattcccagcagttccgggtttatttttcttctctggaatattttttcagtaagccctaagcttgaaacgactactgttttcacttctgtgctcaggagattcggaaggtaatgcgaaaattcctcacttttgaaatcagcaattcctgcaatttttttaagatgtgataagatagtattcaccgctttcgactgggaagatgtcaggccagcaagcaattcttcctgcagatcagacaattcttcttccgttggctttaaggaagtaaatgcatccataaaccagcctgtcacatttttattaaaatttctgttggaggccagaagacattctctcagaaatctttttctatcaatttttttgtctgcaatgagcttctgaacaataggaaaccattctttacgaaaaggtaaggatttggaaggatatttacacagataccagaaatgggtattcagggtttcaggataatgatcaagatcggccggataattgctcaggtggtgtcccagcaattgaggtttcggttgtacatagcctttttctgtccatcctaaaatatctttgtaattaaatgcggtaaagtcagcttctacagattcgttgataaagtctgaaaaccattcgggacagccccactccaaaatctgttcggtctgttctgcattccggaaaagactccagtaatttttaccgaaattttttttatccatgcagacaaatgaagcaatatcaataatagagtgctgattgacagatcctgcggtgtggtaagagtttttagtcattacgatcttgctgatctcccggtccattttctttatagacggcaccagtgtttttctttcctcaatgctaagctgcttcagaaaagggataatctcatgtattttttcctcattaaggatctcataaagtctttctttcatgtgctttcaatttgatatatagttgttttcaggttatttgttatccattaaagtttcaaagctatgccacaagttcccgtcttaagtttcgattcatttatgcatcaaaagacgtatactttttacagggtatgatgtcatatctgaaatgttttgttgcaaacggagcccgaaaaaaggtacccaatatatgaacctgatcaaatcacgatgataaacatcctgataagatcatcttttgattccgttctttattgatatatttttttaaaagagcagtatcttcttttttattttttgaaagtttttttaaaaacagcacaatctcatttattttgcagtttaaaaattttgtcctgaaatctccttcaataagcatagattcattcttatcagctaaattaaaaaatattggctgacagacagtaaattatcccttaaaagtgacttttttaacaaaatattaagttaataaaacggctgttataatatatttgattacataaaaataattctctgtttaaagatataatgataaaaaattggttaaaagccctgtactttgatatttacacaacatttggtgtcttaattttaaaaattatacagtcacaacataaaatcatttacctacacggatacgttaattttttctaaaatattaaaacatgcattgtaattcattaaatttaatatatttgcaaaataaaatacttgacaaatcaaatacttttcaatgataagcaatgaattattatttttaatcaaccttaataaactgcaatctgtaattgccagaaggtttgattctctgggtgctcatggtttgggactcaatgactttgttatactttatcttctcagttcttctcctcagggtaagatgcggaggatagatcttgccgaaaaaaccggacttacggcatctggagtgacccgtttattgaatcctcttgaaaaaatcggcttagtggcaagggaagccaacgaaagagatgcccgcgtcagctatgttgtaattacaactaatggtaaaaagatatttgaagaagctacaataagcgccgaatatattacaaaagaaatccttccttcccgaaagagtaaatctttaaaaacagtaaatgaatttttatttgatcttggaggaaatatacaataatcatcaatgaaaaatgcagcaaaaaaacagctaagggaaaaagcaaaacactataaaacaacgatgggggttcttgcggttaccaatactacaaatgggaaacagtatatccagggatccttacatcttgaagctttggtgaataaaatgaaattccttttaaatggcggaatgttcacaaatcctcagctacaaagggaatggacagaattgggaagtgaagcctttatctttgaatttgtcatgattgttcctgatcagaacaatgaatatatcaactatcgtaaggagatacagaaagcggaagaagcttatatttccgggtccgatgcacaattatactagcaatatgtcagaaaaatacttgtcaccaacttttgaagccggaaagcatctgttcatgaaaaatatacaaggggcagtcattaatctgaatctgattaaactgaagaaagaagcagattattcagcacatccggacctgaagcctgatgaaaagatcagtggatgggatgcttattttacttatatcagggaaaccgagccatttttaaaggaaagtggcggcgaaattttgtttattgggaaaggagatatgtttctgataggtcctgaaaatgagtattgggatctttgcatgctgatcagacagaaaagtgtaaatgattttttcagttttgaacagaatgaagcgtatatgaaaattatgggacacagaatggccgctattgaagattcgagacttttaccgctggaagaaataccgttgaatggaaaaagaaattaaaatggagatagtcagaattggtgaagcagacctttgttatgagatctttggtgagaaaaatacagaaaatataatcctgatttccggattaggaagtcagatgattcgttgggatattgctttctgtaatattctggttgaaaaaggattcagggtgattcgttttgataacagggattcgggatgttctgtatataacgcaaagcgggaaattcctgcaaataaaagtattgaagaggtttttgatgttctcagtaaagaaggtattccttattcattaatggatatggccaatgatgtgatcgggctgcttgattatttaaagattgaaaaagctcatattgcaggccgttccatgggtggaattattgcacagcttttaggttcaaattatcccgaaagagttttgtcattaaccattatcatgtcaacatctttaaacccttctcttcctaagacggaccctgaaattatggcgatgatgacccagcctgctgctgatccaaatgttgacagggaaggatatttaaaagcaaaaatacattttgcagaaaaaatatcgggacaaggatatctgtttgatccggatcaggaaaaagaattgcttgaagaagagcttatccgttcaagaacaaaaaacggcatcatccggcaactattggcgatgggttcttttcaatataattctgacctattgaaaaagataactgctccaaccatgattattcacggaacagatgatctgatctttcaccctgattgcggaaaagatattgcggattctatttcagattctgaatggattctgataaatggtatgggacattctattcctgtggaactttatgattctatcagtaataaaatatatggtttaacaaaataaaagactgcctcattatttgagacagtctcatttgcaaatctattctattcagagttaataattcttcaggcaccaatgcagaatttttgcaatattctttgcatcatctactcctctgtggtgtgtaccttccaatgtaaagcccaattctcccaaagccctttgcattcctacactttttctgatagtagggtgaatttcaccgaataatgtcttcacattgatgtggtcatcactcatcggataatcggtggaaaatctccttgcctgattctgaagcatattcagatcataatttccataactggcccatgtaagcgcttccgaatcatactctgctctcaggatatcgaaggcatcatccagcataattccttcatgatccagcatactttgggtaatggtggtcagctcggtgcagaacgggcttacttttgaatgctgtggttttattaaaattccttcacttttggagatctttccggtttttgcattcatgatacacacaccgatttcgatgatctcactttcctgacctcttggcggacggttttcccaacacgttgcttcaaggtctactattactatattttctgttgttttcacttgtttataatttaattgttaaaagatggaagatgagagtcttacaccgtgttatctgcttccggatttagtttaatttccaatcacctcggagcaaatggagccacccattttttctttttcatcaattctttgacttccccgtaggaaaccggataaaaattgtgacagtctaccccaacgtcaaaactcagagctttctcatcatccggtaatgttccgtgtgaatggccgtatagttgccataccccgcggtgtgagccattccaggtgcgcatggcgtagtggaaaagaataattttctgctttccattactgttatccggttcatcaattttcagttcatggtaatctctgatagaagcaaatcgtttgggatacgttaaagcggctccttcatgattacctttaatcaaatggatattgccatgtaattgatccaaaatttcttttgtaaaatccggttttcctaaactcatatctcctaaatggtacaccgtatcaccgggttcaactttctcgttccacctttttatgagttcttcattcatatggtccagtgattcaaaaggtctctctgaaaattttataatattctcatgaccaaaatgatggtctgctgtaaaaaatatattgggtttcatttttttaattgtttgtttaactacaaaaattttcaacgttttgcggtcattctgaatagagactgaaagtctgtgaaagcagttcattgtggtataaagaatctctttcactttaaacatatttttccctcatcagaaatcgtagattcgacgtaatcaatgacacattcaatgtttaacttcgtagtttagtctataaatattttaattaattcttacgaaatgctttataaaaggcagtttcaatttcttcctgatcgctttccgtatatcttcttgagaaatggatcggaacggcttctttcacctgacagtcattcatgattttccccgacgcagaagcaaaactgtgatggttaaccttagcaaattcctgatctgtatttttataaaagctttctatatataccagatctgcctctccaaatacagcttgtatttttttgtaattgttatcatctgccgcatgatccataatgacaccaagcttatatccctcatttcgggttaacagatgaaacagatctactgctttacagatgactccttcaatttcgatttctttttcaccatcattattttcaaaggcattcttcagcgcactgatccattttccttttctgaatccggaagcattttcattaaaggtcactgaatctttttctttaaacagataggcaatagaatctgttttgtgatcaagaatagcaaagtcaacattcacatattcgtcctcaaagaggaaatgctgagtttttacaaattccagtttccattgtggcggacgaagggtgtagacattaatttcttcttttgaaacaatctcacggatttcatatacgattgcgttttcatcaatcagattccatgtgtaagattttaatcttgcttccacctgtaaatgaatattttttggtcctgcaatcactactttttccccacttccgatctgatgcctgaatatcccgtcaaaatttgaaaagtgatcaatatgggtatggctgatgaatactgcggataaggactgcacttccttcacagtcagcaagctggcttccccacaatcacacaaataatgttttcctgaattcggaactttaattaatatactgatgtcttcctttaaaagactttttatttctgcctgtaacatggttttttcttttttaaaccaccccgtcaaattctttgaattccccccctccaaaggatgggaattgtcacactttcatagtattatttctctttatgaaatgaggtgttttcgttcttctgactttgatggttacgtttatacataaaaaagtttcggtaaaatgaattaccgaaactacactttaagagtcatcaactcttcttttataaaatcaatcacaaaagaattcaactttttgttgatccttttctgttcctctttttcaatgctggtgaaagccaccggaaagtctttctcgaagtcctccaaaatatcctgagcaaaaaggccaatcactttccctataattttggactcgaattcgccaatcttactcacaacattattcagcctgttgactgtaacatatttttggatttcttcccatatttcctgcgccttttcactgaaatgaacctgtttacgaacagttttcgcctgttttttaaccattttggatttttcgatccatttctcattcttgtttttcagaatgactcttgcgccgtttccaaaatatctggttttcaaagttttcacaatggtaccttcacacatattgtcttctaaatcaggtagtccaagccaggctggaatgtatgaattaaaagcattgggaaatttcaaagcttcttccagagttccctgaaacagggttttagcatagaaaaatcctgtctcatcaaaaatctgattgacaacttctgtatccatataggtaattccattcaacttgatatcgaaagcgtaaaattcgttgtaaggggcatactcaatgcctttctgcactttcactgcatcttttacaggctctacctctttatgtttgtagccaccaccgaacaattcaccgtagattaccacagtttctacatccgggcgcatggtcctcactttttgaaatactgccattacattttttctgtagcgttccaacatctgatgggcattgaaaaatttctcacctttttcgatgaaagcagttctcttcgcgattttaatttcctttccgtcggtaaagaaagagaaattagcgccgtgaactttttcctgtactatgaaaacctcatccccaaacccctgcattctgatctgttcgatcacgcgggcctggtaagcattttctatagaattatatgttttgaaaatcattttgttttagtttttaatcgtttctgattcgtttttcttcatctgggtaacgtgtctttgggcatggagtgagagaaaataaatatattcatacacattaattttcccaagtccattcactgtcattgtagttttatacaaaagtccttctccatttttcattacttccagatattgtaaacactgcagatattgctggttgattaaatttcttattttacccaagcataattctcctttcggttccatatgttccggtcttatccattcaaaagcgccatattctcctactttatcaaatttttctttattgaaaatgtagttttcaatttcaatttgcagatcaagatccagagaattcttcattgctttttttgagcctttctcaataaggataagcagataaaaattcgtaagataaatatgctctaaaatctgctgaatcgtccaacctccgtttgaaggctgatgattcaacgtttctttatccttttcaaaccatccgtctacctcatcaaatgttagtttcagatgtatttttatatctttgataaatctaaaaatgtccattacaattctttaaagttttgcagcaggtttaaaatattttcttttcctaccggattcatagagtgacaataaaattctggcaaatcaaggtaattgtccatacaatattctatcagccatttggcacagtcataacctgttttttcaacaaattcctgagaatcctgtttcagataatgttcatcagccaggtcatggtcaaaagagatcatttccggaagtcctttttccaatatcctgttaacaaactgctcgtaattccgcacaatatgccagtcgtttctgaggaaaataacctgtttcgtataatgataagcctcgatcggatatcttatatcatccagaaataataatctttttgttttttccatgatttatttttaaacttcaacccttcctacatcattcttccagctttattacaccatcatatcagcacagttggaacttgcaaaagcgtaaggctttgccttgaacacatatcccattcccagaatatatcccatggcatcttttaatgctacattggatttgaaatccgggtcggtattaatgtctgcgtgtacctccatttccacaccataagcatccagcacagagcagatcgcgtatgcaatttcaacggatttgttgacttcattcagcattcgctccttgatactaatactctgtatttctctttctttcctgataaaggtaaacgctccttttccctcacgaataaacactactgccgtagcataactgatggcatctccgtatacatgagagtctgatcccacacatactttcagacggtgtccgttggcctgttcgcgaatgatggcttcttctaccagctgtgtgatagagtgttggaaaatttttccattcatattctgccatgtttgttgttgcgtttccattttttctacatttttaattcataaatgattgttgataattgataaatgattactagcagtcctattttttaactctagtttctactttctatttttgcactccgaaccggacccgaaccgataccatcagttttggagactgagatgccgccattaaactatcagagtaagtgtattgttgattcattaggactcgaacctaaacttcaagaatcaaaatcttgtgtgctgccaattacactatgaatcaattttaatgataattaaatgatgattgataattgatgaattgctcagcaatcatttatcattgatctctcttatcattcatatttggcggaacagacaggaattgaacctgtacctttagtttttcagactaacgtgcagaccttctacaccactcttccatcttataattgataaatgatggttgataattgttgaattactcaataatcatttatcattgatctcttatcatttatatttttgtacggaaagagggattcgaacccccaaaagcttgatcctaaatcaagaatgtctgccattccaccattcccgcaggtttttttataagtaatgagtaattggtaatgagtaatattttttattttcattattactcattgctcattacttatttctcatattctgtacctctccccagattcgaactgggactttacggggtttaaagccgttttctctgcctattggaatagagaggcgtattttatcagtaatgaatactggataatcagtaatatgaaaatctatatttattactcattattcattgcttattactcatataatgctaggtttgagaaagctctgtctattaataaactatgcctgttagtgtttgtaaagatcttctgcgcctgacagatctttctcatttcctaatgatgttgtgtttaaaaaagtaaaaggctgtctgtttttattgactaaagatcttctgctcctgacagtccttttttcttttcttcattttttgtgtgaatggtaactggccaatttttttaaaaatctgaactttcatggtattatattcattcaatattgaccagctattcacatccagtactctataagggaatcgaacccttgttttctgctcgaaaggcaggcgtcctcaccgttagacgaatagagcattaaaaccactaaccgggaatcgaacccggacaacaagagtacagttcctgcatgctgccattacattatcagtggttggtggaagtagtaggattcgaacctactcagcaatgaagcaacagatttacagtctgccccgactctccaacttcggcgtacttccggatttttatgagcaattaatcctgaataacaagtaattcctcaatttttccttttaaaaagaaaaggtctgtctttatattgaatgtttgactaaagatcttctgcgctcgacagcctttttcttttattaataaaggatattctttgttatagatgataaaagatcattgataaaagattctttacatctcctataattttatattgagatggttatgggattcaaacccactcagtttacacaacggttttgcagaccgccccgactcttccacttcggcgaaccatcagattaaaaaaataaagtctgtctaaaattgtttgatataagaacttctgcgctcaacaaactttatttttacctaaaatttataaatgatattttttaatttttaactaatccggagagaagaaaagcctgtctgtatttttcgtgtttggcgtaaagatcttctgctctcgacaaacttttactttttctcctgaaacaattaacaattagttacctgcgattccggaaagactcgaactttcaacttccggtttaacagaccggtgctctgccattgagctacaaaatcattgtaattccggaaggacttgaaccttcaaccttcggcgtatcagaccgacactctaaccacttgagctacgaaatcattagtattccataagggaatcgaacccttgtcgttcggtagaaagccgaatgcactcaccattatgctaatggaacaattggtctggaaagcaagattcgaacttgcgacctcccgcgtccaagacgggtaaacaaccaccgttatctttccagctttggggttcacttctgtttcttttccgggagacagccgaatgggaaatttccatgaacctttgtgattccgagaggattcgaacctctaaccctgggtttagaaaacccatgctctatccagttgagctacggaaccattttttgtaatcccagaaagatttgaactttcaacccccggtttaaaagaccggtgctctaaccatttgagctatgagattgttttaaagtggtgaatagtcaataatcaattcgtttcgcttgtcaatcactattcatttttttgtaatctcagaaggactcgaaccctcaaccttcggtgtcgtaaaccgacgctctatccaattgagccatgagattaactattttgggtatctccggggatcgaaccctgttctccggttccacagaccggcgctttaccaaataagctaaagaaaccataaaaaaaagcgcctcttttcgggaggcgcttcatctatttaaacgtaagagatcattagctgacccacgtatataagcaccttttatccacaattccactttcaagaatacatgcaacacctgtcggctcctgtccgaatagtcttgaatattgattgaatatgttatgtaattgtttcattttattttttgtttgtttctaaattatttttaactgaaccctgaaaacctgttgctttcaattttcggttgcaaagtaaatatgaatttttgaaatccgcaaataaattttcaaattaagttattgataatcagttaattatatctaattttcagaatagagagtttctgtccgcaatattttgcagatctcttaattacctaaatgactgtctctcaccgggttgcttatcactctattttatcgtattaaagtttcattgttgattaaaaaattttcatgtttatggttattttttttcattctaaataatttctgacctaaaaaacaaaaaacgcctcgaaaaatcgaggcgtttctgtcgtattttgattaattttttacaagtttacagtaaataatttccaaagtcagcacatttcgcctcattccatatcacctcatcatacccgaataaccctttgctagaaggactttcgcatagttctgcattgatatgtgctctttgtattgtcataattttctggcgcaaagataaatcttttttgatattattttataattttcacaattaacgggaggtttttctatatacaaaggcgcaaaataatatcaaaaaatggtgctttaaggcgcaaggattttatctgcgataaaatttaatcgtatatataattacaatatctcttaacgcaaagcttttattttcgcagatgattattttaagggtgctaaggtgaatcaattaaaaattgatttgatgaagcagcaggatttttaaatatttaaattcttcaatctttgaatatttaattcctgaacattttatttcttccggttttgaatcttgaaatatctttcaggattacctgatcatcgggattaaaatgtttcagttcgtttacaatttcagagcgggtcgctaccttttcggatataatttcataagctatattccttgtaaccatatgaagcttcggatcttttttgaattcatatttcatggcatccagatacgtaatctttttgtgagccggcaccttttcatacaggtcctgtatttcagattccagtcttttaatatcaacaatattggcaaaatagttattcagacagttgaatgcatctttgtcctcttcccatcctttcagcagtactttctgtgcctcctcaggtttttccattttgttgcggtataccaaagaagctttcaccatttgattatttcctgtatagtcatctgctacgatctgataataataatgggcatttttaagatcgttgatttctttataaagatctcctactttttctttctgctccatttctttgtaaagatcaattgcctttttgtactgtcttgccttttcataacaatgtgcagcatcggatttattatgcagttttttaagatatactacggctgcttcgttgtaaaatcctccgttttccaatgtttttgcccctctgtaattatcctgcagaagattcatatacacctttgctgcttttttataatcattttcagcgatgtatttctcggcaagttcttcgtatttgcttcggattctgtcaaaaagtgagttttcgagataaaagctgcctccacttccttttcttcctgctgcatttctcttattttgttctttatcttttaaagaggtaatgacaataagaatgataaaggctacaattaagaaaatacctaatgttcccaccacactccagaaactttcatggaacagttgtgcaacaatcccgataaccttaaacatcgccagcagtacgaatgctgccatgaatttgtcaataaatttctgtttattcatcgtcatcagattttaaaatagtcttatcttccctgaagaggcggtaaaggatcagcatcactccgattaccagcacccaaacaaaccaattgtacccaaacatttctatcaatggataaaacaagtataccagcattgctacaagaattgtaatgagaataaatttcacccagactggtacattatctccaccaacattgagggatttatttttaaacaggaatgaatagagtcctactccggcaatcatcaggattatcatatacaaaatatctgaaacgggagctttttcctccatcggagttccctctgcacctataccttttactttcgatttgtcaattgaggcggaggaaggatccacaatatccagggttccatagagttttccaagagaatctgccatcaaagccttcttctttttcagaagatattttacaacatcaccatttaccggtttacctttggtatattgcttcagtgaatctgagattttatgtttcagcttttccgttttctgttcaagatgttttgtaatttttttagtataaatggtttttagagaatccctgctctgcttttctttgttaacaagcttttcaatatcttttcctatctcacctacatctctgccacctgcttttttatagttttctttgtctttttttgttttggattctataataccggcattgataagttccttggataatccttttcgctcctgatgatacattgaatcaatcttaagatcaatttccgaagttccagactgaaaagcaatcatatcagaaggcgcttttactgcattgttcacaattgttcctgaagaagggccggcttcttgctgttcattgctctttttatctgaaggcaaagcaatcctcagcacaatggccgcaataatgactgcccaaaagactctgcggaaatttcttgttcccgcactttccttttttccattggatcctccaaacaatccttccaaccaggtaaatttcccgaagccatctcctctggaagttcccataatgtcaagaggtattcctaattctactgcccgttcaggatatttttcaatatactgtaaatacttttctatttcttttttatttccggccattacttttttaaggtcaaaaggcaggttgttcatccactcttcttcggtttgtttgggctgtaaagtttccatgactttttcgtcatccatttcaaccgtgtagctttttattttttggggaatagaaaccccgttcaaaggttttctgacacttttattaatcgttccgggttgttgaattattgaagtccagtcgatttcttccgaaagttttaccaatccgaattcagggtgcataatcaggaaacgtgaatcaagctgtgcccagtcttccggattgattttaggataaaaagtagtgttttcagggatgaaaagtctgtcatcaacacattgaaaataagcgttccttcctatttcctgtggagcatagtcattgaaaataagaaaacagccatacagcacattgggactgttagccggaatagcgaatgattttaccagatttaaatctatacccaatatttccatttcctgcagccacaccacaggtgaagagcctctgatcagaagtccttttttaggatagttatttttcgggaaaggttttattctaagctccataatccagaatctgttctataaacggtttcaaaaacctgtcacacatatcatccattgttcttaccttcagcagcgaatgctccggaagataatattctgatcctccaaattccgtataggtagccagcgacaggaaaccgccaagtgtagagggaataaaaaattcctcaatgctcttgttactgcttcggaaggtcagcatcccgcgggaatctgtaatcatttcacttccatcgggaaatgtaaatttatttttgttttgctcggcaaaaacttgaaaatcatatttatttttggaaaatcccagcgtattttcagaagcactgtacaattcattaccggaaataaccagatttctgtactggttgattccgatcttattgaaattattgatcatccgcagtccgcttccttttagtttggcaacttcggcttctgcttttactgtatttttttccagttctttctcttttgaagtgatagtttccacagaaatattcccatcgatattgattttgtaatgagttgcatgatccgggtgatgcagataaaagcttcgtccaaaataaatcagtttataaaacataggaatgttcatccccgtgaggttctgttcggaatattctccggtattgagattaagctttgatatcaacctcttatcatactgatactggcacagaataaagtgctgctgtctgttttttgccagagcaaactgtcctctgggttttatggaaatcttatcaaataatacttcacaaccatgatgtgttttgtaataatcgtaagaatgcctgtcgtaatagttatcggaaagataagtcttcagtaattgttttttcgagctcagaatgaaaaattctccttcatacagaaactcagcgatcttattaacgggagccgggaatagaatcggatagttttgcggaaggtctgttttctttccgttggaagtattaacactttgtttttgttgcggcggattggcccacagctcctgcaatggaagttttattttctgaatatgctttcttgctcctttgtggtgtttgtaaaaattaatctcaccatctgaggttgtggtcaccagaaacttcagtctgtctctgttctgatggatcacccgctgcattttttcatcctccatattatcctgatgggtaatgaaaaacacttcaatatccttttctgaatgattctcgttaaaaaacttctccagcgcagctgaaacttccagagcggagcttacctgattaaggctttccactacatcttccactttattaagtgaaacaggaacagccgcctgtcctaaggtaaaaactttacattcagaatgggctttcggatgcttgatcacggctatggcagaggcaaaagccaatacttttggggttccccagtttctgagggaagtatctatcaggataattctttcaaaaatattttcttccggtggaatttccctttgaatataaagcgcttcattattcgctacacggttcatgaagacatcatcttcgttagcaaattcggaaagaagcatcctgtgaaaatctcctttattggtcatatcagaaattcctccgacaggctgctctccgggagaaagatgacgcatcgggattttcagtccgctccagattcttttaatcaggcttcctacctgaaatgttttgggttcttcaattaattctttgataaagtctttatctgtatctgctgttgtttcttcttccagcacttcatcatccagttccggctcatcaatcagacctttcatggcatcaatgatagactgtactgtaggaaatttttcattcagattcaaagcgctcagatctttattaagaactgatgggcttgcctcttgtttttctgcactaatggcaagctcctgcggtcttttataatagattcttaaattaacatcggctaaaagagtagccactctgttatgaccatcactgaataaagtctgcagcaatacaattctgttttgtttttgtttataaactttgggaagagcatgtattttttcaagaaattcaatttgtttttccacattgaactcaaaatcttcaccgctgtagaactctgctgtacgtcttaaaggtcctgcgaaatctgcgtaaccgtcctgcattgcatacagaaccataagcaatgccccgaacggaggccagccctgcggctgaagctctttcaggatctccatgacataaggtctgtaagcaatagctcctactccggggatggagaggagattattctcatgataaccggaatctccgggaacatcttcatcagttttccattcccaaaagtaattttcataggactggaaataagcctttaattccattctcttgatttttctgtaagacggaatgagcttaaggatagggtacggaaatcagtatcttttatcgaaagataatttccgttttcatcccacagcagccatccttccggctcattgttatatttttgctgtaacagtgtacttaggtttttaaactcaaaatccagtcctgccggcagtaaatgcctgtctttggtccaataggtttttccgggaaagctcaacaatggagttcctataaacagtgctttatcctccaacatcgtccattttattttttcaagcttaaattttggtaatgcaacgatattttctttgatatcagctatattgctcagcaaagcgattaccggctgctcttcattactttcttttaatcttaccggaacttgttcctgaattccaaaatagttttggttggaaggaggcaaagtaagcggtaatgctttatttataggagcccagagtaatgctgttcttatttttttggtgggaaccaaagcttctttcctgaataaaagtccatcccggagttcatacaggataaaatccggtaattgttgtatttccggagcttcggcctgttcatcagtaaagcctttgagccagattgttttttcatctacggcaatctgaatatttttccagtctctgattgagcccagaaaatcttcatccgcacggggaagttccgcccagaattcttttaaacgctttgaagaatcttctgccataagctttcaatttcctgctgtatataatgcttttgttccgggtttctgatccagtcgcaacgggtctgcagatacctcagtttatcttttattacattctgctcttcaaaactcaatgctcctccattccatttttcaacaagaatttttacgtctttcatgacttcttcaggattgggagttttgttctgcatggcctgtggatgggaatccggatgatcatctttttcaatcgtcctgttgatgattccttccagaatttcaatctgttcttccgtatcccagatgtgtttcaatacccacaggtcggaaagcacggcttcttttcttccgcagatcagagcacttgctgcaatgaggttctgaagttttacggctctacggtccgaaatagcaattcctgtatttctaagcgtcatgatcgtattcaggtacacttcataaatcggtgtaagatctattgttctgcacaggttttgtaactgcctaatttcgtcagcatgaatttccggaatttccgtttcttcttcattttccagttttcttcctgccagaaggacttgttgtaaaagttcgggattcacataatcgacattaattcttaccagaaaacggtcaaataatgcattcagcgcttcatcttccggaagaacattacttgctcctacaaacatcagtgcaggtaagtgtttggtttcctttccccgtttaaagattttttcgttaagtgccatcagaagggaattcagaatagcagagttcgcattgaaaatctcatccaggaaaaccatggaagcttcaggcatcattccttccgtattggtcaaaagttctccttctttcagctttctgatatcaaaaggaccgaagatctcgttcggttctgtaaagcgggtcaataaatattcaaagtttttcccgtctttcactgttttcgccagcgttctgacaatagctgattttgcggtccccggaggtccgtacagaaaggcattttctcttgccaaaaggcagattcccagcagatctacgacatcatttttacctacaaaagtatcttttacgtagtttaggactgtattgagttgattgatattctgattcattgatttaaaaaattaaaatttccaccacttcttcttctgtggcttctcttctgctttattttctgcctgttcatttcttttgctgaatgaaaaagcaagtctctgataaggcactctgatatcgaagtatagctgtgtaccatcatcaagcgtaagtgcatccattattttatctccgtcctttaccagattttgtgatacatcctgtttattgaagtgatgcctgatgagatccctttcatcagaaattcttgtaataatatagggtgaatctttggttccgtctcctgttttttcaagacattcaaaaatcatctgtgatattgtcatttcaatgctcctgcctttttcatcacccaattccttataagcaaaatatttatagatatgagctctcggactaagcagaatattgacattgacgtattgcacaacttcttcaaattttccttcattgagccaatcctgtaagttttcaaggtcttcggaataagggtcatattcaggatcactgattaccagttcacggcatttcaggaatgtttcctttgtcggatctgttaaaaattcaaatactttctcatacgttttcattgttatcttcggttatagtttttagttcccgccagaatgcgtctttgtgcattccgaattcggctgttagcagtttattgataaacggaatttctgccagtttatactctcttttttcaacaattctttccagatatagttttctgtaagtattgtctgccagttcttctgtccagttcacgttcgtcagatcaaggtcataccctattccggagtagtgaaactgcatcagaatattttccagcatagcaatcaaaggatcttcaggatcaaccgtatttaaagcaataatcacctgtggtaaaaacctcagcgataaatctgccgataagatagaagaaatatctcttgttcctttgaatccgggaataagcttttcaatatttttttctgtattttccctgatgagataaagctgagtactgtgatagagaactttagcagcccaaacagcagcttctttgttgcaggttagccggtcagataaaaactcaaggcgttctttttcgaattctgtttcaaaataatctcctgcttccgcctcttcctgaggggagatttgctgtaagcttgaaaaaagagtaatgcattcttccttacgaagcaaaaagatcgtgtctaaaaacggtgacttggtttccatgatctaacaaaaataaaattatttcgttgagaataaaatttttgttgggaagattcttgttaaatatgggttctttatggcggttacaaggttggaaaaaagcaaaggcgcgaagagaataagtcttgtagttatttttaaggcgcaagaaaatctttgattttcagcaaggctatcccttaatgagttgcttcatttagaaatagtatttatgttattgaattttacaagagataaaatctttgcgtccttattacagtataattataaaaattttgcgtctttgcgtttttaaaatcatcaatagattgcttcgtcgctaaagctcctcgcaatgacttactgtgatacaatttcaatgatattattttccggatccagaatgacactttcataataaccgtctcctgttgtacgtggttctccggcaactgtatagccatcttttcttaacacttccgtaagttcatctactttttctttactgtttaccgaaaatgcaagatggatgattccatactgctgggattcgtatgagttttcactttctttgatatccggtctggtcatgatttcaagacggcagccattatcaaaacttagaaaataggattgaaagtttttaacagggttatggtatttttcattagaaaccgctccaaaatatttctgataaaatgctctggattgttcaagatctttcacccaaatggcaatatgttcaattttcatttgttaaatatttactacacacaaaagtaaacaggccgtcttcacgatacctgctccttattattattttattgttctgtatttaccggattatattttgaataatgtaaaagactttttatatcatctcatttatagcacttattcctaacatcttatgtattctgatcatgacaggcaacttcattgtttacattgatgcaatacctgaaacaatctaaaagttattatctttgccccattcaaaataacattatgagtattcacatcagtgcaaaaaaaggagaaattgccaaagtagtattgcagccgggggatccgcttcgcgcacagtatattgctgaaaattatttagaaaatgcaaaactggttagcaaaaccagaggaattttttattatacgggtctttataaaggaaaagaaatcactgtaggagcaagtggaatgggtttcccaagtatcgggatctattcttttgagctgtttacagaatatgaagtagataccatcatcagaatcgggacttgcggtgcttacaatacggatcttaaactttttgatattttaaatattgataaagctgcaagcgaaagtacttatgctaaatacgcatggggaattgaagacgaaatcctttctcaccagggaaatatcttcaataccattaatgaaacggctaaagaactatccttaaacgcaaaagcaatcaatatccacagcagtgacattttctacagaaaagatcctgctactccggagattgctacaaaatataactgtcctgcagtagaaatggaagctttcggtttatttgccaatgcccagcatttaggaaaaaatgcagcaactattcttacggtgacggatattatcccaacgcacgaaaaaatctctgctgatgagagagaaaaagctttgaatccaatgatggagctggctttggaatcggcaattaagagtttgtaaaaggtgtaagagcaaaacagcaaaacagcgaaaaaacgaatttgcaatttgttatattttagtctttttgcggtttggcaattttgctaaaaaaagagctttacttcatcagtagagctcttttttatagtctgaaaaaaattccggcagtttttgtagtttcgtctgccacttcggaaatgctgatcttttttaagtgagcaattgtctgtgccacataaggtaagaatgaaggttcatttcgtctgttctgcgttctgggcatatttttaggaagcataaaaggagcgtctgtttcaatcatcatcctgtccagaggtacatattttataacatcttcgagatatttaaatcttttctcgtcactgatggctcctgtaaatcctaaataaaatcctttatccagataggtttttgcttcgttcaatgttccggtaaaacagtgtacaaccgcttccggtagttgggaaagatattcatctgtaatctcattaaatcttttaaatgcagatctttcatggagaaaaagaggtttatccacttctatagcgagttcaagctgtgcctgatagcatttttcctgtacaggtctcggcgagaaatccctatcgaaatccagtccgcactctcctactgaaactacataatcgtgtctcaataatttcctgagttcagcaatactttctccgttaaatgatttggcatcatgaggatgaattccggctgttgaaaatagaatttccggatattcttctgcaattccggcagattctttacttcctttcacactggttccggtaagaatcatatgctcaaccccgtgatccaaagcacggttgataatttcttcgtgttcatgatagaactgtttattggtcagattaatgccaatgtcaatataagtgttcattttgttttttacttttttataatttccttaattattgtttttaacttcggcaatgctgatgtactgctttcccgaattgaataaagtgttttgcttcctttcaggatataatcaaaataggtatcactttcagggttaacaaggacaatccacctggctctgatttttactgtttctacaatattgacaggcaacgcagtagatcctgaagttccgataacaaataaaatatcggtatgatcagcaatatcataagcagtatcaaaatagtaatatttttcattataagactcgtcaaaccataaagtatgaggtcttagccagcttccgcatttcttacatttcaaaccgtcaatatcttcaggtgtaaggtcttctgtatactctttctgctttacattttccgggaagtcaataggctcactgcattcttttgagcagcgcactttctgtttatttccgtggatttcataaaccttttgggttcctgctctttggtggagaccgtccacattttgggtaattaacttaaatctgtcgcccaaaagattttcaatttccgccagcgcaagatgtccctcgttgggttgtgcttcagtgataagttttttccagaaaagattatactgccagacttcttctgtttcctgtctgaaatattgtaaggttccaaattcttctggacggtgatattttgttcctttaatccagattccatcaatggaacggtacgttggaagtccgctttcagcagagatacctgctccggtgagaaaagttatatatccttttttctctttaatgatggtatgtaaaattgattctaattctttcataatttttaatttaaaaaatagaaacaggtcgggtttgaaccaacaactttcctttgagtggaaggtttttccagttaaactactgtttcctgttttatgtttcagctctgaggagattaaagtactctgaagaggtcaaaggtctgatttctccggctggagccattttttctttcaattcgcagatcagcaaatctccctgtctttttaaacattttatatgaggtatcaggttactatgtattctgaaggtagaggcaatagctgttaaagcatcatctttatactcctgttctatccatagccaatgttctttttttgtagacggacaccagcatttcacagcataagaatattctgctctgcttccccagatgaagactcccaatttacgattttcaacttcgtgaacttcataacgattgacctttcggatcaattttggatttccgtttttgtcgtattctacataatcaacttcaatttctttttcattgatcttttgggcttccagtttttccatcagattcccaactccataatagctgaaacagaaaagtttaaagttgcggtcttcttcattaaagaattcttcaaacttcatcagttccactttatcccacaggctttcaattttatttaaaatctgtgtaaaaaacggagtatcaaaattttcccactgtctttcatattcacgcgtcacaaaattctgaaaactgctgtgccgtaattttaaaatggcaatcagctttctcaaaggatggcctttttcctgtaaaataaaatggaaaggtaaccttgagacaatgaactgatcttttgtaagatagatattgttattaattttaaaataaatattctttgcgatctgctcaaaaccatcataggtaccatacaaataattgctgacacaacccaaagccggaaactgaagctcctgctgttttgaatcaccccattctcccaaatattccaatgatttaaaatctacacgaacatccgcatgatatgggatctgaatttgtccgttaattttctgaagacgtccgaaatctacattttcatggataatcagatctcctatctcagcaatattaggagcaacggttttgaacgcattgaaacttcctttcacgtattgaagtgcatgcagatagcagatttcagaaccataatattgatagttcccgttaatatctgtcaataccggaaatgcgactccgcttccaccgttgataactacgtttccacatttctcaagcgcctgaaagttcgcataagagccatttagcagatcgatatttccgctggtttcctgaaggtttgggaatacaactcttgtattgtccagtctcagattaccaatcagctttttcagctccggaaaatgatgggtaaacctgtgtccggatgcctcattacatcttattctaagcgtaccatgaacaaattccagattcggaaatgaaatatttttacccacaacattgatcttaccccgcatttcccgatgaggaatcacaatattatctccaatgatattgatatcaaaaataccatccttcagaagcgcatcggcctgaaactggtactgaacaggaataacaactcttgtcttcagcagctgaccattcctggcatataccttagtattttttacagaaacatacccaccggttatttccagatttttaaaggtagcatctataatacatttgaaatgaccgcttacttttttaagctgatccagctgggtacggcaatgcattttaaaatatccttccaccgtttcgagaagtggaatttcacagttcggtgcatcaatagaaagatttcctttaatgtgtttcagttccggaaaccggcagccttcgccacgcaaaagcaggcttcctgatatttcggtgcaatggaaggtcatatttttagcatatacctctatccaagcatattcatcaaaaacaatattcgcccaatcttcttcggagaatattttgtatcgtcgtatggtgtcagtcgtaggcattttctatcatttgggttatcgggttgtattcctgctgaatatattttacaaagcaatcactttctatacggagcatttcatgttcattatgagttataaaagcatcttttgcaatcaggaatgtttctgtagttccatttttcgcatagatatgatagtcttctgctttcagcatgtgctgattgcttgttttctcaagacagtattctttataaccttttgtatattctgtcagatttctaattctgttcagatagtttctgttggattttctttctcttcctgttgagaagtattccggtatattctcatttttggttaccagtgtatcctcaagaaattcctgtttaatttccaacggaattacttctgtttttctaaccagttctgttttaggaattcttggtcttgtacttctttcaaccggtttcctttccttccactgcatcggcaccggaacttttacttcatcaatgatgttcaaaaaaatcaataaatctttaagcatggtattattttttaaaatgaaagccagacagaccgggatcgaaccggcaacccatcctccgtggacatgtttttccagattacactactgttctggctttctggttagggagataagcgtgattcgaacacgcaactattctgggcaggaattatttttccatttaaactattatctccattatttaagttgggagtacagcaggactcgaacctgcaacctcgtccgtgacagggacgcattcttcactgttgaactatgtactcctgtgaaacgggcgggaatcgaacccgcagcctctggcgtggaaggccaacgctcttccgttgagctaccgtttcaagagttgggagataaacaggaatcgaacctgcaactcattttagcaaaatgtatttttccattattactattatctccgtatggattttaccaggtatgaactttataatttttcaataaaactccactgaagtaatttccttttattccttccatcacaggatgcagaattctggctgcaccatccacagagtccaacggtggaatgtagcccatttcaaactgtctctttctgagactttctttcgcgcccgtggaaatccatcccacatctacggcactcatatagatctgatcattttcaaattcttttgcagacgttaaggtcatcatattcaaagccgcttttgtcatattggtatgcgggtgaaaaatggttttattttcatagctgaaaattccttctgatgaggttacattgatgatgaatttttctttaaacactgagtttttcatcaatggtttcagttctttgatcagaaaataaggcgcaatatgattgatgagattcacctctaccaattcgtacatggaaacttcttccagcgtggaattccagcttgttttttctctgttatcaacaggctgtccgaaacgggtaagtgctacttgtgtttcttcatgataagcatattccagtttcgcaatttcacttgaaatttcagtctgattcgggatcagagtatgaatatttttaaattctaccagtttttctttttcacgctttattatcggaaggtaatattcatcgggatattttatggtctgtgcagcattattgatcaggatatccagcgtatcaaaattgaatgtataaaaattgataaaatcctgaatagcctttagatttctcagatccaaaccgtaaatccacaatctgtctttccattcgttatagtctgcttcctgctgcatcaattccatcgccagtgccggaaaacgggttgtcaaaaccagattggccccgcctcttaataccttcaatgcggtggcaaaacctactttcactcttcctcctgtcagaattacatttcttccggtaagatctgccgtttcaaaacgcttttcgtagttctcttcagcacagacaggacataatctggaatagaaagaatgtgcatactgataactttggttacagcagtagcagtttttgggaatctgaagctttgtaagtttcacttcttccttttcatcatcataaaaagcagaaacgcctgccaatgctttctgcattaatactgaattggaatttactgccaggtcatgggatttcatttctgaataattctcgtgacggctttgtttttttgcacctttatgaattttggtaatcagccctgaaaatgttttattatcgggattcagaaaagggttttccttcaaagcattcaaaactttgaggcaggtttcccattcttcatttgaaaatttttgatctgattgattcatagcttctgttttatatctgcaaaactagaagctcagtgcgcaatgtttttacgtagtaaaaaagaagataaaaaaggcgaaaaagtggaaatgtaaaatcttccattaaaggcaacgacaaggaaaagcagctattgtttaaaagaacctgcaaaatctgcgagagttttattttcccacgaatttcacagatggcacagcggtttgtgtttattcattgataaatttttccagaaagccgatcagctttgttcctccgtggctccaccggattccatggccctgcttttccctgacttcaaaaacaagttcatgtttatagtggaagaaaacattccaccaggttttattttctaaaatttcatggattttctccattactttttcctgcttctgttgattgtttcctttgatttctccccagaacttatcatccattcttccgatatgtttttcccaggctctctgggcaatggtgatttcgttattgaagggctcctgacaagctttgataaggatggctttcaaaggtggaatagcgttttcatcacgaatgctcgctgaggttaatctctgtcctaaaacattcagccaatgttcaaacggaattgcttccagaagttttgtcttcacctcatctgaattgttactttcgagaatggtaatcagtttttcaaaactttcttcgcggttgattattacttcttcgttaaaataaggtgcatccagttccagattattcttcttaaacttaaatatattttcttccagatgttccagatgttctctttctaaaatggctttgtaattacttttccatgcttcagaaaaaagggaaatataaggttcaaacagattcatatttacatcattttgatcagattaacagagagttttttttctttgatcagatatccgatcaggttaaaccatgctttacaatgatccagaatccacgcatcggaggaaataatgatttctgcactttctgccagtattttatccggattatattgcagatctgcttcccaattgaggtggtgctgttctgcaaaatcaagaacaatctgtttgatccgtccgctgtttgaaacaggtttgtcaaagatccataccagtttttcaatttgatttttcctgtaaaaagaagcaaccaattccacggctctcacagtttgattcactcttttataggttccgtgaactccggaaagatcacggaaacacccatccagtccttcaaaaatataggcttcggagagcagactttccagcaaaatcagaacattgaaaccgtcaagatatacggtctctccttttaacgatgaagaatttacatgcttcaactgcctgttttgaagctgtacagcagaggcggatgcaccccgtagagcctgtatctgccgggttttaagtctgtatctgtttcctacgagttcagaagctgctttttccggatagtctctggtcagcagataatgcatgtcttcaacagcgagtttcagcttgctgatctgtttctctgaaccaaacagagtgtcatcacctgtattttttccacggtttctgttattcatgctcaaaaatagagtttttacggtaagaaatattttttatctgagaatattaaaccatcccgtcaaaaattctttgaattttcgcccctccaaggagggaatcgagtgcttcaatattaaagcctttcaattatatgattttcttcttaattcatgatctgttatatttactacaacaaaagagatattttgtacaatgtattgatatttattagggataagtttgcaaagacttaaaaattcccttatgaatacactgaaaaaattatgttacctgtctgcagctgtattgctaacaacatctttcgtttcatgttcaaacgatgataatgaaataagtatcgaacagcagactccctcacaggttctttcttctactccatgggaaactaccggagcaaaagataagaatggaaacaatgtagcccttactgatgccagcgtagccggatacgtaggctttgcttatttcaaggcagacgggaagtttgctatttacaatctgactgacgtgctgcgatcaatgggaacctggtctgtggatgcacagggaaaaacaaggactattgcagcattaaatccggatggaacgactattttcacccgcgatgttgaaattcttgttttgaacagaaatgaattcacttacagaatccatcctaacccgagtgatccttctctgtattatgacatcatccatacaagaacctctcatgccgaacctactaacggacagcttacacttgcttccactccatgggaaactacgggagctaaggataagagcggaaataatattgctttaagtgacgccagcgttgcaggttatgtagggtattcctatttcaaggccaacggaactttcagaattttcggactaaatgatgtattaagatctgaaggaacatggtctatttctccggacgggaaaaagagaacgcttaccacacctacttttacccgtgttgtggatatcctggtcctgaacgaagccacattcacttacagaattactcctgatgcatccaacccagctgtattttacgacatcatccatacgaaggtaaaccataaggagcctttgtagtgattatttttttataataaggaagaacctgctcagtgatgggcaggtttttatattaatttacaaaaccacaagcctttatttaaaatactttagtttacttgtaagtttaaatggataaaaataatctacatgaaaattcagacaacttctgtttattcatttatctatattcttcccaccattttttccagtttgctgattctaactgattcagattcactttttctccaatcattgggagtgttatcggaatattattttcttccgcatgctgtgctgccagctccaaaggttcataccatgcatgctgtgccagcttgaatttggaattgtgtacaggaatgaaatttgtggctttcagttcctttatttctgttatcaactgatcaggcaaagtatgtatgtagggccacttttcattgtactgcccgttttccatgatggccagatcaaacggaccatatttgtctccgatttctgtaaaatgattaccataaccgctgtcaccgcctaaaaacagattttttgacggagtttttaaaacgaaagatgtccagagggagatattacgattcagtaatcttcctgaaaaatgtcttgcaggagtaagagtgattctgaaaccttcagcaatgtctatgctttcccaccagtttttctcaatgattttgtcaaaactccagccccagtattcaaaatgttgtccggttcccagcccacaaatgactttacccactttatcttttaattcctgaacggttttataatccagatgatcccagtggtcatgggagataagcaggaaatctatctccggcatatgttcaggcttataataatcggctccctgaaaagcttttactgagcctggcatcggagaagcattaccactgaaaacaggatctatcagaaatttctttccatccacctgaatgaaatacgagctatgcccgaaccaaaccaaaacattttcttcaggctggaggtttttcagatcagtgattacaaacggaagtgccgctttgggtgaggtattttctactttacacaaagtatggaaaagcactttggtcatgctttcaccttctaacagagcaggtgttggcaatatattctgaaatcttccattaagataattgggaagtgtattgaaatattcttttcttttttcatcggggaactgcccgagctgcttttttaaatttttcattcgcttgatttttacattctgagtcgttcttcttccagatcaagcctggttaaataatgtcttatatattcttcgtcaatattaggattgcgtctgttttcttcccgaagccagattctttgctgctcaagggtttcgaaataaatttctttggcttcttcggacagcttatggatagagtcttctttatcttcctgctcccagcggtccatcaatttgctaaaatattcattttctgttcttctctctttataattttcattgagatacctgaaggctacccgtcgcatttctcttctcaaaaattgttcagattcttccccggacatatatcctcctccggaatcggataaattaagctttttaatcagtgccggtaatgtcaatccctgaataatcaaagtagcaagaattacaataaatgtaatgaagagaataaggtcacggtgcggaaaaggttgtccgttttccatgacaacaggaatagataatgcagcagccagtgaaactaccccacgcattcctgtccagcccatcaataccggagctttcattcccggatttctgtctgctacattgatgaaattcctcataatcaaggttacgaagacagcaccaaaagaagagataaagcggaccagaatcaatacagcagtaattaataatccataccctattgcatcggataaacttataccctctttacgcaagcctaccaaaatttccggcagatcaagacctatcagtaagaatacaattccgttgatcagaaatacaaagctttcccatacgttggaccctcttaatctggattgtgaagttctgaaaatctgatgtcttctcacggaaaggaataaaccaccgcttactacggctaatactcccgaggaatgcatttcttctgctgcaatatacatcacatatggcgcaaccaggctaaggattgcatccatattgacatctgtaggaaatattttttctatttcaaggaatataaaagccaatacaactccaattcccaaccctccaaacaccatccatccaaaactcaatgccgcatcctgccataagaactgtcctgtagctacggccaccattgcaaatctgaaaataatcagtgaagaagcatcattaaataagctttccccttccagaacggttgaaaggtttttaggaactttcacaaacttcaaaatagctccagcacttaccgcatccggtggtgatacaattcctcccagcacaaagcctaatgccagcgaaaaaccgggaatgtataagttcgctgcaaaagctaccgatattgctgtaaggaaaactacaatgaaggcaaaactggtaataatccgcctcattttccagatctccttccaggatacggcaaatgctgcttcatataaaagcggaggcaggaaaataataaagatcagttcaggatcaattttcaacaccggtaatccggggataaaactgatcaggagtcctgcaataaccaatatgataggataggccactttcaaccgattggccagcataatggacccgataataacaaggaccagtcccaaataataaataaaattttccaccattgtcttttcaattaactttaaatcaaatttctatttttgaccacaaaatttaatagaaaataaatataagcataagattctgagatgtgaaaataaattacaagcagtgaaaattttaatcaatgattttagagtaaatacattcatatttagaaaaccattcagccagtcccaacataattaatcccagtattgagcctgacagaattaatacagctaatgtcttcgcaaaagttagccaatatgtctttcctgcaaatgtgaaatctgtgggattaatattgtatgcagaataaacggaaggattgatacgcagatccggcctgaagtaaacaactccctgaatatatcttctctgtaaagctttgagatttccgatatagcaactgtaacctgcatctgctccatcaaaatctacgtttattacggaaccgttatagtttactttcaatacttcaattttatttctcgggctgagatttatatcatattcatctgaaaggcaagatttttccagaccatgataaaggattctatcaattgttccatctcttctttcataatgaacgcctgtatcatccacaacaatctttctaacttctctttttctaaccctcttctgataaagaataaaatgatataaaccaaaccctaaaactggatagtaaaccaaggctgctataacaaatattgtaattgttttgcacagtattaaaggtaataccatcaaaattaaagacaccatcaataatacaagcactcccaacgttctggtaagccatgtcatgaaccaccatggtttggaaactaatggtaaaaaatcttttcgcacattctcctgcatttgttgaagatacggaaaaaattaaaaatgctaaagagccatagtagtataccatgactcttttacccaattgaaaataagatataattaaactgaaactatgaaatcgtatatgttttttctgtcgttgtattgtatatatcggaaatgacattatctacaaatctccattctgcaacagaactgcctgaagtaaatttcacatgcagatatcctcttttataaagattggcatattccagatcatcaatcaacagggaaaatgcctgtgccagttctattgcttttgcagggtctgaagtgattcccagatatccttctaaacctggagaagaaacggagctgcacgccagttctgtcccgataaattttccctgggcatcggtaagctttcctagccatgcattgtgtgtatcacctgccagtactatgacattctttcctgcaagaacagaataaagctgctctctttccataaaatagccatcccatgcatccagattgtatggtaaagtagtggtgattcttgcaatttcctgcggcgttaatgtaggatcctgctgtttgtatcttgttttaaggactattagttgggtgatggtattctgaagtgcctgcatcgtagccggttgagcgcttccatgttgtttgatctctgcaagaatctggttcagtaacataagaagttctgcaggaaccatcattttcgtcattaaaatctgctgaccaagaactttccattttgccgtatcaccattgatctgcgaatttagccatgacatttgctcgctcccgatcagccttctgcttgtacttagaaaatctgttttaaactgtatctgattaaagttcccggctgcatccagataatccgagtattccatctgtttatctctcgcaatcactcttgtatccatcatgtaaagagaaactatatttccgaagttgaaacttctgtaaattctcatatctttccccgtcttaagaggaatatattcactgtatgcctggaacgctgccatttttcttgcctgaaaatctccttcgttcggctgatggttttcggctccggatttataggtatcattggcaaattcatggtcatcccaaacacagatgaacggttttttctgatgaagaagctgaaggtttttatcgcctctatattgtctgtaccgctctctgtaatcagtgaggttaagaatttcttttgcgggtagatgagctctgcccaactgattggtgtaaggatttgttccatattctcccggagcatattcataaatataatctccaaggtgcaccactacatcagcttcagattttgcaatggctccatatacattaaaaagtcctgcaggaaaattagaacaagaaactacttccattttcacttcacttacagcatctgattttgaaggtaaagtaagcgtttctcctgttacgctgacttctttagttttactgttatagaatctgtagtaatactttgtgttggaggaaatattctgtacatccactgctaccgtaaaatcattcactgctgtagcattcacctgtcctcttctcacaacttctgaaaagctactgtttttactgatttcccatgtaatctctgcatcagttccttttgaataccgggtccagataataattcctgtagcacttgggtcaaaactagctacaccggattcaaaacctccgtttttaagatcatcaggtgcatttccgttttcagtaaaatcatcgctgcagctttcaattaaaggagcaataaaaaatcctcctgccgctaatagtgaatttttaagaaatcttcttctgttgaattggttattgttttccatcattacttttttttgcaaagcaacggtatctagggaagaagactgttaactgtgttttaaatatattttaggattttttaaacacatgtttaatacaatgtgtgatttttaaatatctaataagaataatgtgcaatagttttataatgcctgaataaataatcatagatcaccatttcaaataatctttgattagaaatgaaaagcctattaatattcatatgaaatatgctttggaaaaaattttgcaatgacatttctaaagactgattttcaaactgatatataatattttcaaatatagtattgcttacttcaatgttattaacaataacatctctttcttccgaaaactcagcagaatgaagaaattcaagaaactttaatttgaattctctatattttttatctaattgtgaattgagttttttatctgcatggaattcttgtttaaaagcattattgaaatcttttatccactctagtttttcccggactgaaagattgagatgagtcaaaatttcatcaatataaaaaagtgaaacaagtattttttcctcatcatcataatgaaggcattgcagggtaaatttactgtttcggcaaaataaagtttcggcatcttctatggtgtattctccataccgttcaatttcccggttataggtatcaacctgaatcgtagaaatctcaccgctgtctatatattgttcaaatgtagcagcaattttatcaaaagtctgattataatattcagtattttgcaatttaaatcttagcctcaaatgtggtttcggatcattgtaacgaacgaaaaaccactttgaaatgtagttgtgttcctgaaaatattcaacaagcggctgtatagcatcttctaagattaaatcggcagtttttacccctgtatagattttcaggtacagccattcacttcctggaataaaagttcttttcattttcatcaattatcttttctatacattggaaaaataaactcccgtttaaagtcatcattttcattatgtaaaaattcttcaatgataataaagttttcattttttactgaatcaatcagcatttttatcagatcgtaattttctaagtttacggtaagtttattatcagatttaacccattgtatccattgcggaatttgcttcagttttctccagttttccaattctgaaaaaagttgatctttatcgtctatcaataataaaaatttctttatttccttcttcgtgatcttccaagaagcttttgataaaataatgtttttatattccactcttggtaaaaagttatatatatattttaaatctccccaattaaaatatagtcctgaccgaatattttgtgaatgtaagtcacaaagaaaatgataaacaggtaacgaatttgcagaataattatgtgcgttggtaagataaggcttaacttccttgttcaatctcttggaacgaaggactatcctattattttttaaagagataaatagatcatctattaatatttggttttccttgggcaaaacagattgggctaagtaaggaatttcatattgtctaagtgttggtcttctgattacattccctattcttgcatccggtaagtgaataatttctgctaaaatgtagtcagaatttaactcttcttctttgttagcaatttcttttgttagattttgtattcccgatttttcagaacaaaatcttcctaataaacttccagcactacatccgtcacttccgtttaaaaataatttttcagaattattttcagaaataatttcagccataaaggaaatagtatctggtaaatcatcccagttttcttcaaaatctaaaaaatattcgtcaggtaaattgattatatattgaccgtgtgttaaagcatcctgtaaattttcatttaaaatttgctgaataggatcaagttcaatttttagatttgatttttcatgaaacgaaggaagttctaaatcttcaagatagggatataatccttttgtaacagcatcctgacgataccctatgcccacctctgtgtctaaagcataattcaaagaaacttcctgtgtttcaaatctatcataaaaagcttttttgaatttctctaaatgagtttctttctgagaaaaattaattttattaagaaaactaattcctttttttaattcttttttccaaaaagaagaaaggtttagtgttttattttcgtacaaatcagtctgaaaaagataatttggtttaaattcaatcttaaaagatttaatcaggctttcaatttcaaaataattcaaaattgaattttcaatattttgatccaatccatttaatttctttttgattgagtttagtatatttatttctttttccgcttttattctttccagaactgaaattattttttccaaataatccgttccagatataacagattccagttcacttacaagcacttgattgcatatgagttcttctataaattctatagcttcttcttctgtaatctcatcatcaactatactttctgcaatttcttgtagggttttaccttcaaaggaaaaattcaatacatgatacaatacttcagaaagtggagctgaagagataatatattctcttttttctttggtgtattcatactctacaaatcggattttatttccaactgtataaatactattgttagggaaaaacaataattggtttctgatttcaggaacttgtagaaaatgctgaactaaaccaataagtaaatgcgtgtctaattttgtatctcttattttttcatgagctgaactgtaattatttagctcattgttgaaagtacccaaaccaacttttgaaaacagtccaaagggggtgcatcttgtacttgctctactgaagtattttaaaattgtggttttaagcttctgaaattcctttaaagaaaattctttttctaaattaacccatttaatcaaatcattatacacatcaggtgacgcaagatagattgcttcttgaaaaattgcggtattgcagattatttttaactcatcatcagaaatgtaataattatttgctttttcatggaaatttttatacgaaaataaaggagtacggactacatactcatcaaagaactgatacggaaaacgagccatttatttttttattttttcattttctttaggctggtattcaggatgatctaactgccataaagcaaaggcaaaaacatctgatagatttaagtatttttgttttaagagaagatcacgtccaccatgtccacccttatagtctactttaagtaaaatgggattcttagaaacattactatttgatagtaatttcgcagcaaatttaacaggcatccatggagctactcgcggatcgttgattccggttgtaataaaggttgcggggtattttgtgtttttttcaatatgatgataggcatccatttcatacagatctttaaattctgattcaatatttttagaaccgaattctttaacgctatttaatccgtttggcattgcctcaattctcaaactatttactattcctgctgttatgatagcaactttaaacagatcaggtctttcagtcatagctcttcctaccgtaattcctcccgcactttgtccccaaatagctattttataggcagatgtataatgttcattgatcatatattcagcacatgatattaaatccttccatgaattgggcttggtatttttaaaaccacctaaatgccatggttcgcccttttctgctcctcctcttacatgggcaatagcaacaattccaccttttaatgcccaaagcatgaatgtcatatctaaaaatggactattattaattccataagcaccataagcatctatcaaaagaggattatttttatttttcacaagatcttttttatatattaaagaaagcggaatatcaagtccgtcatgtgatttaacagttatttcttttactataatatctttgaattcaggatattctacaattgtagctaaattttcaggagtaaactttttggtcattgaatcaaatttaaagcgttcattatcatttttccatcctgtacaatttatccaaaaatcattggactgattatcttgagtagttacagtaatatcacctgacgggaatggtaatgtcaggttttcaattttattattttgataaagatatagtttagcttctacaccattttttgaactgctaaacacaaaaccatctttagtttgataaagtccgttaattacctcgttgggaatactgggaattattaggctaggattcttaaaatccggagatttcaatgatgtacaataaatggcattcacaccatttttctctgatataaaaattatactgtcattttttacaataaatccattaattttttcctctttagaaaagagcagtttccattgattttgtttattgataagactaaccggctggaaataagtatcattaaaatttgtagcacccgctatatagccaaatagatattggctttcttttgtaggaagcttcactataggatagtcttcaggatttatttttaaattaagattgtttttttgtgataaaattacattcaattctttcggattttgtcctattttatagacaacagcttgcatatctttcataaaccggtctgaatgaggatctgttacaggaaattgaagataaataaaactgttattatccggaagccatgaaatccctcccccatttgttggccagcaatttgtaacgaggtctggaagtattttatgagacttcagatcatatataaccatttcagaaatttcttttccactttctgttagagcaatagcaaccttagagccatcataattaggcttaatataattaattataaattttttgccagaatctaggttataattttcgggattgaaaatttgcttttctataccgctaaatccttttctgtaatataattttgctgtattttcatcagcacttttctttaaataaaaacaaaaatcattttccgtgatattaattctatctacggaaaatgattggcgtttatcaaattcaattcttttattaatataatattctctgttaggaattttattaagaacagaatctgaataattggtttgagattgcatccagttaatgactgaaggatcttttaaattttcaaaatttctaaactcatccacaaccttaactccaaaatagttttcaataactggcttcgatggggctaaatttgttttttgggcttttaccgtaccaaaaacaaaatgaatgaaaaatatgaaaattaatcgatgtatcattatacggacttatcttgttttaccagtacctgtcggctcatcatcttcattaaaaaaattcaaatcgttactaccacctctgattgagttaagattgttgattttggttaattgtatttttcttaaagataacttttttaagggttgctttttctgcttcatcttgtttttattatattatttaaacgtctgacaaataacgaaattaatataaacatattcaagaattacattccaaaatttataaatatcgtacaaaaaatattttaactagctggttatatgtgagatagaaattatatttttttatcttttaaagcttttataaaataagaaggcagagtatctgtaatctttttaaaagctttagtgaaagattctacattattatatcctgcttcatctgcaatagctgaaattgtaagcttttgtaaatttttattttcctttaattcatcaataatataattaattcttaattcattgagatattgaggaaaattttgccctttcagttcgtttactagtttggataaataggatctgtttgtattgagttcttttgataataaatccaaattgatcgttttatctaaaaaacgtttggttctttcgaattcttctaattgtattctaagttgtttaattttattatcaggtagatttgatagcttagatttttcagtttcttgttttgatgaaaggtaaattaatttattatctgtcacatcaacatcttcagggataacctcttttatatcttggcttctaactaataagttggctttagattgatataattttattttttttctatttttaatttgtaaaaatatcaaactgattataagcaaaatacccacacccaacaacccaaatagggtataattcttagaatgtaaatctgcaattaagttttctttttcattcaagagaagtggcgtatcatattttttattgatttctgcagacaaaaagctgtaatttttatttaatatgctatctacagacaataggtgctcaatataaaataattgtttttctttatcccctgtttttttataataatcaattaaaagtgggtaagtatttcttagttcataggaaacatttttacttgctattataattgaatctaccttctcgaatcgatctatgaaatttttgttattagtattatataaaatttgtcctatataatattcactcaaagccacattttgaatattatcaggatctttagtgaagattttggaagctttctccaaaattggcaaagcaagtttgtaatttcgttgtttgaaagtattaatcccataaactaatgataaagaagcatataagtcctgatctttactttttaaattttgctcaaatccacgtttgacatagtaatttgacgaatctaaattattacttacgtgataggcataagataaattatataaacatttctcataattaatatgatttgtaaaattatttttttctaaataatctttatatcctaataagagttttaaagcctctggataattctgcagttcaagctttagtaaacctatacaagaattaatattttggtaaacctcactaccttttttagcgtagctcttcgcaattaaataattatctaatgattttaaataatccgcagtgtaataataataaactcctttatatctatatgcttttgacagatattcaaggttttgtattttcctggatacaattatcatactgtccaaaaataaaagagcttgtttatctctacttattttatataataactcatatccatcagctatttttttatcatttttattttttttcccctttgacagaattgtattagcatagatttcagccttggttttattagtataaatatttttttcaaaatttttctctaattgctcaaaatcttgattttttagagagtcagcaatttgaaaaccttttatgctttgagaaatgcataaactagaataaaaaaaaattaaaacaaataatattttatacatgggtatttttcaaatgcaaaagtacacattttgaatcttttttattgccaggataaaacaaaatacaaacaactgataatcaatattattaatacctgaatttacaaattccttaaagaatttttaccaaaatttataaatcccgttatccttttcttgcgatatcaaaaaagcacatgcatctttgctccgggtaaaaacacaataaccatgacctttttatttttatatctgcgcaattataaaaataaaataacgctgatcagcaaaaacccatgccagggtttgtatggcaaaattaattatcataaaaacaaaattatcatgaacaaaaaaatcagaaactcagttttcgcaggcggaatgacattcgtattcgcattaaattttttagtccctaatgtagttaaagcaaaaggtatcgcctatggagatcaaatacagtcttctaatacttcacgtgaggcaattgctcctgattcaaatgtatctgctgttgccggtaccgttcttcttgctgtaatggtagtatcagccatagtagatggtcttcatgcaacagatgatgtttcagcaaacatccagaatctggactaataatgattttatggctcattatattaatgggccatttttatctaaacagctatgaagaaagtaattaaaatatttatcgttgcctgtgtatcaatttattggcttttaacatttttatataattcgcccaataattttataaaaattgagcatcaaaaagaactgaaaatattttctactttttttgctcaaaaatggagtttttttgctccaccaccgcaatttaattacaaactttattttacttatctggatgagaataaaaatgaaattgctgcttttgaagtctactcttcaattatagaatcaaaacgaaatacaagaccatttaatggtagagcagaaatggtagattacacaatttatggatctatcgagggcgttgttaatacaatagtgaaagaaagaacagaaataaataccaaacaacccgaattaaatactgacaatgcaaatcttctggcagtgcaaaggctcaatgaagttcctgaacgggttcaaggttttctattgttaaaagactatgcaaaaattgttggaaaagataaaatgtccgcagagaagttaaagtcagtaaaatatgtaacaataaacataaattctgaagaaattaaaaagtttgccaatagagaaagcaaaaaaccaaatgtagaatctaaaataattgctttcaatccttatcctttttaaaatgaaaaaactattccactcaaatcattatatatatctttcggtattcaggatattgatatcaatacatgtatttaaaaaatatttacaactattttttaataaggatttaataactgatgctacatttttgaaagcagcacctgttaaccagacatttcagatatttggaattcagcagtccactatttttcaaaatattaatattattcttagtattataatgttgctaagtattttatttgcctttggaattttcaggtatttcacacctttattgttatacatttgtgtagaaattgttcaaagagcatatccttttatattaaacggaggtgataatctattaaaatttcttttactgtatatgatttttacggattgttacagatatttcacactgaataacagtagcggacaaaaaaaagacagtatcagctattttataaatcaaatatcagttttatctataaaaattcatttatctttgatttatttcgtttctgctatattcaaactcaatgctaaagtatggttcagtggtgttgccacttattatactttacagctagaaagatttaagggaacagaaatgaataatatattagcaaaaaatggaatttttgtaacactctccacctatattactttaatctgggagttagcatttccttttcttgcgtggcataaaaccggcaaatacattgtgttcgctcttggaataatgatccatatgggaatctatatttttatgatgatccatgattttgagatcctgtttatgatgtgttatggttttttcatcagtgatgaggaatgggaaaaagcaggagtatattttcaaaaaattgtatcattattcaaaagaaaaatatttagtaaggaatatgcttaagagatatctggaactgagattaaaattattgcttaaagcttctaaccaaaatatggatattggtgttatggtaagtataatgcttttatttctgcttttttttaaaacaaataataatagctattatgcattaatttcatcaactgttttatttatcattcactttacccgaaaggatattgactttctaaagaatattttaggaaaacaattctacataggtattgtatcagaatatttgataatttggatatttataaatttatttttcatcttcaaagaaaataattttatttttctgggaaatatttttatatgcttcatcttgcctttactaaagcttaaaaaatattttgccaatccctcgtttattaataaaattcctaatgcattattagagtggaaggcttatatgagaaagaatattataatcttcttttcctttgtattactttccgttttcttaggatatcatcctgcaactttagtaatattaggactatgttggttacatattctcctgcatgtgtattcactccaggaaaataaagaaattctcattctgcagttttcaagattaagattagaaaaaaaagtcatatactcttttttgatttgctggatcatctcaattcccgctataatcaactttgcctttttaaatcctttgcaaaaagattatatagtttattttagtctttatctttttctttcgaattatgttattattattaataagtacgccggctataatgaaaaaataaaggtaacccatgttaatgatgcagactttttcaaatttacacttataattgggttattaattcctgcaataatttatataataaacaatagaaaatcagccttaactaaaatcgcaaggtatgtttagtatacaaaatatcacattcaattataactctaaaaaaattttagatgaccttagtttaaagataaacgaaggaagcatatttggtgttctaggaagaaatggtgcaggaaaaacaactttatttgaatctatttttcaaaatacaaaatacactgggcaaatattattaaaaaaccaaccaataaataaaagagatatttcttatttggaatctgaaaattacttttatccttatctgtcagttaacgatattttaaatctgttaaaaaatgagaacgaggataaaaaggtaacaaaactgacaaatttctttaatattccaacagatgctattgttgaaaaactctcattaggaacaaaaaagaagcttgcaatcctttgtaatatcttaattgatagatccgtatatctatttgacgaaccatttaacggacttgattttgaaagtgttgaaaagttttattttattattgatgaattaaaaaaaagaaataagatcgttttgataagctctcatatcatggagactcttacaaattgcagtgatcatatcggtcatttacaaaatggaaagtttactaaaatttacctttcagaagaataccatttaatacggacacatcttacagaagatatccagaaagattgggtctcttataccaacatttagcatttaaaaaaactaatttctatggacaataaccttctttcattggagtatatttttattacttcaatagtaatcgctttatcctttacaggatgcatatatggcattgcatattatctttcttatgataattttagtatgactgctgttgctttctttcctattcttttattgtttattgcttttatgatagctgcaataagtttgtttttatcattaaagaaatacaggaatgcaaaaaaagtaaatcatatcggcaatttttattatgcaatttgtacgtttattcttagcagcattatgatttttttgattgatgttttcgtgtatgctttaattgacaaaactctgtcttttaaatatgctgaaacattgcaaattatatccaaacaatatgcggtgacgtcaaaaaatattaattacatgaaaaaaattccatttattcttcaaagtggagttatggtgtttacaggactacttgcaggaacatttttttcgctattcattttatctcaatataaaaacataaaaaaacagccagatttacaagccatttaaaaattcacaaatgaaagttattatttatgattctgaatgtaaattttgtacaagattttccaaatggagccaatcaaatgttaaaacgctggaaattatttctgtaagaagcaaagaagcaagaaaacttcttcgtgataaaggaataaagtttatagatcttcaaactatatattttgtgaatgataatgaagtttgggtacggtcaaaggcaatatttaaaatatttacgaactttacttctccctggaaatttatttcttttttctcttttttgcctgcttctattacagatttcgggtataaaatttttgcaaaatacagatactacttttaaaaactaacctatgaaatacttagtaatactatcattattttttttaattaatatcaaaaccaaagcacaggaaataaatcgctttttctatgaagtacaatataaacctaaaaaagattcttcaagaattgaaactgcgatgatggttttagatattaaaaaagataaatcaatctttaaagattatcaattaattgtttcagattcaatctccaacgaagtctttaaaaaaatgcaaaaaacaggcatttacgaaaatcagacaacccctccaaatgttagatttacctattctgtaacaaaaaaataccctgatatggatgttcaatatactgaggatattatgaacgggttgactcctcttacatttggctatcaggaaaaattaaattttgattggaaaattcagaaagaaaagcaaaaaatcggggaatataatacccaaaaagcaatattaaattttgctggaagaaaatggattgcctggttttgtcaagatcttccttttaatgatggcccctataaatttaatggcttacccggattaattgtaaagatagaagatgatcaacaaaattattcatttaccttaaaaggaaataaaaaagctaaagataacagtgaagattctcttattaaaaagttcaccaatggtaatgtgaaaatagtagaaaaagtaaaatttacaaaaactttcgaaaactacaaacaggatcctttagctgcaatgagaagtgaattaactcctcaattattaagtatgacaatgccaggaactgatatgaaggtaaaagattttattgaaaaacaagggaaagagataaaagaatcttacaagcttaacaataatcctattgaaaaagaataataatgttattaataaattatgtgtaaggtaatattattttatacaattatatcaacttaaaactaatcgtatattccaatagtatgatcctaaaataaaaagccccttgaacaggggcttttcgagtttttagtgtggtcccacctgggctcgaaccagggaccacctgattatgagtcaggtgctctaaccaactgagctataggacctcaaaacttggttaaattttgtgtttgcaaaaatagtaaaatttctttcactacaaaattttttatcgcttttcttggcaaagttctaccagcacgccgttggtagactttggatgtaagaagacaactaatttattatcagcaccttctttcggttcttcagagataaactgaaacccttcttttttcagtcttttcacttcatccaggatattttctaccccaaatgccagatgatggattccttcaccctttttatcaataaatttagagatcggactttcaggattactggcttccagaagctcgattttactttctcctgtttcatagaaagatgtcacaacgccttccctttccactgtttcttttttataggattccttccctaataattttgcaaaaagttcatcagaaccccctaaagactttacggcaataccaatatgttctagcttcataaatagtaatcaatataattaaatcgtaaatttgatactacagtcgaatttcaaagtatcaattcaaacaaaagtactaaatttgcagaaattatggaaagtaacagacaaagaaaagtagcacagatcattcaggaagacttcgcagagcttttccgcaaacaggctgcagaaagcaaacagagcatattggtatctgtttcagatgtaaaagtaactgctgacttaggaattgcaaagatttatttaagcattttcccacaggaattccgtaccgctgtaatgaaggagattgaagaaaacaagcctcaatacagaaactttattggccagaagatggcaaagcaggtgcgtattattccacagcttaacttttacctggataccgctcttgatgatgttgaaagactggaaagagaattaagaggcgaaggcgacaatcctgttttatagatcttgaagaatattgcattttacatagcatccagataccttttggctaaaaaaggaagtactgccgttacgtttattacgtggctggccgtgggtgccatgacggttgctgtggctgcaatgttcgtcattatttctgtcttttcaggacttgaagacctgaacaaggatcttatttccaatctgcatgcagatcttactttaaaaagcacttcgggaaaaacgatcaaaaacctggatcatgttactcagattctgagtaagaataaagagatcagcagtttctcccgtgttattgaagaaaaagtatacatcagcttcaatggaaaaggtgatattgcctatttaagaggtgttgattctgcttatgtcaacgtaaatcctattaataaagaagtattctacggaacttatccgagtttcaaatactctaatgaggtattgatggaaaacagtctggataacagactttcaattcctgtagattcctccaatcattatgcaaccatctttatgcccaagccgggtacggggatcatcagtaaggaagaagacatttataataaaagagatattctggtaacaggagttttccctggaaaagatcagctggacaattacattatctctcccatcgaacttgcagaagagctacttagccttcccaaaaaatcagcttatcagattgttattaaactgaaaaatccggaaaatgcagatgccgtaaaacaaagcttgctttctgcaatcggaaaaaatattgagatcaaaaccaaggaagaagaaaatgccgctttctggaaaatgatcaacactgaaaaactttttatttacctgatctttgcactggttatctttattaccacctttaatcttgccggagcaattattatccttcaacttgataaaaaagagcaggcaaaatcattgatatcactgggcttccctttaagtcatttaagaatgacctatttctataccggactccttattgttgtttccggagtaattacaggattgattcttggaacagcactttgctacttccagctttatacagaattcttcagagctaatgaggtattgccgttcccggtaaaaattgtaggcaaaaattatcttatcgtagcactcacagcttccctgttcggaattgcaatttcatggttcttttcaaaaatcagcaaagaatatattactaaaaactaatatattaacttcatatattacatacaattaatatacttcagtttcattttttcgtacctttacgccccaattttaaaaaatgaaacaaattttatctttttttcttgtaagcgtgactttcataagcgctttggcacaggctccggcaggatattataatcaatcgccaggattaacaggtgctgctcttaaaacagctcttaaaaacattatcagcaatggacatgtagaccatggctatggcggtttatggacaggctatgcaacaactgaccgtgattatttttacgaaaatgacggaaccattctggatatttattctgaaaatcccaatggacctgatcaatacagctatacattaggaactaaccagtgtggaacatactctacagaagggcaatgctataacagagaacatgttattccacaaagtttattcaacagtgcttctcctatggtcgctgacatacactttatccgtcctaccgatggaaaagtaaacggaatgagatcaaattatccgtacggagttgttggtaacatttctttcttatctaaaaacggatcaaaattaggaacatcggtatctccgggatattcgggaacagtatttgagccgattgatgcatttaaaggtgatattgccagaatgatcctttattttgtgacaagatatgaagacaaccttcccaatttctctactggagacatgcttgccaacacagcataccctggactgcagccctgggcacttaatcagtatttagcatggaatgctatggatcctgtatctccagaagaaatcgcaagaaataatgcatcttatacgtatcagggaaacagaaaccctttcattgatcaccccgaatatgttactcagatctggggaactccggttattgatacacaggctcctacagccgcaacaaacgttgtagccaacaatcctacttcaaactctatcaccgtaagctggacggctgctacggataacataggaatagcatcttatcttgtttatgcaaacggagccctaaaagctaccgtatcaggcacaactacctctactgtaatttcaggattatctccgcttacccaatatacattctatgtaattgctaaagatgcagcaggaaattcatctccacaaagtacaaccgctacagagacaactcttgacgggcctgcaggaggcggaagctgcggaacggaagatttcagcaccatgctggatggctcatcttcgccgtcttcatatgccacaagaacatggacaaacaataatatcacttggacagccacttcggcaagaaccgacgaaaccattaacggtaaagctgtttgtactaaaggatctttaacaagttctgttatttcaggcggtattcagtctctgacattgaccacacagagaaaatacaacggtaacaatggtaaccttaacgtattgataaatgatgttacagtaggaaccattccgtacagtagcaccgtaacaacgactactattaatgtaaatgtaagcggtaatgtgacaattaagatcgtaaatccaaacagtagcgacagagttgctatggatgatcttagctggacatgtttcggtagtacgttagctactgctgaaaaccaaaaaggtaaatcagaattcacagtttaccctaacccggtaagaaataatgaattatccgtaaaaggagaaaatctcagcaaaatttcaaaagctgacatctatgatctttcaggaaaattaattgaaacaattgctaatcctttcagacattcaaacaagattaaccttaaaggtatggtaaaaggaacttacatcctgaaaacagacagtttctctactaaatttattgtagattaattattaaaaaatatttaaaaccaaaggccggatttatccggtcttttttttatttttgatatatggattccaacaaaaaattaggattaataggacgaaatatttcttattccttttctaaaaaattcttcgaaaataagttccagaagctcatgctgaagaacttttcctacgatatttttgatctgaacgaaatcaatgaagtagaacaactttttgcttctcctgagctgttaggatttaatgttaccattccttataaagaaaaaataattgattttcttgatgaattaagtgatgaagccgaaaaaataggcgctgttaactgtgttcttattcatgatggtaaaaagacaggttacaatacggatgctttcggttttgaaaagacacttcttttacacaaaaaaccttcacaggataaagctctgatcttaggaaacggaggagccgcaaaagcagtcaagtatgcgctggataaacacaatattccttcaataactatttccagaagtacagaaatcaattttgaaaaccttgatagggaaacagtttcagaacataaaattattgttcaatgtacgcctgtaggcacttttccaaatgttaaagaatgtctgaactttccttttgacggactttcctcagatcatctggttattgatctgatttacaatcccaactacacccaattcatcctcaatgcctctgaaaaaggagcaaaaacagtaaatgggtattatatgcttgaacagcaagcagaaaaagcctgggaaatttggaattttcaaaaaaaataacataaattagtgctttaattggccttacagctatatttaaaggatattaacgccactcacataaaagatttgctatgactacagaaaacaatctttctgaaaacgaagaaaagaaaaatcctaacgaagtatctcaggacacatcagaaaacgcggtttctcatgatgcaaacccgcatgaagatgatgcagaacacctggaagaacatgaagaggaagagatctctcttgccgatgctttaaaggaaatggaaaaaatcatcaacactcctaatgcaggtgaaaacttcaaaagattcaaccaactgaaggaaaaagcaagtcattacatccatgatgaagtggaggacaaaaaacatgaatacatagaagccggaaacgctgctgaaaatttcagctacgaacacccttctcaggctaagtattccgcattagtcaatattttcaaggaaaaacatgacgacttccagaaaggacaggaagaagaacagaagaaaaaccttgaacaccgccagaatattattgaaagacttaaaaatctttataccagctctgagccggggatcaatcttttcaaatccatccgcgagataaaagaagactggtcaaaggccggacaggttgcaaaatctgaatttaaaattcttaataacaactatttccaccacctgaatcagttttatcagatgctggatctgaacaaagaatttctggagcaggaatacagccataacctggaaaaaagagagcatatcattgcccgtgccaaagaactggaaaacgaaccggtaatccagaaagcactgaatgaacttcaataccttcataaactctggaaagaagaagctgaacccgttgcagaagaattccgtgaaaaaacatgggaagaattcaaagaaatctccaacaaaattcacgaaaggaaatctgagctttctgcttctattgaaaaagaacagaacgaaaaccttgaaaagaagaatcagatcattgctgaaatcaaaaagctttccgagccttcagaaacacctaaccacaattactggcaaaatgccatcaaaagagtggaagacctgcgatctgactttttgaaaacaggaagtgttccaagaaaactttccaaccagaattggaatgacttcaaaacaacactaagagcttttaatacaacgaaaaacaattattataaatcgttgaaaggatctcagcaagccaatcttgaagaaaaactgaaattgattcagaccgcacaggacaatatgaacaatgaggaatgggatatctcggtacctctattcaaaaagcttcaggaagactggaaaaaaatcggtcacgtaccaaaaagcatgaccaataagatctgggacgagttccgtgatgcatgtaacgcattcttcaacaattacagagagaaaagcaatacttcaatcgacaactggaaggagaactataaaaacaaaaaagctcttcttgatgaactgaaggaagtttccaatgacgaaggaagcatcgaaagaattgagcagatcaaaacttcatggaataatatcggaaaagttccaagagataaaatttcaatcaactctgaattcaataaaacattaagagagaaattgaaaataaacaagatcaatgaacttgagctgaaagaagaaggcttatctgaaaatcagcttaccgacaaagcaagaaagatcaaaaatcagatctctgatcttgaagcagaaatcgtgaagctggaaaacaacctttctttcttcaacaagccgtcaagagaaaatcctcttttaaaggatacttacaataccattgatgagaaaaaagctcatctggaaacgttaaaacaaaatctccacaacattatcagcggagaataatacataacaaaatacataaaggcggagcaaagtaatttgtcttcgctttttctttttacaatatgaacaacgacgaactttatatcaaaagatgcatcgaactggcccaaaaagcacttggcaaaacataccccaatcctcttgtaggaagtgtgattgtctataacggagaaattattggtgaaggataccatcataaggcaggggaaaaccatgctgaaattaatgccatcaattcagttaaaaataaggatcttatcccggaatcaacaatttatgtatccctggagccatgtgcacattacggaaaaactccgccttgtgctttaaagattaaagaacttggatttaaaaaggtggtgattggagcgatggattcccatgataaagtaaacggcaaaggaaaaaaaatcattcaggaggcaggcattgaagccgtttcaggaattctggaaaaagaatgtatcgaactcaacaaaagatttttcacctatcacgaaaagaaaagaccttatatcattttaaaatgggcagaatccggtgatggatttcttgataaggattttaagtcaacagctgtttccaattcgctggtaaatcaatttgttcatcaactcagggccgatgagcatgctattttagtaggaacacaaaccgctttgaatgataatcctagccttaccgtaagaaatgcagaaggagtgaaccctgtaagaattttaatcgactttgacttaaaagttccggctcatttcaacatttacaataatgacgcaaaaactctggttttaaactctgtaaaagaaggtattgaaaatcatatacagttcattaagatcaacaaagatgattttctactggaattaatgaaagcactatacaaagaacagatacagtccgtcatcattgaaggcggccgctttacactccaacagtttattgatgccagcctctgggatgaagctatagtaattaaaaatgaaaaccttaaactggaaaacggaacaaaggcacctgaatttaattatacagccaatagacttgaaaatttcagagataacatcgtatcattttacagacaaaaataaaattaagcagtctattctgacggcttaatctatgatcatgatgtaaaatagtaaagcatttaatacttttgcatccataaagccggaatacacgatgacgtttgaatataaaaccatagaaaaacccatagaaaacactcttttaaaagaaaaaggaagcaagtttatcggatttgcttacccggtaaataatgaaaaagagttaaaggcagctttggaaaagatcagggaggaacatccgaaagcgacccaccattgctatgctttcagaatgggattgaatggtgaaaactatcgggctaatgatgacggcgaaccttccggaagtgccgggttacctatttacaaccaattattggccaatgaaattacgaatgtgcttgtaattgttgttcgttattatggaggaaccaaactgggagtttccggccttgtaaaaacttataaagaatctgcgaagattacattagaggcagccagtattatcaccagagaattagaaacagaagtagagattcaatttaacttcaatcagcagaatacaatttttacattgctttctaaatttgatgctaaagttttgaacttcgatgcgaatgaagactgtattctcaccgcgtcattgaaactggcacaaaaagaaagcatctcagaaaaactttccgagatgcagtatgtttcatttgaatttaacgattaatctcttcttcctccaaggagcaaagatgcccagtacagaagctgtgccagtgaccctaaagcagctactacataggttctcgccgcccatttcaaactgtcctgtaccccaacaaattcttctgcagttactgttcctgtatctttaagccatttcatcgctctgttactcgcatcatattccaccggaagtgttacaaaagcaaaaagcgttgtcacagcaaacatggcaactccgatggcaagaacggtcgtatttccattgggattctcaattgttcttgatgctgccattactgcgatgcccgcaatcagaacaaactgcatcagattggaacttatattaacaataggaaccagttttgaacgtaaattcaacatagaatatcctaccgcgtgttgtactgcatgaccgcattcgtgagcagctactgccgctgccgctgcgtttctctgcatataaactgcctcagaaaggttaactgttttatctgccggattatagtggtccgtcaactgcccgggtactgatattacctgaacatcatttatcccgttatctctcaacatcttttccgctacttctttccccgaaaggccatttcgaaggtgtacattggaataatattcaaatttcgatttcaatctggaagaaacccaccagctcaccaacattgaaataccaataatgatataataacccaccattttatataaattttgtgtttaaattttacccataatcaaataaaaactgtgccaaagtatacaatattattatttatatttgtcctttaattcttctcaaaaaacatgtctacaatttcaattattgaagtaaaaactgcgggtcagctgaagcaattcgtaagatttccaatggatctgtataaaaacaatccatactatgttccgtcctttattaatgacgaaatcaacatttggaatgctgatgaaaatcctgcccttcaatattcggaggccagacaatatctcgcttacaggaatgataaaattgtagggagaattgcagttcttattaaccacaaagaagagaaagagttaggaattaaaaaagtacgctttgggtggatcgactttattgatgatgctgaagtttcaaaagcattaattcagaaagcggttgattatgccagagaaaaaaatattgacaaaattgaaggtcctatggggtttaccaatcttgataaagccggaatgctgataaaaggtttcgatcagctggctacaatgatcggaatttacaaccacgaatactatccgaaacatctggaaaacctgggattgaccaaggaaaaagaatgggtagaatttgaaatcatcttccctgaaaccctgcctgaaaaaatccataaatttaatcagcttatttccgaaaaatacaagctgaaagttttaaaattcaaaacaaaggaagaaatcattcagtatgtgcatcctatgtttgatcttttggatgaaacttacaaacacctttccacctacactcctatttctgacgaacagcgtaaaacctataaagagaaatatttcaaactcattgacaaagattttattgtatgcattgccgatgagcataacaatctgatctctttcgcgattacgatgccttcctattccaaagcccttcaaaaatccggtggaaaactgcttcctttcggttggtggcattttttaaaagcaggaaagaagaatgacagagccaacttctatctgatcggaattcatccggattatcagagaagaggtgtgacttctatcatcttcaaagaaatctgggatatattcagaaaaaaaggagtcaaatatctggaaaccaaccctgaactggaagaaaacaaaagtattcagctgttatggcaagattataatccggtaaatcataagagaagaagaacctattctatggaaatcaataactgatgctgtattttgtaccaggtaataatttaaaatctaaaaatttatgaaaccacagcttatcatatttgctattttaattgtaggatttatcagttacaatttcttttttcagtcaccggatgataaaacaaatacagtaataaatattctttttgccagtattctttttgggtatatttcatttatggcttacactctcttgaaaaaaatgaaaaaataaaagcagtgcttttaacaagttattttgattggtagtaatcattcaaaataccctcaatatacctgacagaatgtattttttcatattcgctacaaaaaacgggaaaaaacccggcaaaaaacgatgacaaaaagctaatttttattgattctaaattactgatttaactcattttcatcctacttttaagctgataaatttcatgctttcttgtttattcgctaaatttgcaaattgagataataatgcaaaaatgaatttacctgaaagttatattccaatccttatccaggctggtgtagcagtaggatttgtagcggtttctttgcttggtgcacatttcttaggtccacagcagaaaaaaggaaactctgtaaaaaaccaaagctgggaatgtggggttcctgtagaaggaaacgccagaacaccgttttctatcaagtacttcctgactgcggtattgttcgtactattcgatattgaaatcgtattcttttatccttacgctgtaaatttcagagaattcggtatggaaggattccttgccgtacttacgttcgtagccatctttttcatggcgtttttctatgtatggaaacgcggtgcattagattgggataaataaattttaattaaaagattcaatgtatttaagtaaattgaagattttcaagatcttattttttaatcttaaatattttaatctttaaatatttactaaaatgtcagataaaaaaccagtaataagaacagatgcacctgctcctgaaggctatgaaggagaagggtttttcgcaacgaaactgagcagtgtaatcgggatggcaagaaagttctcactttggccgttaccatttgcaacctcttgttgtggtatcgagtttatggctaccctgaacccgacttatgatgcttcaagatttggaatggaaagaaactctttctctccaagacaagcagatatgctgatggtttgcggaactatatcaaagaaattgggaccagtcctgaaagaagtgtacactcagatggctgagccaaaatgggtggtagcagttggagcctgtgcttccagcggtggtatttttgatacgtattctgtacttcagggaattgataaaattattccggtagatgtttacgttccgggatgtcctccaagacctgaacagatcattgaaggtgtaatgcaggtacaggctctggcagaaagcgaaagcatcagaagaagagacatgcctgagtatcagaaattattagattcttacaacataagcaactaacggaaatgacaaacgaatttgtattagaagctatcaccagagaatttccggaatctgtcatttcaagctctgagccttatggaatgctgacgattgaagtaaaaaaagaagatattaagaaaatcattcactatcttaaagattcatctctggaaatcaatttccttacagatatctgcggaattcattatcctgagttcccggaaaaggaaataggtgttgtctaccatttacataatatgatgaccaatttcagattacgtctgaaaatcttcatgtccagagaaaatattgaagtagattcccttacggatctatatgcgggagcaaactggatggaaagagaaacttatgatttctatgggattaaatttaaaggacatccggatctcagacctattctgaatatggaagatcttggataccacccaatgttgaaagaatatcgccttgaagacggtacaagaaccgacaagaacgatagtatgttcggaagataaaaaagcgaatggccaatggcagctagccaatagccaaaagcaaatagctaaaagcaatcattatgaaagataactcattatctaatatactaaaccagtacgatagtaaggaacagattgacgggcaattatataccctgaacttaggacctacccaccctgctactcacgggattttccagaatatcttaacgatggacggagaaagaatccttcacgctgaacaaacagtgggatatatccacagagcatttgagaaaatttctgaaagaagaaactattctcagatcactacccttacagaccgtatgaattactgttctgcacctatcaataacttaggctggcatatgacagtagaaaaactgatcggcgtagaagttccaaaacgtgtagattatatgcgtgttatcctgatggagcttgccagaatcggtgaccacctgatctgtaacggggtaaccggaatggactcaggagccattacaggtcttacctatatgttcatcgaaagagagcgtatttacgatatgtatgagcagatctgcggagccagaatgacaaccaatatgggaagaatcggaggatttgaaagagatttcactcctaagttccatgagctgatcaaggatttcttaaagacattccctccaagattcaaagaattctgtaccttattggaaagaaacagaatttttatggacagaactatcggtacgggagcgatctccgccgaaagagcattaagctacggtttcacaggtccaaacttacgtgcagcaggtgtagattatgatgtaagagttgcacagccttattcttcataccaagacttcgactttattattcctgtaggaacttcaggagatacttacgaccgtttcatggttcgtcaacaggaagtctgggaatccatcaaaattatcaaacaagcatacgaaaaccttccggaaggaccattccatgcggatgttcctgatttctatcttcctgaaaaggcagatgtctatcagaaaatggaagcattgatctaccatttcaaaatcgtaatgggagaaactgatgtaccgaaaggagaagtttatcatgctgtagaaggtggaaacggagaattaggtttctatcttgtgagtgacggaggaagaagcccttacagacttcacttcagaagaccatgcttcatctactatcaggcataccctgaaatgattacaggttctgtaatttcagatgccattgtaacgatgtgtagtatgaatattattgcgggagaattagacgcataacattgtaaaaagtaccattgtaaaatgtattcatgattttacaatgatcaaataaataagtcattagtacattgtacactgtacaataatacattaaaaaaaatgagcgaaacaatagcttttaaaccggaaagtttagcacaggtacacaaaattatcgcaagatatcctgaaggaagacagaagtctgctcttcttcctgtacttcacctggcacagaaagagttcggaggatggttagatgttcctgtaatggattatgtggccggactgttaagtatcaaaccgatcgaagtatatgaagtggctactttctatacgatgttcaatatgaagccggtaggtaaatatgttctggaagtttgcagaacaggaccttgcatggtttgcggaagcgaaaaaatcctggatcatatcagaaccaagctgaacattaaagacggagagactactgaagacgggatgttcacattgaaacctgctgaatgtcttggagcatgtggatacgcaccgatgatgcaactggggaaattctttcatgaaaatttaacgatagaaaaagtagatgaaatccttgatctttgcagacagggacaagttgctttagactaaataaattttaacacattaaaaatagccataagctaaaagccacaagccaatagctgaacgctaaaagcataataaacaatgagtaaaaaacttttacttaaagacgcacatatagaaggtatccgttactttgaaacctaccgtaagcagggaggttacacagcagctgaaaaggccttgaaaatgactcctgacgaaattcttgaagaagtaaaagcttcaggattaagaggtcgtggtggagctggattcccgacaggaatgaaatggagctttctggcaaaacctgaaggtgttccaaggcaccttgttgtgaatgcggatgaatctgagcccggaacattcaaggacagatacctgatggaattccttcctcatttattgatcgagggaatgctgatttcttcttactgtttaggttccaatacttcttatatctacatccgtggagaatattcatggattccggatatccttgaagaagctattgaagaagccaaagcagcgggatttttaggtaaaaatattttaggaaccggtttcgatcttgaaatctacgtacagagaggtggtggagcatacatttgcggtgaagaaactgcattgcttgaatcccttgaaggaaagagaggtaacccaagattaaaaccaccattcccggctgtaaaaggtctttgggagagaccaacggtggtaaacaacgttgagtctattgcggcagtggttccgatcattgatattacaggtgctgaatacgctaaaatcggggttggaagatccacaggtaccaagctgatttctgcttgtggaaatatcaacaaacctggtgtatacgaaatcgatatgacgatcactgtagaagaatttatctattctgatgaatattgcggtggtattaaagatggtaaaagattaaaggcttgtatccctggaggaagttctgttccgattgttcctgcaaatctattgctgagaaccgtgaacggagagccaagatatatgaactatgagtcattggcagacggtggtttcgctaccggaaccatgatgggttcaggaggtttcatcgttttggatgaagaccagtgtattgtagaacataccatgactttggcaagattctacaatcacgaaagttgcggacaatgtactccttgccgtgaaggaacgggatggatgtacaagattttaaagaaaatcgagaaaggagaaggaaaaatggaagatatcgatctgctttgggatatccagagaaagatcgaaggaaatacgatttgtccgttgggtgatgcagcagcctggccggttgcagcagcgatccgtcacttcagagatgaatttgagtggcacgtgaaaaacccagagttgtctcagacacaaaattatggattggcacattatgcagatcctatcccggctgtagaaaagaacgcatagttgaaatgaaaaaattgttggttgtcggcttaatgatgtcgagttttgttttcggacaaaataaagagaaggattctttaatagatagaagttctgataaaggagcattggtttccagaaagaaaccggaacctttaagcaaaaaaggtcagatgttcgttttcttcggatggaacagagcagctttcagtaactctgatatccgtttcacaggaaatggctacgactttcagctgaataatgtatctgcacaagacagacctaccaagtttggtattgtttatatcaatccgggatggtttacagtggttcagtacaacttcagagcgggatattttattaaagataacttagccctggttttaggaatagaccacatgaaatatgtgatggatcaaaaccagaccgtaaatttcaaaggccatatttcagaccctgaatatgcagcaatggtgcaaaacggacaggtgaacctggcagatgagaagttccttacttttgaacatactgacggacttaattatgaaaatttaggtcttgaaagatatcagaatctgatcaataagaaaaatgttgatctggtttggtcttatggagccggtatcggattcatgttcccgaaaagtaatgtaaagcttttcggaaatgaaagaagcgaccgttttcacgtggcaggtatgggtacagacgtaagagccagtcttaaccttgttctttgggaccatgtaatggtaagattagaaggaaaagcgggttacatcaatatgtgggatatcaagactacattgaataataagccggacaaagcccaacaggatttcgttttcggacaggtccttgcaggaatcggatatacatttaatactaagaaatataaataacaaagcctattgcttaatgcataaagcttaaagcatacaatatgagcgaagaagttaaaaaattcaaaataactatagacggacagactactgaagtgttgccaggaacttctatccttgaagctgcaagacaaatcggtggtaaatctgtacctcctgctatgtgctactacagcaaattagagaccagtggagggagatgcagaacttgtctggtagaagtttctaaaggatctgaagcagatccgcgtcctatgccaaaactggtagcaagctgcagaactaatgtaatggacggaatggaagtaaaaaaccttacttctgagaaagctcaggaaggaagaaaggcggttactgaattccttttggtaaaccacccgctagactgccctatctgtgaccaggccggagaatgtcatcttcaggatttaggttatgagcatggtgtagaaaatacaagaacagaattcgaaagaaatacttacgaagccgatgaccttggtccacacatcaaattgaacatgaaccgttgtattctttgtgcgagatgtgtattggctgccaatcaattgacaggtgaaagagaacacggtatccttttcagaggagatcacgctgagatttcaacatacctaaataaagctttggataatgactttatcggaaatgttattgatgtttgcccggttggagcattaacggacagaacggcccgttttgccagcagagtatggtttacaaaacctatgaacgcttcctgcaaatgtgataaatgttccggtaaagctgtagtttggatgaaaggtgacgaaattgtaagagttaccgcaagaaaagatcagtggggcgaagtggaagaattcatctgtgatacatgtcgttttgagagaaagtcattatcagactggaatatcgaaggtcctagacatatcgacagacactctgtaatttcattgaaccactacgaaaagccaaaagacgagctaagagttttagacaatccgatggcgaaagaaatcagtgaaaaagacgaaaaatagaatagttggaagttaggaagctggaagctgggagcttaataaataccctaaatttcagttttaattttagctgttttaataatatataaaaaatttggtaatgtgatgaagagttgatgccacgatgtgataaacttccagcttccagctcccatcttcaaacatttaaataaaaaatggatttacttacatttaaacttatacttgtactagcacttttcctgctatcactgacgattgccgcctactctacctgggcagaaagaaaagtagcctctatcatgcaggatagaattggtccgaacagagcgggacctttcggattgctgcagccgcttgctgacggtggaaagtttttcttcaaagaagactttacacctgccaatgcagaaaaattccttttcgtattaggaccagctttggtaatgtttatttcattgattacaggagctgttattccatggggtaaaagtttaaatattgcaggtacttcttttgatcttcaggtggcaaacatcgatgttggagtacttttcatcatcggaatggcttccattggagtttatggaatcatgatcggaggttgggcttcgaacaacaaatattcattattaggtgctatccgtgcttcttcccagatgatttcttatgaattggcaatgggattagcgcttctttctatcattatgatgtcaggaagtttagacttaaaagaaatcaccgaaagtcagactaccggcaaattatggggtgtaattccttgggtttccggattgaactggaatattttctaccagccggttgctttccttgttttctttgtagccgccttggcagaaaccaacagacacccgttcgatttacctgagtgtgaatctgaattggtaacagggtactctacagaatactcttctatgaagttaggattatatatgttcggggaatatgtgaacatgtttatctcaaacgctttcatggtagttcttttcttcggaggatacaactatcctggtattgagtgggtaactcagaactggggagaaaacacagcagggattttaagtattgtagcattccttacgaaaacagtaattggaattctgatcttcatgtggatcagatggacacttccaagattcagatatgaccagttaatgcacttaggatggaaaacattaatcccaatggcattggtaaacctgttaattacaggtgctgtaattttagcgttccagtaaatttgagatttgatgtttgaaatttgagattcaacgaattgactttaaattagtaattttaagagtaataatttcaaatatcaaatacatggcaacgataaataattttgaagatttagaaatatggcagcagtcaagaagtctttgccaattgattcaaagagaatgtttattgaatccaaaatttctaaaccatgtaaaaaccagattgacaggtcatctgcatcaattatggataatatagccgaagggtttgaaagagaaggtaataaagaatttataaactttcttaccatgtctaaaggttctgcaggagaagttcgttctcaattaatcagagcttttgaccgaaattatttagatgaagaagtttttatttttttaaaaagccaaacaatatctttatctaaacagctgtcaggatttataaattatttgaagatgacagaccacaacggaaataaatttaaaagaaataataattaataattaaaggtttgagagataaaaattttgctaataaatttcaaatctcaaacttcaaatttcaaattatataatgaaattaactaacagatcaaaagttgtttccaataaagaaatgacccttgctgaaaaaatctacctgcctgcgatctttacagggatggggattacatttaagcatgctgtaagaaccgtgataaagggtgctcccgcagtatattcgtatccggaagtacagaagccaagaaccaccatctggagaggccagcacgttctgaaaagagacgaggaaggcagagaaagatgtacagcttgcggactttgtgcggtagcttgtcctgcagaagccattacgatgactgctgctgaaagaactaaagaggaaaaacatctttacagagaagagaaatacgcttcagtatatgaaatcaatatgctgagatgtattttctgtggtatgtgtgaagaagcttgtcctaaatctgccatctaccttactgacagattggtagacgtagaaaccaacagaggttctttcatttacggaaaagataaattagttgaaaaaataaatgaaaggattgatatcacgacaagacaatccgagaaacaaaaaaatgcggtaaaataatggatcagtttttatttttcttggtggcgtttttagcagtggcaagtgcggtttactttgtatttgcaaaaaatcctttatatgctattttgtcattaattgttacaatgttttcaattgccggaatgtacattcttctcaatgcacaattccttgcaattatccagattatagtatacgcaggtgccatcatggtacttttcctttacatcttaatgatgcttaatcttaataaagcagacgaaagtaagaagaacaatactttaaaatttgttggagtttttactgcagggcttttattaattggagttttaggggtattcagagggattcaggacaatcacattgttgttgaaaatgtagacagaggggttggtcttacgaagaacctgggtagacttttgtttaatgaatatgttttaccgtttgagcttgcttccatcctaattctggcaggtattgtaggcgcggtattaatcggtaaaaaagatttataaaattatgggagaagtaaatacatttatacaaagcatccctttggactacttcatcattctttcatcagtattgttctgtctgggagtaatgggagtattgcttagaaaaaatgctattgtgattctgggctgtgtagagcttatgctgaattctgtaaaccttttattggcagccttttcagcatacaaaggcaacggcgacggacaacttttagttttcttcattatggtggtagctgctgctgaagtagcggtaggtctggcaattattgctatgctgtatagaaacacccgttctgtagatgtgagtatatttaataaattaagaggataagaatggagaatctagtatatgcaatagtacttttaccacttttagggtttcttattaacgggctgttcggaaaaaatcttccaaaaatattggttggatctctggctactgcggtagttttcggatctttctgtatcgcggtaagccttttcatgaatttcaattctgaaagccagcctgtcattgtaaaagcttttgaatggtttagagtaaacggagttcagatcaattttggattccagattgatcagctttctttaatgatggttatgatcatcacgggtatcggttcactgatccacttatactctatcggatatatgagtcatgataaagggttctacaagttctttacttacctgaatcttttcatcttctccatgttacttttggtaatgggaagcaactaccttattctgttcatcggatgggaaggtgtaggtctttgttcttacctgttgatcggattctggtataccaacgaagaatatggtaaagcagcaagaaaagctttcatcatgaacagaattggtgaccttgcgttattgatcggtatcttcatgatcgcttctcagaccaatgctgtagattatctttctgtagcagaaaacgcttcaaaatttgaattagacggaacagtgatcatctttatcacagcgagtttattcatcggtgctaccggtaaatcagctcaggttccattatatacatggttaccggatgcgatggccggacctactcctgtatcagcgttaattcacgctgcaacgatggtaaccgcaggtatttatttagtagtaagatctaacttcttatttactttggcgcctaccgtacagggagtaattttattcatcggattcttaacggctgctttggcaggattctatgcacttcgtcagaacgatatcaaaaaagtattggcatactctactgtttcacagcttggatttatgttcattgctttaggtcttggagcatatacaacagcaatgttccacgtaatgacgcatgcattcttcaaggctttattattcttaggcgcaggttctgtaatccacgctatgagtaacgagcaggatatgcgtttcatgggaggtcttaaaaaatatattcctcttacgcacgctacattcctgatcggaacattagccatttcaggtttccctttattatcagggatgatctctaaagacgaaattttagtagcagctttcgctaaaaaccctgtttactgggtaatcctatttgttttagcggcaatcactgcaacatatatgttcagactgtactatcttacattccacggagaattcagaggtactgaagaacaaaaacaccacttacacgaaagtccttcaaatatgacattaccattgatcgtattggctgttctttctgtaatcggaggttttattaacctgcctcacttcatcggtcatggtcactatgccaaactgatggaatggttaaagccagttcttacagaacaaagctatagccagatggaagctactctttcaggagtgcctttcaacactgaaatgatcttattggcagctacagtaattatgttcttctctgtttggtttatcgtaagaaatacctacgtgaaaaagaaaaaaatggctgtggcagaagaaagctataccggatgggagaaactttctgctaagaaattatatgtagacgaactttacaacgcattgattgtaaaaactgttgaaggattaggacgcggaggaaaaatgtttgataagggtatcttagaccgttttgtaaactttgtaggtgatggagctgaagacagcggaaaagctatgaagcgtgtacagaacggaaatgtagagacatatatccttatcatgtctttagcggtgggaattatattaattgttaactttttattacaataataatgtcttgtttgttattaacattattactattacctctagtaggttcgggattagtttttgcctggaagaatagttccagcaaatatttggcgcttggaattgcattggtacagatgctccttaccttctatatgctttcggatttcaattttggaccgacagtagacagtaagcttcagtacgaaatcacttatccttggtctcaatttattaaaagtacgcttcatttcggtgttgacggaatgagtatgctgcttttattactgaccaatattctggctccaatcatcattttatcatctttcaacgaaaatgtaagctacagaaatacattctacggattgattctgctgatgcagttcgggcttgtaggagtgttcacttctttagacggattgttattctacattttctgggaagtaactttgattccaatttggttcattgccggactgtggggacaagaaaataaaaggttcgaattcactacgaaattcttcgtatatacatttgttggatcattatttatgttagccggactgatctatgtgtacaatcactctgcatcattcgctttaacagatctatataatgcacaactgaacgaaacgcagcagactgtggtattctggttcatcttctttgcatttgcagtgaaattaccggtgttccctttccatacatggcagcctgatacctatacctactctcctactcagggatcgatgttattatcagggattatgcttaagatggcagtatatggtgtaatgcgttacttacttccaatcactccgattccgattgccggaatttccggacagattgtaatcatccttgctattgtgggtattgttcacggagctttgattgccatcatccagacggatatgaagagaatcattgcttattcatctttctcccacgtaggattgatggtagcgggtatctttgcttctgcagtagttactttaagaggaacattcaatgttgaaggtgctgaaggagctttggtacagacttttgctcacggtattaacgtagtgggattattctactgttgtgatattttatacaagagatttaaatcaagagacatcagacaaatgggtggtttagcgaaagtagcacctaaatttgcagtgttgttcctgattatcatattaggttctatgggagttccattaaccaatggattcatcggggaatttattttgttgaaatcggtttatgattttaacggaacagcggcagtaattgctggtcttacagtaattctttgtgcagtatatttattgagattctacggaaaagcaatgtttggtgaaggagatgcagcagttctaagtacagcaaaagatttatcaggtgtagaattttctgtattggcaagtttagcggtttttgtgattttacttggtattttcccacaaccggtaattgaaatggtgagtagttcggtgaagtttatctaccaatcaatggtaagttaatttgatattttaagaaatgagtgttttaattattgttttcctaacggcagttattgcgttattttcaggagtttttgaacaaggaaaattcgcaagatacattgggattttgggattaatcatcgcattgtacgtaagttttatgccggaatgttcgttcttcgatcattacaagcatatgtatgagtacagtggcaatactgcattattcactaaaatatcaatcgtaacgactttattattattcttccttggaggttttgctttcagcaatcacagaagccaccagtcagaattatatgcattaatgctgtttgcattatgcggagggattatccttttcggatatcagaacctggtgacgatgttcttaggagttgaaatcctttctattccattatatgtaatggctggagctaataaaacggatctcagatcaaacgaagcttctatcaaatatttccttatgggggcttttgcaacaggttttttactgttcggtattgcattcatctatggaagtgcgggaagttttgatctttacaagattcatgattttggaatagccaattcaggaaatgtaatgttcatcttaggagtattattgattctttgcgcattggcatttaaagtagcattagcccctttccatatgtggagtcctgatgtatatgcaggttcaccatcattaatcacagctttcatggcgagtgtggtaaagatctccggattctttgccctgttcagattgatgacacttggttttaccggagttacacacgaatggatcaatgttttaggagtattcctaatcattactttacttttagcaaacgttatgggtcttgctcagacaaatgcaaaaagaatgttagcttactcttctgtatctcacgcaggatatatcggattggtattcttcggaatgacaagcctttctacttataacctggcattctatttatttgcttattctttatctacagtaggcgttttcatgtgtctgatctgggtagagaaattaaagagagaaacttctttcggagcattcaaaggattggcgaaaactgaacctttattagcaacagcagcaacaatctctatgctttcaatggcaggagttcctttaacagctgggtttatggggaaatttgctttattctcccaggctatgaatggtgcagctttccttgtattggtagcagtattaggttctgccctgtctatcgcttactatttaagactgatcatcgcaatgttcttctttaaagaatcaacattcaaatcatcagaaaaagtaacgcttacttacaacatcattgcagtagtggttattgctttgattataaccctgggaattttcccggatctttttgcaagaatgttcggaatgtaatatctgaattcacaatatcaaaaagcacaactttcagttgtgctttttttattttagattaaacaataatatttattgtcccaaaaagctataaaatgcattaatcaataatttagttatatgtctttttaaaaaacaacaaaaaattacaaaatatgttgtgaaatttcaggaagcaccgttaaattatgcacaataaaataacatagctatcctagtaatattccgcttttttcataactttacttttaaatttcagctcttggctaatctctataaaaaagactccccttttcaggtttatatatcattcaaaaaatatttggatgttctggagcatatccgatataatgacagattggaatacagggtgaactatgcagagtctttgattgagagtacaagaaactttaaagagttcagggaaggttttcaggacacagcgctccttgaaaaatatgaagacctcatcaggcttcttcttgccgatctgttcccaacaggacttaccaaaaatgagataaaagcggccagcattcctctttccaatattaccttcaattataccgaaaggtttaaagacattctgaaagacgcagggaaagacttcgaaatagagctgagaaatatttcagataatgaattttatgtgttctgctgctgcctgattcttcagagctatttcaaaaaggatattaaaagtacaatcccgttttattatgatattcccaacaaacagggaatcatgaaacattacaagattactgttaattcagattttactgaaattatccctacagaagacgctaagattccatctgatgatattctggacatgcttctggaaaatctggacgattttaaactgtggaaaaaatactttccttctcaatcctggatattaaaaggatttacgattatttcactggtagactgcacttctgaagtggctctttctgatctgaaatcaagcatgatcgaaattgatcccgaagatttgaatcctaatgaaaatcttaccgaaatctttaaatcctattttgatgttccggaactaagctttggattgatgaccttcaacaagaaagaacagaagctggataaacttccgatttatgagagtcttctcactaatcatattctcgatttctggatcaatgcctttgatgaagaaatccgtaagagcacttttaataaccttaatcataattcgaaacctgttgttgtttccaatgtcaacaatcttgatgaaagtgttaaaaaactgccttctttcagtattttaaaggataataatgtcaacagtttcatggtaatacctatcatgaaagacggtgagcttctggccatcatggaatttacgtctcctattgccggcagctttaatggcttaaagcttaaaaaacttgaatttttcaccgatatggttcttttctccctgaacagattttattttgagaaaaattatcagatagaagccattatacagcgtgaatataccaccatccatgacagtgtggtttggaagttcagaaatgaagctgaaaaatattttacggcatcactgggaaagaagatatatactttaaagcagatttcatttaaaaaccttacgccattgtttggggtttcggatatccgctcttcgtcagaaaaacgttttaatctgatgctgcaggaccttaaccagcagattgaatcactgaacgaaattttaacgcttaccaattcagattcagaaaagtttctgctggcactggatgtttttgaaaatgaactcaacaatgaaataaaagctgatacggaacaacgttttcagagattgctgagggaagaaattcatccttttttacaggggaagctggaaattaaaacctccagagccataaagtcaaagatcaaagattatttttcccaaatcttttcatcaactgagctgttttacagctatagaaaaaaactggatgactctattacgctggttaaccgtaagctggcagatatgctggacgaaagccaggtaaaagctcaggaaattttcccgcattattatgaaaggttcaaatcagacggtgtagagcataatctgtacattggccctaccattgcacctgatcttcactatacttctaaagttgttcataagctgagatactggcagctgaaaaccatctgtaaaatggaacttgatttccagtctttcaaaaaggatcttcctatacagctggatattgcctctctcatttttgtatacaatgaaaaaatagatatccgcttcagaatggatgaaaagcgctttgatgtagacggagcgtacaattcttattatgagattattaagaagcgtctggataaagcccatattaaagattcttcggaacgtattacagcgcccggaaaaattaccattgtctatttcggaatggaaaaccagaaggaatatctcgactacatttcaaaacttcagaaaaaaggggttttacaacatgaagtagagtttttgagggttgaagatcttcagggaattacaggattgctggcactgagggtttcttttactcttccacaggaataaaaaatccggaacaaaaattccggatgtatttatattgattttcaagaaaattgatcttgaatgctgttaaagacttagaaatgccactccaaaggataaaacagaaataataattcctgccataaaaattttataggtaatagataaaagtttatactttctgttaagaacttttccaagataatataaatctttcaccatagaatcgtagatgtaatccctgtctttgatcaggtctttcatggcgttgtgataatcatcgaataacatctgctgaaagtttccgaagaaaagaagattcacttttctgttgacaatatcctgagaagtaaatgtagtttttgtcacattcggttttgtggacagaatcgcaaagataatggtcagtacacttgacagcagtaaaataaagctcggaagaatcagatgcgaatttttaggagcatccagcttcggaaccaatacggaaagacatactgaaataataatggcatttacagataaaagaatattggctttactatctgcaatatcgctcaatcttgtatggttattaagtgttaccctgaataaggtatctacacttctgtctgatttttctttgtcttttttaccttctgagttatcctttttactttcctttttttcctcctctttttccagtttcttttctatctttttgatgtttttctttttcaaaggctcccagttttctttggcataatcagtataaaaagtatgtttgtttttcagcatatcaagatttcccgcattccattcttcattggaaaaacatcttacattggtcagctcccattccttcctcaaagcatcagaaatatcagtataatcatgtcctgcaaaatgactgaaatctgcatcttttacaattttttccagtaagttctgaggttcatagtgtattttcgtagccagaatcagcttttcaacatcagcaatataactttcaggataattttcctgctgcaaaaaagccttcattacttccacacttcgctcctcatgattcagagcacactctatataccctgtatcatgaaaccatagcgcaacgagaaccttctcctgatcttcttcagaaacaggggtgttcttcataatttcttctgccttatttaccgtataggcagtatggataaaattatgataaaaatataccgaagataacttatctttgaataagatttcaacataatttttagctttgtctagaatgttcattcctgaaattttgttaatgtaaatttatgaatttatcctttaaaactcatcttaaaaatacttctattgttctgagaacagtaatgtccgcaggagtcctgtattcctgttctacatataacgtacaaaagggcaaaaacttatttgaagtaaaagattccgaaataaaatcagaaaacgattttaaactttttctgattggagatgcaggaaatgcagatgaacctcaggcacaaaaaactctgaatttactgaaaatcaaactggattcagcagatagcaattccatgctgatctttctgggagacaatatctatcctaacggaatgcccaaagaaacagacaaagattatgcattagcaaaacagaagctggaaaaccagttagccattacaaaaaactttaagggaaaaacactagtcattcctggaaatcacgactggtataacgggctggagggtttaaatgctcaggaagggctggtaaaaaaatatctcgatgataaaaaagcttttctaccgaaaaacggctgtcctattgatgacatcaacgtttctaaagacattaagctaattgccatcgatacagaatgggtgattgccaactgggataattatcctggaatcaacaaaaactgtaatatcaaaacccgcgaagatttttttacagagtttaaggatcttattattaaaaatcaaggtaaaaaaataattgttgccttacaccatcctatcatcagcagcggaactcatgcaggttttacctctgctaaatctcacctgtttcctttaaatagtaaagtccctgttcctgttgttgcaagtgtgatcaatattttaaggagctcatcaggagcaagcccggaagatattaacaatcaacattacgcagatctcgccaaccggctgaaaagtattgtacaggataaggaaaatattattttcgtatcaggtcatgatcataacctccaatatcatgaagatggaaacctgaggcagatcatcagtggtgctggctctaaaacagatccatccactattgtagaaaaaacagacttctcctacggaggcagtggttttgctgttttaaatttcagaaaagacgaaagcacagatgttgagtatttttcaacccgggatgccggacttcaaaaactgacacatatttccgtgatttcaaaaccggatgtatttgtcaataactttccaaattcatttccggcaactttctcttctactatttatcctgtacagcttacagaaaaaagaaaattttacagatggctctggggagaccattacagaaaatattatggaatcccgattgaagctccaaccgctaatctttcagaactgaacggaggatatattcctttcagagaaggaggaggaaaccaatccaacagtttacgtctgaaatctgcagacgggcaggagtttgtaatgcgtggtgtaaaaaaaagtgcgatccgtttccttaacaacatggctttccagaaaagcacattaggagaagagcttgccgatacatttcctgaaaaattcctgctggatttttacacaaccaatcatccgtttaccccttttacgattggaaacatgtcggaaaagctgggtatttaccacagtaatccaaaactgtattacattcctaagcagcaagctttgggaaggtataatgaaaactacggggatgagatgtacatgattgaagaacgtttttcttccgatccgaaaacactggcttatctggacaatgcaaaagatattgtctctacagatgatgtattaaaaaacctcagcaaaagcaataaatattctgtagatagagaatcttatatcagagcaaggttatttgatatgcttatcggtgactgggacagacattcagaccaatggaaatgggcagaatatgaagaaggcgataaagtaatctataagcctattccgaaagaccgggatcaggccttcagtaaatatgacggtgctgcatttaaacttatcatgaatgttcccgccatccgccatatgaaaacctttacagaagatatcagcagtgtgaaatggcttgccatggaaccttacccaatggatcttgttttcttgaaaggagcggatcagggtgaatgggaggctcaggcaaaatacatacaggagcatcttaccgatgcggatattgatgatgctttccataatcttccgaaagaagtacaggacgataccattgcggaaattcagagaaagctgaaaataagaaaaacaaagcttcagacctatgcagctcagtattatgatgtactgcagaaaaaagtacctctggcaggaactgtaaatcctgataagtttgtcattacgaaaaacggacattctgtacttgtgcagcaatataagctgggtaagaataaagataagaatgagctggtttttgaaaagacttatcatgattcgaaaacaaaagaattgtggatctatggactggaggatgatgacatctatgaagtaacgggaacaggaaatccaaagatgaatatcaggctgatcggcggatataatcatgacacctatactgtgggtgatggaagaaaagtgaagatttatgattttaaatctcagaaaaacacctataacgccggtaatgcaaccaagaatattacggatgattatgacattaacagctataattataaacatcctaagtataattctgtagcaggatatccaaatctggattacaacccagatgacggtgttattgtaggcgttctggctaattatacagtaaacaattttatccgcgatccttttactcaaagacatagcttaaaagctaatttttatactgccacagcaggattcagccttacgtataaaggcgtatttaaaaaagccatctcaggttgggatatcaatctggatgcattttatacgactccaagattttctcagaacttcttcggactttccaatgaaagtgattatgataaagaaaataccgaaagggaatacaacagagccagaatttccaaattcaacttttctccttccatctcacagaaaagctggatgaatctcagccatcagttccaattaacttttgaagataataaagtgcagagaaaagctgaccgcttcatcaatcagtctccggatgtaagacctggtgtttttaatagccagcagtttgtgggagccaattatacatttggttataaaaatgctgataacgcagccttccctactcttgggctggaatttatgcttaatgcagactggaaggcaaccctttctgattttaataaaaactttgtgactctaaaaggaagacttgccgttgatcacagaattgataaaaaaggaaaatttgtatttgccaacgccagcaatgttatgtggatcaataataataactttgagttctatcaggctgctgctatcggaggcaacaacggaatgagagctttcagaaatgaaagattctcaggaaggtcctattttacaaataattctgagatccgatgggactttggaagaataagaaataatattgctccggcaaacatggggattcttatcggatatgatgtcggacgggtttggaatgataatgaaaattccaggaaatggcatcagtcagccggtgccggggtatggctgagtattgtagaaatgatgtctgcaaggttaaattatttctatggttcagatggcggaaggctatctgcagggataggaatgaagttttaaacacattcgtctgtaaagaaattattccaaacttacttttggattaaaatttaaattaatataaagtactgtttaataagattttaaagtataatttaaaataaatattaaaaaaatccaatttaaataaaatttaatatttcaaattttcaactcacattttttaatgataaaataaatatggcttttaaataaaagccatattttcagctatataggtcaaaaacacacatagtttaatatgattatcaattatttaaaaatttgacattttaaaaacattttatatttgctgcaacaaaaaaatcagcaaatgatgaaaaagaagctattgtatatggtattatttatcatattcgcaaacttaaatgcacagatagggattaaaacatcaacacctcaaaatacactgcatgtcaacggttcccttcaggttgttaaagatcttaatgtaggaggagatgacagaacaaaaggaaattccggaaacaaaggtgaggtcttaatgtcaaacggagcaggtaatgcaccagtttggaagaccattgaatctgaaaactttctgaaggtagtatttgttggaaacaagactgatatcagtccggcaagtggcagctatacgggaacacattctactccggtaagtactcacgaaagttattcacagacgtatatttttaatgtaagtaataaaattgatacagcttatttaacatataactcaaccactggacttttcacagtagtaaagcccgggttctataatattgtgccttatgcaacctatgatcttaatttaaatccatccggacagacggcaggtacagccaattcttatatacaaaaggtttctccggcacttacaacacttgcaggcatatctaccggtcatggcgaacgtacgacaggattgaatcataatctttcatccattaacttttttaatgcaggcgagaccttcagaatacgctgccgttatacccaggatttccggttatcaagtggtaatattcatatttcttaccttactccctagtctataaaacgtcaatcactttaatactttcatatatttaaaagccccgcagattttctctgcggggttttatttattttttataaagaaaaagtatacacatttcctccttcatctttccctttctcatctgcaatcattaatgttttatcatctaggaaaacaacagcttctttctgggaattatgattcaacggaattttctgaatcttggctgaattaaaatcatcagctgtaaatcctgtaagaacatgaacatttttatgggtcagcaatacaattttatctttagtactgttgatagtggcagatgtaatggctgcatcattataaccgccctgaagtttcaatgttcctaccagcttcgcttcaaaatcaccagctttattaggtacctggaatacaaggaaagttccgtcgaagcctttgcttctgtttttagtaaaaaggtagaaatttccattcatctcaacaaaagcttcacagtcataaagcagatatgattttttcggaggaaattccgtctgtccctgataatggaattttgttgtctgaacaactttggtaacagtttgtcgactgtcttttaaatctgtttttaagattgccagatcctgcctgttattatcattatttccaaagtctccaatataaatatttccttcaggatcggaaataatgtcttcccagtctgtattttccgcattttctaccggaatttttgccagcatatcgcctttatcactcagtccgtatattgcatttttatttcctctgtcttcaattacccagatcgttttcttatcttttgacaaagtaattccggaaacctccttcaactttttgggtaatgagaactgtatttttagttcatcttctttggcagaggaattctgagcttttgggttgcagctcattaaaagcaaagcaggtaacataagaaaacgtaacatatttattttttattttttattttttatttgaatgtaagaagcattaattgttccaatcgggaattatgaaagctttttcgctttttcccaaagaacatccatttcttcaagagacatatctgtcagtttcagattctgttcctctgcaagtccttccatcttttgaaacctagaaataaacttaagattggttctttctaaagccgaatccggattgattcctgaaatcctggagtaattaatcaaagagaaaaaaacatcaccaagttcctgttcttttttatccagatctgtctcagcatgaaactcctgaatttcttcatctaccttcttccaggcatcttctgcatcatgaaactcaaaaccgattcctttcactttatcctggattctgtaagcctttaccagacttggcagacttttcggaacacctcctaaaatagacttattcccttctttcagttttaatttttcccagttctgctttacttcttcttcatcttttacttcagtatctccgtaaatatggggatggcggaagaccagtttttcattcaaagaattgataacatctgcaatatcaaaactttctttttcagaaccgattttagcataaaaaacaagatgaagcaggacatcgcccagttctttctttatctcctgtaaatcgttctgcaaaatagcatctgaaagttcataggtctcttcaagggtaagatgacgaagggattctaacgtctgcttttgatcccacggacatttttcacgcaagtcgtccataatatccagtaatcttccgaatgcttctagtttctcttgtttcgtattcataaataatgggaaattcaatcttatacaaatgtaagggttattcgggcatcattacaaacgttggaagtaaaagttacggagtgcagtatttaggatagattaggtggtaaacctaataggtttcgaaaacctgttaggtttggaatattagcatgcaattatcttttgtctgaaaaaacaaaaaaccttgtccggaaattccagacaaggttttgtatttttaattcaaaaatgaattatccttgttttctatgtgtactctttggagctgattttgcagctgaagtcgcttttacttttggagcagctggcttttcagtttttggagccgcttttttagcttctttttcaatgcttacttcttctgttgcaggctcaccttctaaagtttcaggttctgctttcacaaagctttcaggagtaatatatccagctttttgaaggatgttgtaccactgagctaatttcttgatgtcagaagaatatactctttctgtatcatagttaggaagagatgccaacatgaaatctttcagttctgcttcagaagatttgtgagaaattgtttccttataatcattgttcttagcaatattttcaaatacttcaaacaagggaacttctttctcgaatgtaaacatggcaatattgtccagtaaacttacctggcttgagtttccaatgcttacttttttctttgatgtaacatcttcaataatgaatccgtttcttaattgagaaactaatttgaaaagtcctggttttccagaaattgaaattattttttctaacagcataattttattttttgtaaattctgcaatcagcactagctttttgcttttattattctttttaatccttgtttaaattattttggaaatctcattttgtaaccgatgtttacgtcaccctgagagatttttgtcagcttacctttcaccagtttcttcttcagagcactcaggtggtcagtaaacagaatcccttcaatatggtcatattcatgctgaattacgcgggctctaatatcggaaaaagtttctgtatgtttcacaaaattttcgtcataatattcaataacgattgtgccttttcttttcacatcttctcttacatccggaatagaaagacagccctcattgaacttccattcttcacctgattcttcaagaatctgagcattgatgaaaacttttttaaactctgccagctcatccttaatatcttcataatcctcatcttctgcaagaggtgtcacatctattacaaacagacggatatccaaaccaatctgtggcgcagcaagacctatgccatttgcactgtacatggtttcgaacatattatctatcagttcctgtaatccgggataatctttgtctatatcttttcctacttttctcaaaacaggatccccaaaagctcttatcggtaaaatcatcttaatctttgttctaaaaaattctgcaatatgatagttgcgcttactttatctattaatcctttttcctgcctcttcttcttattctttccactttgggaaataaaaaatgaagccatttttgaggtaaatctttcatcaaaacggtgaactgcaatatccgaaaattcttttttaaatgcttcaatgaattttaaaatatcggtttccacttctgaaatatttccttttaaatctatgggaagcccaatgactaccgcatcaaccttgttttcactgaaatattttttcaaaaattccatcaaagaacggttctctacagtctccagtccgctggctataatctgcatatcatctgttgcagcgatgccacaacgagcctttccgtagtctattgcaaggatttgtcccataagtctgcaaatttagtaaaatttactgattttattcataacgcagtttttttatgtaaatcatgttttattccattattttttttataattttaatcttccaaaaaacaattatatgaagaaactcatcctcgtaagacatgcgaaaagcgactggccggaggaaacggaggactttgacagacctttggcagacaagggtctggaggatgctatgcacatgtccagatttctgaaaagcaataatatttccattgactattttgtgtccagccctgcggtacgtgcactgaatacctgtaagatttttaatcagacctatcagctggattgttctactgatgaaaaactatataacccttcggaaagaagctttgaatctgtaatttatgacctggatgacaatctgaattccgttgcactcttctctcacaataacggaatttccaattttgccaattccatttctgaggatattttccattttcccacctgcggagttgccggttttgaagtagactgccaatcgtggtcagaatttgacggagccaaaaagaaacttctgttcttttatgagcccgggaaaatataactttacttttctgtttttttatgctgtcctatccgttcttcttttctcctgccagaaacagaagaaaccttactttgaatctattgcactgagtgatataaagctttctgcgtccccaaaacccggaagctggcggtataatcatgatgaacattttcagacatttgaagattttaaaaaatcaaaaaagataaagcccacacctggaaaaaatacgatttatcttcaacccatcggaacatttgatgatctgcagaaaaaagaaatagccctcacaaaagaatatttaaaactatatttccaactggaaacaaagatacttcctgttttacctaacagcattttccctgaaaaggttaaaagaatttcaaaagaagggcaggaacaaattctggcaagttatgtactggacagtattctgatcaaaaaaaacctaaggatgctatagcattaatgggtattacggagaaagatctttttccaatgccggaatggaactatgtttttggactcgcctcttatgataacggtgtaggggtaacctcaatatacagatttgctggcggccaattatcagattctaattttgatgaaagctttttaagattaataaaaatcagttcgcacgagattggacatatgtttgggatcagccattgtcttaatgccaattgcgtgatgaacggaaccaattcattaacggaaacagattatcatcttgccagagcctgttctttatgtcagagaaaactgagttccagtatacattatgacaataagaaaagacttcttgaactgaaaaacttctttgaaaggcagcatcttaacacagagcttactttagcaaatcaggatttaaatcttgtgcaataaaccaacatttcttttaccgactactcattcccctcctccggagaagtagcaaaaatattttttttaacaggtgataagtttcggctcctatgtttgcaaaagaataaatttacatacaaagcaaaaggggtgagagaacagttttggctaaataactcaggaagtatattgtgctttagaaatgtcctccaagtgaatcgtgaattttt

SEQ ID NO: 7 - DNA, 49202 bp, Chryseobacterium sp.
cagacagattttgaagaaagtagggtaaaaatcaaagaccttcaccctacgcaagctaactcaaggtcgcttttataaatataaatgtataaaaaatatttggaagttaacacagaatctaaagccatatcactgttaacaaaaaataggttcaaaccctttcctattgaactatatcagctttaattttttattagaatccgtgttatttgtgaacaaatttgcgccatttgtgtttagtcacaaaaaagaacggaccaaagcccgttctctataaaatatctctcgcgatttcgcctttttacctttagcactttcgcctatttattttctcttcaaatccaggtcatcaaaatcaaaactaaagtctgtcacatcagaaattgccttcaatcttgcagattctgcctttccgttttcatcataactgaaaataatataagcatcagcatcatagcttctgtcatcccacttaataatgaatgaattattggagtaaggaagcagctctccttttaatcttggagaattcttgcacgaaattctgtaggtatttccctgttgtgcaatttctacatcaccaaaccatacatcattgtatgttcctgtaaactgttctgctttgggctgcagtcctttttcttttttaaatgcttcagctttagcatacgcatctttcttttgtttattgaattcagcctccattttagacattctttctccataggttttcagccagtttctgtctgctacgccaagataagaatcttttaccgtattcgtaatggtattgaatgctgctccggactgctggtttgttaatactacaattcccagtttcatatccggaattaaagtaaactgggtaaccgttccgattaatcctcccgtatgctgtacttgcttgtgcccttttacatcgctcagaaaccatcctaaaccatatccgtaaaaacttgtatcataaggattttttgccgctactctgtccggaatctgtaaactccacaattgttgagcattcttatctgaaaccagtttttttccatctttagtggtgaaattatttagaaggcattcagcccatgtagtcatgtctttaatgttactcataattcctcctgcagcattggcggtttcgttccagtcatgaggaacagcaattgcttttccgtctacaggagcgtgcgcatcaattttattcgctacagcttttgctctgttgtagcttccaaaacttgaggtcattcctacaggtttcataattctttgctcaataaattcagcccagcttaatccggagatcctgtgaatcacttctccagccacaatgaacatgatgttattataatccagtttcgttctgaaaggattttcgggtttcagatatcttacattgtgaacaatatcgttaacagttaaatttcctccttccggaaagaacataagatctccctggccaagtcctaatcctgctctgtgcgtaatcagatctttgatcgttacattttgagaaacgtagggatcatacatttgaaactcaggaatatattttgaaactttatcgtcccagttcaactttccttcatctgccaggattgctaatgccgtacacgtaaaaccttttgagttggaagcaattcctaccaacgtattatcatccattggctgtttgctggtaagagaacgcacaccaaaccctttggaatagattactttaccgtcttttacaattcccaccgacattcccggtacatcaaaagttttcagggtattctggatcagttcgtccagctttttttcttctacctgcgcattgaccaatcctacagttaaaagaaaaatgaaaaaagaaagtttctgtttcattgtttattttaattttcccaaatttactaaataataagcgatgctaattttagccgcgttaaaactttacaataaatcagttgtattcatgaaaaagcctatttgtatctgtattttctccctttttgctgccaccacaattaaagctcaggacaaaacagccaatccattgctgttacaaacctggaatttgaataaaatggacacctatatttatacttatgaaaaacaggatggttttgaggccagaagagaaggaatcagatttcagaaaaacggaaagatcacaggaaatctgatcaaatctaccttaaaatatgatgctctggaagaacctgtgactaaaaatgaaaaggcagaccgctacatcggaagctggaaaaaagcttcagattctacagtgaccatagtatttccttccaataccaatatgacaggcacttttgttattacaaaacttacggagaatcagctgaaactaaaaaaggttttcagtgcggatatagaaaagaaaatggattctatccgaaaaacaaaaaatattacagagtaagagcctgactcagtttatgaagcttctttatatttgcaatcttaaaaatagtaaaatgacacgaaacagattattggccttcttcttactgatggtaagctgtaatttatatttttcgcaggacgtatccattaaagatgataaagttttactggatgggaaacagattctgaaagcagaaaagatcaatgcagcccagtattcctttttctctatgaaagatgatgaggaagttcttctttaccggtatatggataatgagacgccaaggtatgtaaatgatgattattttatcctgaattttctgactgaaaaaacaaaagtagaatcgacggatatgaccaaaatatccaattttatgaattcgaaaaaaggaatggaaaaactggtaaaatggttactgaaagaaagagtgatcaatcatgacggggaacttaatcctgagcgtgtagccatattcaaagataaatatcacgaaaatattactgaaagaacctttagataatgaccaaaatccttctcctctccgactctcactcctatattgatgacaggatcctggaatatgcttctcaggccgatgaaatctggcattgtggagatttcggaagtctggatgtgattgaacagcttgaaaaaataaaacctctgaagggagtttacggaaatattgacaatgctaaaattcaggcagagtttcccgaggttaaccgtttcttttgtgaaaaactggaagttctgatgattcatatcggaggatatcccgggaaatactcacctcttgcgaagaaagaaattgcagaacagcccccgaagttatttatttcaggacattctcatattctgaaagcaatgtacgatgagaaaaacaagcttcttcacctgaatcccggtgcctgtggaaaacagggctggcataaagtaagaacaatgatgcgctttgtagtagatggtgaagagatcagggatctggaagttattgaattggggccgagggtgtgataagggaaagcacgtgaaagttcgagtgttggagagtttgagagtaaaggagtttgttttttataccttttactttctacctttgtacaataattgactcagaggagacttgaaaaatatgaaaatcggcgataaggtttcggtagtagatgaagatttaaacggaatggtaacttccgtgaagggaaatattgtcgtttttaaagatgaatatggctttacccatcagtaccccaaagaaaagctggttccgaaagatgctgatctgtatgaaaatataagaattgtaaggaaagcagaacccaaaaaaattatttctaagaaacatcagaaaaatcatttggttctggacctgcattttcataatttggtaaagaatcccaatgactatgacagctttgaaagactgtttattcaaaaggaaaagctgattgaagtactggagttttgcaggaaaaataacctgaagaggctggaaattgttcatggtattggtgatggtactttacagcggatggttcgggatgtactggaaagccaggtcaatattgatttttataataaggaaatacttcaccatcaatcaggtgcggtaatggtagaatttcactaaatttgcaggaattgaaatatgaacgtacttaatttactttttaccaaagacggattaatctgccagattgttaaaaacaaaaacatcctggaggaaaagtcttatttcgttactgaagagacaccagccaatcttattgaacagaagctggacgaagttcttatcaagcagcgttacgaagaaatccatgtgatttcagcatttaatcactttaccctgatgccggaaggtttttccgagcatgatgcaggatttgatctgattgccttcaatgctccggctgacagagagaaggaggaactgatgctctccatcaacaaaaaattcaatattcagttttattatactttcccgaaaagttattataaaaaaataaaggaacttgccgtgcctgcccattttaatttctcaggtgaaaagtttttaagctcaatcaataataaaaccagtaaagaaattcacatcaacctgtatcataatcaatgtgaattttttgcgattgacaataagaaaattattctttataataatctggatgtcaattcagaagtagattttctttacttcattatgtttacattaagcaaaatcggtttcggaattaatgaaaccagcttttatgcttatggagaaactacggaaaatgaaacatttatttctgaacttcagaagtttgttaaaaacctgaaaattgtttttgacaacattcccaacaagaattttatacttaattaggttgcaggcagaaggtaatagaaattaaaacacattcatcttccacctataatctaccacctaacccctaacaaaaatatgttcagaataatatcaggcaaatggaaagccaaaaaaattgccgctcccaagaactttgaagtaagacctaccaccgattttgcgaaagaggctttattcagcattctggaaaacaaatacgatatgcagtcgatctccgtgcttgatctttttgccggaattggctctattaccctggaatttgcttccaggggatgtcagaatataacttcagtggaaatgaatccaaagcatacggcattcatcaactctactgcttccgagcttgatatggcacttcagatcaatgtacagagaggagatgtttttgactggcttaaaaaattcagaaataaaaagtcatttgaaattgttttctctgatgcgcctttcgaaatggaagagaaaaaatatcacgagcttatctctctggtcttaaacaataaatacctgaaagaaaatggagctctgattgtagagcaccaaagccgtatgaaattcgatcatcctaatttaatagatacccgaaaatacggaaacgtaagtttcagtttttttgaaccgaataaagaagataatcaggaactctaattcctgattattttttttgagataaccggagcttcttcaccccattttgtaatggcttccagaacaggcaataaagttcttccgaagtctgttaattcatattccaccactaaaggaggtttctctgtaaaaacttttcggtcaacaattccatcttcttccagttgctttagctgtagactgagggttctttctgtaatggtaggaattgattttcttaattcattatatcgcttagcgccatcaatcaaatggtgtaaaattactgctttccatttgcctcctataaatttcatagtaacactggtacagcacgggtaggatttattatctatggtatacatttttatactatcattttttaccgttattgcaaagttaggaaacttaaattaattttgtaactataaaaatgatagtataaaattatgaactttttagagcaaatgaaaaacaggtatactgtaaaaaagtataacccacagggaaaagttactgaacagcaggttgcagagcttaaacaaattctaaaccttagtccgtcttctatcaacagccagccatggaattttatatttgtaaatgatctggagctgaagcagcaattaggggacaaatcttattttaataaggaaaaagtattggaaagcaactacatcattgttttccaggtaatcaaagatgtagagaactttgagaaacaaatagaagaaaatcttccggaaggtgctgttaattattaccggacgatggtaaaacctaaaggtgaagaagctgtaaaatcctggctgcgtcatcaggtgtatttgtcattgggagtacttttatctgcctgtgctgccatgggaatagattccactccaatggaaggaattgaacctgatggatatgatgctgtgctgaataatgaaaattatgaaaccttattcgcagtagcgatcggggaaagagatgaaacagatgccaatcagcctaaattcaatccaaaaaagagactgaatgctgagaaagtaattgtggaagcgtaattaaaacacgagtttcacaaattatttcacccatgacactaagaaaaaaatctgcttcgatgtgaggcagactttttatttataatactttcaattctaaatcaattgttttcccgaagaactttttagagatcttttcgaaattcttggtaagatctgaaagatagaaatgataattcggtttgggattgttctcatttaaaagattgtacttatccaggataatcttcagatgattggcaacaatattcggagagtctattacccgtaccctgtttccgtaatattgctttatttcatctattaaaagaggataatgggtacagcccagaatcaacgtttcaatatttttaagcttactgttgcttaaataattgtaaataatagcatgggtaatcggatggtttttaaaaccttcttcaatggcaggtaccagcaatggtgttgccagttcatccactttgatccatttgttatgcttgcggatactctttttatacagtccggaatttacagtcgctttagttgcaataactccaacattattgtggatttcgtaagatactttttcagctacaggattgataacgtctattacaggtactcttcctgcaacagactgcattacttcattcaaagcattagcggttgccgtattacaggcaattacaattgctttgcagttctgttccagcagaaaattggtgatctttgtagaatattcaatgatggcttccctggatttttctccgtaaggaaggtgctttgtatctccaaagtaaatcagatcttcattaggaagaagtcttttgatttctttggcaacggtaaggcctcctactccactgtcgaaaattccgataggctggcttggtgaaagatgtgaataatcttgttttttcgttttcaaatgagctgaaattttatacaaaaatagtgaattttatggcatactgtatacatacagacattatacaataaacaaatctgaagcaatcccatctgccataaaccaatgcttctccggaattttcaaatgatcattttcaatgattaaaataccttcttccatttttggtttgatttccgtttgaaaatgctccagaagtctatccgaaaatttggttttcagactttcaatatctactccccaaatggtacgcaagccaatcatgatcatttcattaaactgatcttccatcgaaagaatttcttcttccttagccagtaatttatcattaagcttcttaatatactgctgattattggcaacattccagcttctgacatcaaatccgttgtaggaatgtgccgaagggccaattcccaaatattcctgatacttccagtatgaggaattgtgacgagaatagaaaccgggtttggcaaaattggaaacttcataatgttcaaaaccatgatcttttaaaaagtctgataaataatagaattctttattttgttcttcctctttaggactttttacctttccttttgcaatccagttttccaaagcagttttaggctctaccgttaaggcatacgacgaaatatgaggaacttctaaagcgatagttttgttaaggttttctttccagatctcaagattggaagtgggcgaaccatagatcagatcaatactaaggttttcaaagccgaaatcctgggcacgcttgatagagctttctgcctctgaggcattatgagctctgttcattaattttaaatcctcctcaaaaaaactttgtgtaccaatggaaagtctgttcacgggtgttcccgcaagctgctttaaaaagtttttatccaaatcatcaggattggcttccagtgtaatttctatatctttttcaaagctgaaataacgtaatgtttcatctattaaagaactgatttcatccacagaaagaatagaaggagttccgccaccgaaataaagggatttcagatttttgttttgcaattcatcttttctcagcaatatttcagttttcatggcacgaagcatttcatccttaaaattcagggatgttgaaaaatgaaagttacaataactgcatttttgcttacagaacggaatgtgaatgtatatcataaaaaaagctctgaaatttttcagagctcaaatttatttaaattaaattgattagtatctaaatcctctcacattaataaagttgtcgaagttatatcccagaccaatcatgaagctgtttcctccataactttggatatcagataatccaaggttataggtagctccgatcatgaatttattgaatcttacttttacaattggagaaatactcaggtcctgattgtcaaatctgttctgaaccgttctgtagcttaccccgaaagagaatgcgttgatatcattggagaatgtcgccatcaggttccagtcgatcattcttgttgagtttgtattaaggttgatcaaagctgacggtgcaattgtaatattatcagcaatgttccagttgtatcctaagtttaggaagaatttaattggagaaggttcgtagttgtttacgatagaagcatcattacttaatgcaatatcatttacggaaacacctccgaataaacctctgtaggtagcagccaaaccgaagttcgcatataccatgaagatattactttcctcccctcttaataacgggtcacctccttcttcagtattgatttttgaataatcaaaattcatgttatagaagttaacacttgtaccgaaagagaactggtcttttctatctccttcgctacttagcggaataaaatatgaagcaccagccgtaataccacccgcagagatcggtccgttactgtctctgaatacggaaataccagcacctactctatcaaagatattcgcattgatcccgattgactgtacattcggagaattactgaattttgaaaattgttgttgataattggcgttgagctgtacgtaatctgtttttccgtattgagctgggttgaacaggaactcaccatccaaaagatattgctgatagtatggtagtgattcttgtgctttgtatgcatttgacaaaagagctaaacatacgatagcatatagttttctcataacaaatcttgatttcaattcaacaaatataaaaaaattctcaatatatttttagttttctaaataatttctccatttttttacagcatccgccatatctttgggcattgggctctcaaaatataattccttctttgttgttgggtgtataaatcccagggtatgtgcatgaagggcatgtcttggcaaaatttcaaaaacatttttaataaattgcttgtatttcggaagatttacccctcttaaaggagtatgtccttcatatctttcatcattaaacaaagtatgccctatatgtctgaagtgcgctctgatctggtgtgttcttcccgtctccagcttacactctacccaggtcatatacttgaatctttccagcactttataatgcgttacggcgtgttttccctggctgccgtcttcataaacagacatttgcattctgtttttaggatgccttcctatatggcctcttatggttccttcatcttcctgaaggtttccccatacaaaagcccagtataacctcttcgtggtccggttaaagaattgttttgccaaaaagctcagagcatattcattcttggcaatgaccagcagtcctgatgtatctttatcaatcctatgaacaagccctaccctgtcaagatcggatttctcaccattcttttcaaaatgatacgccagcgcattcaccaatgttccgtcccagtttccgaaccccggatgcaccaccattcctgcttccttatccacaacaacaagatcatcatcttcataaataatattcacaggaatatcctgcgggataatgacattctctctcggaggatgcgcaagcagtacagagatctgatcgcccggcttcacacggtaattctgctttactgcaactccgtttacgatcacgtttccggctctgcaggtttgtgaaattttatttcttgaagaattctgtctgtatattaaaaggaacttatcgattcttaaaggttcctgtttactgtcaacagtgatattaagatgttcatacaatcccttattttcctcatcaatatcgatgttttcaatactgttggaatctaataattcttcatctaaaaaatcgtcgttatcttctgacattgttttatatttttttacacaaaaggcctcaacatttgcagttgaagcctgtatttttgatattaatctgatcttattctacgacaaccttcttggcttttggcttttgcgcaggctgttgtgttgttgtggatacagccggcttggctgtattatttgccgtagcatgagtaccattccctgcagaagttttaggcttttctgctgttgaagcagctggtttaacagctgtagtctgagttttaggagtctctgttttcggtacttcaggctttggagtttctcttcttggggcaggagcaggcactgcgggagcttcataacttggctcgctatgaacttcttcatatcgtaccggaggaagtgaagtatctactttcatacggtagatagaattcagctgttccaccttagctcttaattcagcaggagttttcttacttgcccaaaggtcaatctgcatgccctggtcacgaacatctccggcagcaggatcctgataataaatgatatcagattcatcattactgccatcttcatgttctaccaatcctacttcaaacatactcttggtaatgacagctcttgcttcttttaccgtaagtccgacaacgttaggaatagaaatatttctcattggtccggaacctaccaccacatcaattactgagaatcttggtaaacgggtacccggatttacagcatttcctttatataatattcttaaaagagcatctttctgaatactaggctcataaattgtatcaccgattttaagacctacctgatccagtctctggaaagccagcccggaatatttattgataacattcggaacagcaataggagcccatgttctgggatttactttaagcgttacagttcttccgtcttttacacgggagcctggcgcaggataaacctgcaaaacctgaaatggtctgtatttaggatcataattagcactgtctacctcatattccaaccctgtatcgtctaatattttaacagcatcatgtactgatttgtttacaacattgggaacaggaatttcctgaccatgattagtatggtactccagccagcgaaatgtgagccataccaacccaacgaaaacaccgatggctactactaaattcagtaaaactttccaattgaaaagtgatttaagcatacttaaaaatactttaattataaccgcaaatatagctaataattttagaatggactttttatttaacacaattcatttttgattttaaaatttgctgatttcccgtattgcattatataaaatgattaaatttgccttaattgatactatatggttatgaataaaaaaagtgttgccgtagtaatgggaggctattctgatgaatatgtcgtttctttaaaaagcggacaattgatttatgattctctggacagaaatctctatgacgtatataaagtagtagttcttaaagatgaatggtattttttaggagaaaatgataaaaaatatgccatcaacagaggtgatttttctgtgactctggataatggagagaccttacaatttgatgtctgcttcaatatcatccacggaacaccgggagaaaacggaattcttcaggcatactgggacgccataggtcaaaaatatacaggctgcggtttttaccagagcgcgcttacattcaataaaaaagatacactggctgtactttcaaaatatgggattccttctgcgaaaagcatttatttaagaaaaggtgaagacattaatgttgatgagatcgtatcagaacttaagcttcctttatttgtaaaacctaatcaatccggatcttctctgggaatttcaaaagtgaaagaaaaatctgaactgattgccgctactgaaattgccttcaaagaagatgatgaaattctgatcgaaagtttcttaaacggaatggaagtatctgtaggagttattgattttaaaggagaaaccattgttttaggaatcacagaaattgttcctaccaatgagttcttcgattacgaggcaaaatacgaaggagcttctgaagaaattacaccggcaagaattgatgaagaaaccacaaaaagagtggaggaaattgcaaaaagagcttacaattcattgggaatgagtggtttttcaagaagcgaatatattctgatggacggtattccttacatgctggaaatgaacaccaaccctgggttctctccggcaagtattctccctcagcaggcaagacattatggaatttccatcatggatctttgtggaaatgaagtagaaaaagcgcttaataaataataaagagttagaaattagaggttagaagttagagattgaatacacttttaacaaataattcactactcaaaatcataactcgtacaacatgaaaattgctgttttcccagggtcttttgacccgattacactaggacattacgatattatagaaagagcagctccgctatttgataaattaattatcgctatcggacagaactctcagaaaaaatatatgttccctcttgaaaaaagaatggaatttatacagaattcagtcgctgaatttcccaatgtggaggtagattattttgaaggacttactgtggattactgttttgaaaaaaacgcacaatacatcatcagaggtcttagaaatccggccgatttcgagtttgaaaaagcaattgcccataccaacagaactttagcccacaaaaaactggaaacggtattcttactgacttcttcaggaaaatctttcatcagcagcagtattgtaagagagatcattaatcacggaggtgaatacgaactattggttcctgagtccgtgagagtggagcgataaaaaaatataattgatgagcgataaatgataattgatataatggccaagaatttgcttaagcagaaatcattcatcaattatcatttatcaacaatcatttataattatatatgcacgaacagttcaattttgcaatagaagtcctggggaccattgccttttccatgtctggaagttttgcagcgatgcagaaacggctggatccgttcggggtacttattatcgcatttgtaacctctgtgggaggaggaactgtaagagacctgcttcttgatattcctgtattctggatgcatgatctgcttacatgtgggctgattctggtaaccagcattttttcaatggttttcaaatcccttgaaaaaaatttcaaggtaaccttgtttattttcgacagctttggtcttggcttattcaccattataggagttcagaagggtttaaatgcaggcattcatcctatgatctgtattgcattgggaaccataaccgggtgtttcggagggataatccgggatatactgcttaacagaattccattgattttcagaaaggaaatttacgctacagcatgtattgtaggaggagcagcatttcttctgatgaccaggtatgcaccgttttcctatacttttgtgcaggtcttcactattttactgattgttgccatacgaacatttgctgtcaaataccattggcagatcccaaagttctatggtcatgatcaaagttcggaaatgtagaatcaatcttcacagatataaaaaaagcacctctaagggtgctttatatttttaagtgacttagaagaactttcctctgtttctcatatgaggattatgcatatgtttctgcatcgtcggcattttcaactgctctttcatcattttgatctgatcagtcatcattcctgcactgtctaatctctttgcttcttccaacagcttctgcccttcctgttttcttcctttggaaatagcggctgcagcaagatttaaagtagccattgctctgtcatgcttcatattcaaaccgtattccaatgcctttttcatgaaaggctctacttttgcagggtgatcctgagcctgggtcaatcctgacaaatagtgaaaatatccgtattgagtcttatgaagctgtgttttatagtctgtaatttttgataaccattctccggctttctccatattctgctttcttaattgccagaatgccaaaaggatatattcatttttaaagaatagcaggattggaaatgcagccaaaaggaatacaacaataccccacccaagatttctcgtgaagaacatcatataaagtcccagtaaaataaggactgctgctactgcaatttttatgtatttattcattattaaattttagaagtgcaaagataataaatttaaggcttaaagttcaaaaagtcaatggtgaatggtcaattcgctgtgcctgttaatttttatacctgtgagaaattcacgattcactttgcaaagcaaaaattgactattgacccctatgcttcttttttaattctttcaaacgtctggaaacagaaatcataaccgttcttttcatctttttcatgacagatttcgttggtcattttccagattttaggatctattttcgggaaaaatgtatccgcttcaagatctgctttcactaaggtaacttcaagtctgtctaccacatccatagtctgctcatagatatttccacctccgatcacgaaaacttcttcatcaattttttttgcaaatttcaatgcttccttgatgcttcctacaattagaattccttcttcaaaccaatctttttttcttgacacaacaatgttggtacggtttggaagagcttttccgatactttcatatgtttttcttcccataataaccggatgccctgaagtaatttccttaaaatgtttcaaatctttgggaagatgccaaagcaactggttttcaaaaccaatctcatttttctctcccatcgccaccactattgttgtcattcaaataattttttacaaaattagcacataatttgtatatttggttagcacaaaaaatttaaaaaaataaactatgaaaaataaaggatgtctgggtgcaggaaccattggtatcgccctccttattattgttgctgttctattcttctggggaaaaagcggctataacaattttgttaacaaagaacagactgtgaacgcaaaatggtctaatgtagaaacagtatatcagaagagagccaaccttatccctaacctggaaagaaccgtaaaatcgtattcaaaatttgagcaggaaactttaacacaggttgtggaagcacgttccaaagctacttctatcaatattgatccaacgaatatgactgaagcagatctggcaaaattccaggctgcacagggagaattatccggagcattgagcagattgatggctgtggtagagtcttatcctaacttaaaagcggaccagcagtatatcaatttccaaagagagtacactgctatcgaaaacagcatcagaactgaaactgtttattacaatgatgctgcacaggattacaacacgtctatcaagactttcccgaataatattctggcgaatttcaccaactttaaagaaaaaccttatttcaaagctgatgcaggagctcagaaagcccctgaagtattcaaataataatgggtaatttcctaacaaatcaacagatcgcttcccttgtggaagcgattcagtctgcggaagatcattctacgggagagatcagggtgcatattgattccaatacggaaaaccgcgatgccaaaacagcttttgaggttttcaaaaaactcggtatggacaaaaccactgacagaaatgcggttcttttccatgtcaattttgaacagaaatatcttactatcattggcgatataggaatccatgaaaaggtaaagcagagttactgggatcatcttcacgattacattaccgctgaatttgccaaaggaaattattacaaagcactgaaaagtgctatcctggaaacaggacttgaactcaaaaaacattttcctgtaaaaggagaaaatccaaaccaactcccaaatgaaattacgttctcttaaaatagtattttcatttttattactatgcttttacacatttgtatcagcacagtatactattcccgaaaaacctgcagtgctgtatcctgtttttgatgaagccggactgctttcacagcaggaaaaggatgcgctcaataataaactgatcaagtttgcagattctacctcaacggaaattgaagtggtgatcatccgctctaccaaaggggaagatgtcaactttctggcaaccatgtttggtgagaaatggaaaatcgggaagaaagatgtggataacggagtggttttcctgattgcaacagaagacagaacaatgtctatccagcagggacgtgccgtggaacaatatcttacagcttcagtagctggacagatcctggattatatcgtcactccaaatttcaagaaaggactttggtatgagggaatcaatggaggaacctcagccattatggaggcagttcagggaaaattcaaaccggtagcgacaacggctccttccggtaacggaagtgcttttaaagttctgatcatcgcttttgttattttcatcattattgccattctttttggaaacagaggcggcggacgcggcggaaacaatgacgacgacgatgatgtaatcatcaccagaagaggacgcagaaattatcctggcggtttcttcccattccctggaagcttcggaggaggtggctttggaggcggaagttccggcggtggcggcggattcggaggcttcggcggtggcggaagctttggaggcggtggtgcatccggaggctggtaaacaaatacattttaaaaatcatataaatcagatcattaacgatctgatttttttatttaaaacactaaaataacactgattctttagcttttcttaatgttaaattgatctttagatattaaaaaattaataaaaccgcacaaaaaccgtctttaattcaatattttttcactatatttactaaaaacaggattatgaagaagacgctggtagtatttgcacacccttatctggagcactccaattcgaatgtagagctcatcaatttctacgttcgccaccagcattataccttaagagatctttatgaagaatatcctgactttcatatcgctgccttcagagaaaggaaacgtcttaaaaattacgataggtttattttccagtttcccctgatatggttcggaatgccgcctctcctcaggttatggattgatgaagtattcgacagagactggcttaaagagggcgaatacaatccactggaaggaaaagaagtttatattctggtcactaccggaggaaaagaaagatctttcagtaaaaccggcacataccagtataccatagatgaactgatcagcggactgatagtttctttaaaagttttcaaagcagatattaagcatataaaaatcgtttacgaagccaacaaattatccaaaaaagaaattattttacataaaaaagaattcacagaactccttaatcaataacatatggaatccagcttagcgatgaacacattaatttttctgggtgtagccattatcatggttccattggccaggaaattagggctgagctctgtgattggttatatcctgggtggaattattataggtccatatgtactcaggcttacaggaaaaaatgtagatgatatcatgcacgccagtgaatttggtgttatcatgctgctgtttcttgtaggattagaactggaaccccggaaattctgggaaatgcggaagaaaataatgggacttggactttcccagatggtacttacgattgcattattattcgttgtattcatcactgcaggatggagaatagacaaagcggttgccattgctatgtgttttgcgctatcttccacggcaattgttctgcagaccttacaggaaaaaaataacctcaagaccactgccggagaagcctcattctccaccctcctttttcaggacatttcagtgattcctattctggcaatacttccaattatagccaattacaaggccaagcatcacgataatgaaatccagattctgattcagaaactgccggaatggcttcaggcaggaactgtaatcttcggtgttgccttgcttattttattaggaagatatgtttttgttccctttcttcgttatgtttcaaaatcgggtatgacagagctgctgacggcttcttctctattcctcgttatcggggtttcagagctgatggttgttattggtctttcacctgctctgggagctttccttgccggggtgatgctggccaacagtgaattccgtcatgagctggaagcacagattgatccgttcaagggacttttactggctgtattttttgtcagtgtaggttctactattaattttaatattattcagaaagatccattgtttatattcagtactgtttttgctgtactggttgtaaaatttatcgttttatacaccatcggaaaatttttcaggatagatactcctcaaagtcttttttatgcatttgcgctttcccaggtaggagaatttgcttttgtactgcttaattatgcctctgatctttatctgttaggtcccgagatgaatgcacagatgatggccgttactgcaattaccatgtgtatcactcctatcctgcttattatcaatgataaatttattactccgaaattcattaaagaaattccggaagaagagcacgattttaatatccttggaagtgaagttacccaaaagaaaattatcattgtaggttttggtcatttcggaagtaccgtgggacgtcttttaaaagctaataaaataccagcaacagttctggaccgtgattctgatcgtgtaaaactgctcagaagctacggctttaaagtctattatggtgatgctaccagaattcctattctaagagcagcaggaattgaagatgccgagattcttgttttatgcctggatgatccggatgataataagtttattgcggaactggtacgcgaacattatcccgatgtgaaaatttttgtaagggctaaaaacaggattgatgcttatgactatctcaacaacgggatcaatcatatctaccgtgaaaccttaggaacagcagttgatatggctgtggatgttcttcatgaaacaggaatgagaaaatatgcagcaagacggctgggacaaaggtttatggctattgataaagcctcaatccggaagctggcaaaaatgaaagaagaagatgacgacattactctctttaccacaaaagaaatcctccagcgtgaggaggaattattagcttacgataatcttaattttgataataaaaactgggaaggttcctcatccgctgatgaagaagatgaggaagaatcccaggattaatttattggatgtttacgcttccaccgctgctttcctccttgattacattcttaagttctccttttttagagatatccacacttcctccggatgaagcaccggctttcacactggaaacagcactgatgtgaacacttgccccgctggaagcatctgcttctacatcatcagcaataactccttttgctgaaacactgctgcctgaagaggcgctgatatctgctttttttgcttttcctgaaagatcaagagtagatcctgaggaagattcaatatcaaggttcacggcccatattttaccatcaaagctactgctgctgcttatattgatatccatatcgttagcctccagatctccggaaatacttcctgcacttgaagcttcgatatctgttttttcctgggtaaatttatcttttacaataattcgagctgctgaatctgccaaaagttttttaaaatcctttgcataaattttcgcagtcactttgctgatgttcatcactctgattcccggtttataatgaatgtgcagttttccgccatcattatctataagaatttcatcaatgatactttgaggtgccgaaatttctactttttccgtttcagattttataacctcagcttcaatagcctgtgaaacctgaatttcatcaaagtctcctgtaaattctttatgctgcatcgggccggtttctttgcttaccactttttctacccaattacctctgtcaccttccctgtctctgtttctgttctcatgtttatcattacatgaagtcaatgccactaaggctgaaaaaataaataaagtccctgttttcatgtttatttcttttgtcaattatttgtttgatttctttatatttaaataacaactaatttataaaaaatattacattaccattgaaaatactataacagcttatcaattccccttcaaaaagcttttttgcacattttctgaattatgcagtacaaaaaatattcataaaccggcttcaataaatacattttcgaatatatattctatgatataagtttttaatatctttatggtttaataacaattatatttatgaagaatatttcatcggtattattaatttctgccttggcgttcaatcaatcttgtactacaatgaaacagaccgatattcaacaggagcttcctgcccctgatccctctttatcttcaaatccttttatgaagaagagcaagcttcaatacgaagctccggagtttgacaaaattaaaaatgaacacttcaaacccgcttttgactttggtttaaagcaacatgaagctgaaatcatcaaaattgccaacaatccggcggcccctacttttgaaaataccatcgtagcattggaaaaaagcggtgaagtattgagaagagcacaaattgttttctctaatcttaccagtgccaatacgaaccctactttgcaggctttggatgaagaatatgctcctgttttcgcagcacattctgataaaatgtaccttaatgaaaatctttacaaaagaatacaatccattaaagaagacggccttgattctgaaagtaagagactggtgcagttttataagcaaaactttgaaattgcaggtgccaatctttctgcagctgataaagaaaaattaaagcagatcaatcaggaactggcctctctttctacccaatatgccaacaaattactggaagcaagaaagcagggaggtgtatttttctcagatgcaaaagaacttgacggactttccgctgatgaaattgcagcggctgcatctgatgccaaaacggcaggacagccgggaaaatatcttctggctttacaaaatactacgcagcaacctcttttacaaaatttaaaaaacagagcaaccagagaaaagctgttcaaagcttcatggacaagagctgaaaaaggagatgctaatgatacaagagcaactattgaacaacttgctaaactgagactgaaaaaagctcagattctgggaaagaaaaattttgccgagtggaagcttcaggaccagatggcaaaaactcccgaagcagcaactaaactgatgaaccagattgctactccggcagtggaaacagccagacgtgaagcaaaagacattcaggatcttatcgaccagcaaaaaggaggcttcaaagtagagccatgggattggaacttttatgctgaacaggtaagaaaagcaaagtttgatctggacgaaagtgaaataaaaccttattttgaaattacaaccgttcttgaaaaaggagttttcttcgcagccgaaaaattctatggattaactttcaaaaagagaacagatcttccggtttatcaccctgacgtagtaacgtatgaagtttttgaccatgacggaaaatctattgcgatctattatctggatttctatacaagagattctaaaaacggaggggcatggatgagtaattttgttgagcagtcttatttattaggaacaaaacctgtaatcgttaattgctacaattatcagaaaccggctccggggaaaccttcactgatcagttatgatgatgtttcaaccatcttccatgaattcggacattctattcacggaatgtttgcaagccagaaatatccttcgctttcaggaacaaatgtacctagagactttgtggaattcccgtctcagatcaacgagcattgggctttagatcctgtcgttctgaaaaactatgccgttcattatgaaacaaaacagcctattccacaggctttggtagaaaaaatcaaaaaggcagctacattcaatcaggggtatatgactactgaattggtttctgcggctgaacttgatatggattggcatactgtaagcaatgaaagtcagtttattcctgttcttgattttgaaaagcagtctttagccaatcatggattcaatttagcaacggttccgccaagatatcacacgccttatttcgcacacatctggggaggtggatattctgcaggatattatgcttacttatggtctgaaacactggacaatgatgcatgggaatggatcagcaaaaatggcggattgaccagagaaaatggtgaccgtttcagaaaatatattctttcagtaggaaattctgtagatctgaaccaggcattcagagactttacaggacacgatccggatatcaaacctttattgagaaacagagggtttattaaataatctatgatagtcaatacaggaataaaagttttatcctcattaattattctgacttgcttctcattaaaaaacaaaaaatttgaaagcaggtcagaatctttatttcaaaaacattctgatacagttacacaagaagaagcagacaaatactttcaggagcaacaaaaatattttgattctacttgtaaggccgaaacaataaaagctgaagcggatattaagaagaacaaacttgtttattttcattatttcggaatggtaaaaagctacagaagcaatgatgaaatgaatattcttttaaaaagacacaatatcgaagtagattctgcactttattattgtactgttccacaggcgcttcaaaattgctacgccaaagtaatgtcaaaggaaattaggagaaagtttggtccaaagtttattgattctttaagacaggtagcagatatacagtatgtagaaaagaattccgataagctctatgattttgaagaatgtgatactatttcaagatatccgggaagtaaatcctaccgaagtttttttaaagattataaaagaggattttggaagaatgtacaatatcccgatcaatttgaatatcggaaagacaaagatttttattcttccatttctgcagaatttacgcttcacaaagacgggacggtctcagatatagacattgaccttacttttcataataaaaagaattataagtacgcctcttactttatcaacgaaactaaaaattttataaaaaagacaaaatggattcctgccaaaacgatgggaataacagtaaatagcagggttcctcttacattattttttaaataacaatgaaaaaaattattacagcaacattattatcagtctttggagcaatatatgcacaaaaaggccacgcaaaaccacaagccaatcaaatagacaacaaacttgtcggcctatggaaaggaagcgaaaaagaccaacagatagcagggatggaaaaacgatgggtgatggaaagaaaagcagatggtacttttatgcttatttttaccacgattcaggattgcgaagtcgatcaatttattgagagaggccaatggtggattgagaagggagaatttcatgagctccactttaattcagggaaaacagacatatacacttacaaagtcctggacccttcccatgtaaaatttgattcaaaggagcaggcattggatatagcaactgatacctatagctttgttgatactaaaattgatgaagacaatcagtaagatataatgagaagcattctttaatcagagtgcttctttttttatatttcggcgaaagcctgttcctattgaaatcaaaatgcatcttttcaaatccgaaagtagatcatatgttaaacgttaatcaaaaaattagctgtattaaacggtcaggattcattatttttgcatttcaaattttaaatacaatataatggactgtccatgctgttcaggaaaatcctacgaagaatgctgtaaaccttatcacaccggagaaaaacatgcgcctaccgctgaagctctgatgcgttcaagattctccgcctttgctattccgaatggtgaatatctgatggaaactacccttccgggaaaaagaaagtatcacaataagaaagatcttcaggaatggggagaaattaaccaatggacaaaactggaaatcataagaacgcctgctcttaaccatgtagagtttaaggcttattatacagatcaggacggccatccgcagattcatcacgaattttcagtctttcagaaaatgcatgagcgttggtattatgtttcaggagagtttttagattagtacatataatgtcgtgcgatgctttgcgcatagaaccacccccgtcaaaaattctttgaattttcgccacccctccggtggaggggaatgccaagcaaccaataactattatatccttataaataaaaatgtccgacaaaatcggacatttttattttttagtgagcatcagttccgtcaattccgtgagcgtgaccgtgtgccaattcttcttctgtagccggacgggtattcaaaacttctacctggaagtctaaaactttccctgccattgggtggttaagatctgctaccacaacttcaggagtaatttctactacaaatgcctggaaattgtttccctgattgtcagataaaggcaaaatagctcctaccggcggaagtcctgattctttaaacatctccactggtaattgtgcaatagcatccggctgtctttcaccgtaagcttcttcaggctggatcacaaaagccgctttgtcgccagcttttaagcctaagatattttgttcaaattttggaatcatcattcccacaccatacaaaaatgtaagcggattttctgttgttgtctcttctacaagaatcttacttccatctggttcgatagtgtgaagtatatactttacagctacaacgtgattgttttcaattgtcatatttttctttttttcgtgattttgtctcacgattaatggtacaaatatactgtttttgaaatgattcaatgagcaaggaagatgggagatggaagaaggaaactatgaaaggcataaagaaaaatatttctctcttttttagcctttattttttcgggcctcatctctctttttctgtctcaggacaaaaagatataagctttccacctttgttctggcccagggtgttttccgtaaaaatttcagagaggagctgatacttggattatctgtaaaacattttatattaatctgttcaccaagcctttcgaaaccttcataatattctaccagttcctcaaggatagcatccagtctttttccatgtagaggatctttggactgctgttccatattttttctgcaaaattaatttattataagtttatatggaaatctacaatccttcttctctttttgtttcttatttttgaagaagctatttttcacccataaaaattatccgttatcaaacatgagcaaaaataacgaagccaacaggaaaaaaaataaaaagaaaattgatcagaagaaacgtaaaatacaaaatgctgaagcagaaagaaaagcaaggttaaaacaaatccgggaagatttcaaagcaagagaagctgataataagccataaaattgtttttaaccgaattaaggaaaaccttatttttttaaattaagtattctctatctttacatgtaatagctgcaaaataattctttacgaagcaagttgaaaattatgcagcaaatattctttttaattctcaaatttaaattatgaaaatcctccacactgccgactggcatttgggtaaacgtctagaccgtttttcaagactggaagaacaggttctggtgatgaatgaaattgttcagattgctgatgagcaaaacgttgatttagttttaattgccggtgatctttttgataattttaatccaggtgtagaggcagttgaacttttttataaaacactgaagcgtctatctctgaatggaaaacggccggtgattgcgatttccggcaatcatgattctccaagtttaattaatgctcctgaccctctggcgcgggaatgcggaattattttaatcggccatcccaagacggaaattactcctttcggaacagaatattttaacataaccaattcaaaagaaggttttatagaactgaaaattgacgggatagatttcccggtaagaatacttcatactccttttgccaatgaaatccgtttaaaggaatatttcggcgaaaataaagaagaggaaatcaacaaagtactttctcaaaaatggaaagatcttgcagatcagttttgtgatgataccggagtgaatcttctgaccgctcatttgtatatgaataaacggggtgcagaaattttagaagaaccggaaggagaaaaaccaattaaaataggaaatgcagatctcattttctctgacagcattcctgaacagattcaatatacagcattgggccatctgcatggttttcagaatatcggcacgaaggaaaagcctatgatctattcgtcttctcctctatgctacagtttcagtgaagccgggcagataaaatatgtttctattattgatgcggagccgggaaaagcagttagctatgaaaaaaaggctttaaaaaacggaagagcactggtcagaaaaactttcacatctgtagaagatacggttcagtggctgggtgaaaatcccaatacatttatagaactcacactggaaagcgaaacttttttaacggctgatgaaagaagattgatttatcagtctcataacggaattgttcaccttattccaaaagtaaaaaataaagaatttaccgaagaacaggctcatgaaatcaatttaaatcaaaatattgagctgctgttcaaagattattttaaatcaaaaaacggcggacaggaagccaatgaagaactgatgaatttgtttaacgaaattttaaatgcataagccatgatccctgttcaattaactatcgaaggtctttactcgtaccgggaacgccagactattgatttcagaaatcttaccgaagcggggctgtttgggattttcggggctgtgggttctgggaagtcttcagttcttgaagcaatttcgtttgccttatacggtgaaacagagcgtctgaatatgcgtgataaaagggcttataacatgatgaatctgaaatcaaacagttcttatatagaatttgattttgtgaattatgagaataaactcttccgtgccacccgtgattttaaacgaaactccaaaaaattcgaagaggtaaagcctaatgctgttactttttatgaaaatatagatggaaaatggattcctctggagcactcaaatgcagaagctatcataggtttaagctattccaattttaaaagaaccatcattattccgcaaggacagttcaaagaattccttgagctgggtgccgcagaaagaacgaatatgatgaaggaaatttttaaccttcagaaatttgatcttcagaacaatgtttctgcactcaatgtaaaaaacagatctgaactggatcaacttgaagggcaattaaaaggttttgaagatattaatgaagagaaaatcaaaattcagaaagaggaacttacagaggaacagaaaaaactctcggaagccaataaaaaactggaaaagatctcccaaatctatcaacagctgaaaaacctgaaaagtgattttgaaagtttgcagctgaataaggaaaaattcagtaagctctctgaagaaaagcctcaaatggatgctttggaggcaaaagcagaattatatgaccgtattttcagaatcttcaatccgctgattattgagaaaaataagctttccaaagaaattgcagataaacggaacgagaaagaacagcagattaaaatatggcaggaaactgaaaaggcttttactgttataaagaaacagctcgctgctcttgaaccacaatttaaggcattggagcaatcaaaaattcaggaaaatgatatgaacctcatcgttcagatcctgaaattttctgaagaaataaagactttaaatgaaagaacccggaaaggctctgaaaaggtaaaagaagtaaatcttaataaggagaaaattcaaaaaaccattgatgaactttccgcacagattaaaactttaaaagaacaaaaacttgattcagctttactttctgaagtaggcaactggtttattcaacataagaattttaaaaagatacagcaggaacagaccgaaaaaactgaacagcagcaaaaacagattgcggaaattgcagaagaactaaaaccttttggctatcatgaaaattacaaagacgatttcagaatcaggaaggaaactttagaagctaaaagaaaagagctttccctaaaactggatcatcttaaaatacaaaaagagctttcccgttttgccactgaacttcatgacggcgaaaactgcccgctctgtggctccaaagagcacccgcacattgtggaatttcatgatgtaaatactgaattacaggagatccaggagaaaattacatctgttgagcaggaagtgactgccgttcagaagcaggaatctgaaattgataaaattctggaccgcaaaaaaatctttgaagaacagcttacttcagagcaaaaaacggtactccggattcagaaagatatagagcatcatatcctgagttttacatggaagcaattttctcatgatcaggaagaggaatttgagaaaaaacgttcagactcattcactttagaaaaaaagattgaagaagcggagcgaaatatagcactggaaagagaaatgctggaaaaagaaaacaaaacgctggagaaatataagagtgcattggaggctttccgtttggaagaagtttcgaaacaggaacaaatcaatatcagccgttctgcgcttaaaatcctggactggaatctgtatgctcaaaaaacaatcacagaaattgaagatgcttatcaaaagttggttctgtccaacaaagaaaccgaagaaaattataataaagcattagagcaggaaaagattctttctccaaagctggcagaacaaaaaaccattgtcagccaatctgaaaaacagatcacagaacttgagagagagatttccgcaaatgaatcggttatagcccaagccttagcagatcaaaatttcaccgattttaaagaagttgaaaacattctgcatcaggaaattgatattcaggttgtgagaactcaaattcagaatttcaagattgaatttgaagctttaaagaaattcatcggagaactggaattaaagctgaaaggactttcatttgacagtaaccagttttcgttggctgaacaacagcttactcaagcacagaacgagcaaaaacagatcagcgattctgtggtgacaaaggctgcagaaatagagcgtctggaaaaagaattcgtaaaaaaagaagaactgttgaaagcactggcaaagcttcagaaacgttctgaaaatttaaaggtcatgatgaacctgtttaaaggagctggttttgtacaatatgtatcatcaatttatctgagacagctttgtgatcatgccaatgtacgtttccacagaatgaccagaaaccagctgagtctacagcttaatgaaaataacgatttcgaaatcattgattacctcaacgaagggaaaagcagaagcgtaaaaacgctttcgggaggacaagcttttcaggtatcgttgagtctggctctcgcactggcagaaagtgttcaggccaacgcgcaggcagataagaatttcttctttattgatgaaggtttcggaacgcaggattctgaatctgtgaatattgtctttgaaacgcttaccaacctgatgaaagaaaacaggattgtaggtattatttcgcatgttgaagaactgaaagagaaaattcctaccgctctcaatattatcaaggatgaagaaagaggaagtatcattgaaattatttagttcaatatattgtaaataacaaaagccacaaaagaaacaaatctttcgtggctttcacacctcacaaactttcctgttacagtccttttataacaggcttcacttcatttccaaacaattctatagatttcatcatcacatcatgagcaggatctcccacatccatatgcccgataaatcttgtgattccaaaaatctctttcatataagcaattttatctgttacctcagccggacttccgataaacagtgcaccgtctttacttcttccgccttcatactgtgcttttgtgtaaggagcccaacctctggaagcgcctattctgtccatctgcgatttataattatgaaaatatccatccaccactttctgatcatcactcacaaaggtatgggagtgaatggcgatctgcattttcgaaacatcatgtcctgctttctgatattcctgtttatagaattcgatcagattcctgaattggataggcattcctccaataatggctactactaagggcattcccaattgtgccgcacttaaaacagactgaggagttcctcctaccgctctccagatggaaagttttccgtcattttttgctcttggatataccgtttggttctgcatcggagcacgaagttttccagaccagcttacattttcttcagaattgattttcaacaataattctaatttttcgtcaaatagctgttcatagtcattcaatgaataaccataaagcggaaatgattctatgaaacttccacgtcccacaaatatctctgctcttccgtctgaaataagatcaagtgttgaaaaatcttcatatacttttaccggctctgaagaacttaaaacagttactccactggccagctttacatttttggtaatacttgctgcagctgccaacactatttccggtgaggaaacggcataatccggacggtggtgctctcccattgcgaaaacatcaattcctacctcatccattaattttacctgatccagtatttcacggatcttagttcctgcatctctatattttccggttgactggtcaaaagccaggtcaccgaacattcctattcctaattccatattgttgattttagtgatacaaagttaccactatggaaaatcaaaaacattgatgtttgttaagatcggaagatgattactttaaacactaattacactaatggatcactaataacgcgagagtgtcattgcgagcaaagcaaattgtgcttttgttggaaaacgcaaaggcgcgaaaggatctttatcttcattctgtttaaggcgcaagaaaatcgaagattttcagcaaaggtcagttcttatagtattagggactataaaattttatcgcagataaaatctgtgcgccttacgacataatccattagtaatcttgtgcctttgcgttttccaaaaaattagcaaaaacaaaaaatccagccgttccgctggattctattattatttcttcagatataaatcaaaataatctgtaatcttctgcatcaggtgaaccctgtctttcccgatcacattatgcggatgtcccggatacgtaaagtaatccagctgaactccgttatccacagcagacttgatgaatttgatagaatgctgccatactaccacatcgtcctgcgctccatgaatcatcagtaattttcctttcaggttctgaactttatccaaaagattggctgcagcatatccctgaggattttcctgcggggtatccatatatctttccccatacatgatctcgtacatgctccagtcgattaccggtcctcctgctactcctactttaaatacatccggcttgcgaagcataaaacttgtcgccataaatcctccgaaactccacccatggattcccattctgtctccatctacataaggaagagattttaagtactctacacctttcatctggtcattcatttctgtagttcccagatttctgaatacagcctgctcaaacttcaacccacggttggaagaacctcttccgtccattgtgaaaatgatgtatccgttctgagccatgtattcgtaccaaaggtttccggaagccgggaagctgttggtgatcagctgtaaatgtggtccgttgtacagataaacaatagtcggatattttttattgggatcaaaatttgtcggaagaatgattttcccatacaaaagagtaccgtcgtctgcctttacttctacatttttgatttccggtctctgataattctttaatggattttcagaagtaagaatattggtagtctttaaattggctgtattgatgatattggcaactctaggtgaattggcattgctgtaggcatcatacaggtagtttccgtcactgctcaaagttccggcatgcataccttccgcactgtccagtctctgcatcttaaaattcgtccagttgattctgtataaatgtctttccaaaggagtctctttcgtagaggtaaaataaatttcctttttcttttcattaaatcctaaaatatctgttaccagccaatctccttttgtaatttgtgctaccagtcctttttcaagactgtaatggaacagatgattatatcctgttctctggctctgccagataaaatctgtgttggagttcgggaagaaagtaagcggatgttgtggttctacatatttactgtctgtttcttcaaacagcgttttcaccaattctcctgtaacagcgtcatattgattcattttcatatgattctggcctctgttcagaacgcctacaaaaatgtattttgaatccgggctccaggtaactgcagtcaggtactgatctttttccccttcaatttttaagaaagtagtagattgtgtcttaatattgaaaacgcctaatgttacctgatgagaagtctggccagccatcgggtatttgatgttgtgattgacagcaggagttacagaccagtcaatgatcggataatctgcaaccatgctctgatccatcttatagaatgctacactctcagaattgggagcagggaaaattcctgtatcaattccgaattcatttctgtgaactgcctgaccgctgatgatattttcattggtttcgttagttacagcaatcgtttttccgttcttatttacaaataaattgttctttaccgtgaaagcaaaggtctggttatctccaaacatttttatgttggctgcatcctgatcaatgacagctgtactctttactttccagtcatttcctgatttttcaatccaggacattttaccaccagcagcaaaatagccattggaatttcctgtgaatctgatggcaggaacagctttcagtttatcattcgtaaactgtttattcaattgggtaagagataccagagtatcctgcttattggttttcagatctgtaatcagataaccacctttcacagcctgtatgtaagactttccatctgcagcccacgaaaactgggagatatttttcacagcaaggttggtcctcattccatttacagcctccgccatggtgaacttctgggtctgggcaaatgctgaactgcctaaaaccagcatcaataaagaaaatttatgtaatttcatcgtataaaattgaatcctccaaaaataagaaataaaaaccattcgttaagaaatgttaaattaaaacattcataaaatggaattcattcattgaaagaaattatttcttaacttaatagtagattttttaaaagagattaaataagtcaattgtgaatagtcaattcgctgcgcttgtcaaattttattgctggaaagatagtattcaccattcacttgcgaagcaaaattgacgattgatgtgctaaataagcaattgtgaatagtcaattcgctgcgcttgtcaaattttattgctggaaagatagtattcaccattcacttgcgaagcaaaattgacgattgatgttaaataagcaattgtgaatagtcaattcgccgcgcttgttaattttaatttattggaagatgatagtattcaccattcacttgcgaaacaaaattgacgattgacaaaaaaagttcatttcttatcctatatcaatgacttgtataggtaagctatcctaaatttgcatcattaataacaaacaaaaaatataaaatacaatggcaacaaaatggattttagaccctacgcatagtgaaattactttcaaagtaaaacacatgatgatctctaacgtaaaaggaagtttcagaactttcactgctgaaattgactctgaagacgaattctttgcaaatgcaaaaactacggctactattcagacggattctgtatttacaaacaatacggacagagacaaccatttaaagtcagctgagtttttcaacgctgaagtgcatcctacaatcacttttgaatcacaggcattaaacaatactgttgtaggtaatcttaccatcaacggaattacaaagccagtaacgcttgacgtagatttcggaggaattaatgtagacccatggggaaatacaaaagcaggtttctcttttgaagggaaaatcagcagaaaagacttcggattaaactggaatgcagctcttgaagcgggaggtgtaatggtaagtgacgatgtaaaagtagctggtgaattacagtttgtaaaacaagcataattaacaacatataatataaaaggttcagggatttgtctaaaagccttgaacctttattctttttataatcttcaatattatgaatctcaatgatcttcaaaacataagcgacggttttaaaaacactcagagaatgcctgttttatttcttggacatggttcgcctatgaatgccattgaagaaaaccaatttgtacagggattccggaaagcggcttcagaaattccaaaaccgaatgcaatcctttgtatttctgcccactggtatacagacggaactttcgtaacggcaatggatatgccgaaaaccatccacgatttttatggttttccaaaagcactttttgatgtacagtatcctgctccgggaagtcctgagctggcaaaggaaacagcggaacttcttctccctgttgatgtagaggaagatcacagttggggactggatcatggcgcatggtctgtgatcaagcatatgtatccggatgcggatattcctgtgatccagctgagtatcgattatacaaagtctccacagtatcattatgacctcgctaaaaggcttaataagcttcgtgaaaaaggcattctgatcatcggaagcggaaatattgttcataaccttcgtcttatcgactggaaaaacatcaatacagtaggagccggctgggattgggcagtggaggcacgggaaaaaaccaacatctggcttctggacggtaattttcagaatatcatcgattatcagaaacagggaactttcttacaatatgccgttcctactcctgatcattatcttccgttgctttatactttaggattaaaagatcagtctgaagagcttactttattcaatgatgaacttatcggtggctcactgagtatgacaagtgtaaggatcggataatatgaatattaaataaaaaaagaaatacctcagccgaggtatttcttttttttatgactgtttttttattgtacagcttttaaagcattgatgtttccgtagccgtagcttgaatttacactggaataataggtggaagcctgtctcattttagtgagtacctgctctctcgtccatgacggatttttagcccaaaccaatgccgcaattcctgctgttgctgccgttgccacagaagaaccgcccacataatctgcctgcccgttataataactaagcaccggaacggtatttcctgaaggcctttccatctggaaagtaaaatcgatctgacttcctgagtgacagacatcacatctctgattggaagtattttcttttacgcctgtaatggcttgagtttccggcatagatgcagggaaaattacacccacaaaattagtgaagctggtagaagttcctcccgcacagaaaatcagttttccttttgaatacgcatacttaactccatcttcaatttttccaacggaaaaaatatgccccatcgacatagaaatgatctttacattggtattattacccaattctgtgaaagccgtttttactgccgtctgctcgctggaagtttccagaacaacattttctgctgccctgtatgcaataagattggcgttataagctacccctacaggtaatcctgcattatttctgggagctgccattacagaagccattttggttccatgaccgcactgatctccagaaccgtctgaattatacaccccgtatttactgatcgttctccctgaagaagctccgttgttaaagctgctgcccagtaaagtctgttccggagaaactcctgtgtcaataagtccgatagtcactccggctcctgtgctgtagctccaggcttcaggaatactgtgtttggtgaaagcccatggaatttttgcgccaggcgttgttgaggtataatctgctgtactcaatgtggcagaagaaaaaccacatcccgatgaaccacttccggaagactttgcagcagtattatactgagcttcaaattcaaaataatgataatctgccggttctacatatcggattgttttcatttgccggagagccgtgatggtttcctcgttttcaatgacaacatccatctgattcagatattgatctgaaaggagaagaaaatttctttcctcttttccttcatactttctgatcacagaaagaacttctttctccatatcactgctgtttggagatttacttctgtcaaagtcatcctttgaagctccgaaaccgatggaaaccattttgtttccacggaaagcagcactccatatgaaatgatcggattcattcttccagttgaaagtaccatctgtttttatagcctggttgatcctttcattgatctgttttgcagtcaaaggatctttctgagccatttctgtttttacattttcattctgaagttcttccctggtacacgagtttagggcaaaaaatattgccagtaggaatacagtttttttcatatgttataattttggttggagccacaatataacactttaacgggaattaaaaacttaaaaagagtaaatttagcattacaggaatattaaattacagtactttttcatagcagacactctgctcaacgccaatgtattgcccataattgggtattctgctaaacccgcttttttcgtatactgaaattgcatttttaagatcccttgaggtttccaggactgcttttttaaaattcagttctgcagcccagttttcaagttcttttacaatggcagagccaagtcctttttttctgaattccggattggtaaacattcttttaatctctacggtatcttccgaaagcggtttaaaagcaccgcaggctgccggaatattatcaatgtaggctacaatacagtttttgatggtatcaattttattgaattgagcaaagaaatcatcattttcaccattatgttccgataaagtggcgtcaagggattttacaagagtttgaaaatctgtattggcagaatctgttctgagtatgtgcattttgtttgattaaaaaattaaaaattaaaataatttaaagatctgtgaaaacaaaaagcttccttctggaagcttttattttatggagctggtgggggtggattttgaaaatgataatgtttatttaatttatcattaacccttttatctaatacttctgcataactagttccaatttctcttgcatccttcattaagtttggcatattttcaatcattttctgtcctgccggagttttataaaatttaataagctcatcaacgtctgaatcagtaaaatactttttataaacaggaatgtataaagcaaaaattttctccggtgacatgtcttttttaaactcatcccaaaaactctcaggtaaatctttatacttattgttataatagtccataaactgttgaaaagctatagacaacatcttatctgatcttgttaaagtgatcagttctttcaattttgcttcattggactgagaaaaagcatttattcccaataagaagaaacacaaaataatacctttcttcatatttttattttacatcaacaacaaactttctctcattgatcaattctgcgatcgctaacatgtctttaccgataagcctgtcatcttcaagcttagcaactttggaacgaagaatcgcgaagttttcctcaattattttcgagcatttggcaggtcttctgaactcaagtccctgagcggcaaacatcagctcaacagacagaatattcacaagatttccaagaacctgattgaattttcttcccgagatacttcccatagaaacatgatcttcctgacctaaacttgtaggaatagagtctgccgatgccgggaaacataatgttttattttctgtaaccaacgctgcagaagtatattgagggatcataaatccggaatttaatcctgagctttccgttaataatcttgggagcccatattttccttctaataataagtaacttcttctgtcagaaatattccccaattctgctgcagctaatgtagcatagtctaaaggcagtgccatcagctgtccgtggaagtttcctcctgaaatagattcttcagcacttagaacaatcgggttatctgttacggagttcagttctgtttccgccatacttctgagatgttcaaaagcatttctgctggctccgtgaacctgtggtacacatctcatagaataaggatcctgaactctctcacaatcttcgtgagctttcaggttttctgatccttttaagaatttaagcattcttgctgctacttttttactgccttcaaatggtctgatctcatggagttcctttttgaaagggctggcagagcctctgtaagcttcaatactcatagcagcagtcatatctgcaaggtctaataaatattcaaatttttcaagtcctttgatcgcatgagcaagaataaactgagttccgttgatcaatcccaatccttctttaggccctaaaaccaatggttcaaggtcatgtttcttcagaacctccatagtatcagacacctgctctccttcccaaacctgtcctaagccaagtaaaggcaatacaagatgcgctaatggagcaaggtctccggaagctcctacagatccctgctcaggaactaccggaatgatatctttttcaagcatcaggatcattctttcaataacttccagagaaactcctgaaaatccttttgaaagggcatgaaccttagcaatcatcataattttggaaagttctttatctataggctttccaacacccaccgcatgagaaatgatcaggttatattgtaactgagcggtctcgtcagccgaaattttagtatcacacaatggcccgaaacctgtattgattccatatacacatcggtctgactctactattttctgtacgtttttctgagattttaaaatttgttctttggcagccttgttcagcttggctttattaggttttttacatatttccagaacatcatggaatgtaaagacatctaccccgtatatcatttctaaaaaatttccttaaaattacgcatttaacaataattggaaaagctaaatttcaatcttctatatttttataaagcaagcgaattaatttactatttttagccccgaaaattaaaaacaataatacatgagaatgaaaactctattccttgctttatgtgtagcaagcacagccgctttcgcccagaaagtaaaatattctaaagaagaaagaaaagaaatgaaccgttatctgtttaatgaaggtttcaatacggcaacagataaaaaagtttctaccattatattgaaagataatactgagcatcagggttacagtaaatcatgggaaaagcaaaaagggcagattctttctatcaccattgaggatgttgacaccagaaagcctatgaaatttgcagcagcagatattgctgaaatgtacttatacgcaactgagactgaaaaatcgatgaaagcggcaaagtttatttccaatatgagaaattacagtactaaaaaatacagcaaatctgtaactgatgacgcaattccgtatgaaaaccagattgtttctctaaaaaataaaaaggaacctaaggcctttttaatgcaggtaatcaaccctgaatttaatgaactaattacggtttatcacgatccgtttgcttcagagactgtatccacaggctttgccggcgctcctgcatttggaggtggtgttatcaaatcttattatgtaagaaaaggagataaagtaatgtggcttcacaaagatgattttgaagataactatgattttctgtttggagacaatgccgaatttatgaaaaagtatcctaaaaactctgtagaatggaattatcttagctttctgatctatcagtatactgaaatgagccacggataaaatagacattcatcatacaaaagcctgtagagccatctgcaggtttttctttttttaaatagggaaagtttccttaattttgttatatgaatccttctttagaactacagctcaaaaccttaccatccgaacccggcgtttatcgttattatgataaaaatgaacagctattgtatgtggggaaagctaaaaatctgaaaaagagggttctctcttatttcaacaaaaatctttccggatacaggatcaaaataatggtcagtaaaatccagcgtctggagacgaccattgtaaacagcgaatatgatgctcttctattggaaaacaatctgattaaggaacatcagccgttttataacgtcatgctgaaagatgacaagacttatccatggatctgtattaaaaatgaagattttccaagaattttcctgaccagaaatgtgattaaagacggatccgaatactatggtccatatgcaaaagtgcgtcctgcaaagattttattggataccattaagcatatttacaaactcagaacctgtaacctgaatctttctccggccaagatcgcagaaggcaaatataaagtgtgtctggaatatcatatcaaaaactgtgaaggcccgtgcgaagaccttgaaagcaaagaagattatgatgaaaagatagatgctatccgcggaattattaaaggagatttccgaaaagctaaggagtatctggtgaatcagatgatgaagctggcctccaatcttaaattcgaagaagctcagattattaaggaaaggctggatattcttgaggattatcaggctaaaaacaccgttgtaaacccgaatattgatgatgtagatgtatttggaatgaccagtgatgaaacagccgcttacgttaacttctttaaaatccgaaacggaaatatcatccagagtttcactacggaaatcaaaaagatccttgaagaaactgatgaggatattatggaagaagctttgatagaaatccgtcagaagttttcttccgattctaaagaagttcttttacctttccatttgtctgtggaaattcccaatgtaaaactgattgttcctaaagtaggagacaaaaaaagaattgtagaactttctgaaaagaatgctaaagaataccgtctggaaaaactgaaacaggttcagattgtagatccggaaaggcataccaacagaatcatggctgaaatgcagaagcttctgagaatgcctgtagagccaagacatattgaaggttttgataactcaaacatccagggaacaaaccctgtatcagcatgtgttgttttcaaagacggaaggccaagtaaagctgattaccggattttccatccgaaaacagtagaaggacctaatgactttgccacaatggaagaggtcatttatagacgttataaaagaatgcttgatgagggtgaaaaccttccgcagctgattctgatagacggtggaaaaggacagctgtcttctgcagtaaaaagcctgagattactgggactttacggaaaaattaccattgtaggcatcgccaaaagactggaagagattttcttcccggaagatcctataccattataccttgataaaaaatctgaaacactgaaaatccttcagcgtgtacgtgatgaggctcaccggtttggggtaaaacatcacagaacgagaagaaaaaactctaccatcaaatctgaactggaagaaattcccggtgtgggagaaaaaactattgaactgctcctgtctaaactgaagtctgtaaaacgcatcaaagaagccaatctggaaactcttgaagaaattctggggaaaagtaaagctaaagtgatttgggaattttttaatgccaactaattgtacagtgtcatagttaattttctaacagaagacacaatcattcttatgcgattttatatgatttctcattttatcaatatgagacaaaaaccaacacttctttaattacagagtaaatccatcaacaaaatacattaataaataaatattttatttaaaaatattattatatgtatttttttcataaattagtgttatcaactaataacaataatactatgaaattttttcctgttttataaattctatcacattctcacaaccttttataaataaccagaaattttattaagaagtaatgtttctactatcaaaattgaaaaacacatcagcatatatattattaaaggctctttttcaagagcctttatacttattgtttatggtatttttattattttgctgcaaaaacttctttagcatatttaccatctgtctgaggaatatcaatcacgatatttccgttttcaaaataacctatggtagtacttccatcagataactttacaaggaaaacagaattcttagacgttgctttgaaaactgcaaacggcactgagctgccagactttgccagaataaactgatttggatcaagttgtattttctgaagatccagcttgccatttgagtagttattcgcctccggagttgttgttgttgttgttgttgttgttgttgttgaaggcacaactgtttcaggaaatgtacgctgagcaatattatcagatgccggtagcagcgctacaggattagaaaccgggatttttatgaaagatttcttaagagcatctggataaccctcttcaaactctttaatatttgaactctctttagattcaaaaacaattttgtccttacaattcttaaactgtaaagttactttattaacaaaaagacttgagctgtcaagaatatctgcaataagtacattacaggaattttctttagcatcagaaggccactcttctttattcataggtaaaacaacgtattttttactgctcaaggacatttttaaaatattttccaagccaaagctatcttttttaaatgtttctaatttttctggaatagctacatatttataatctgaaaccttttgtgcaaaagccattgtagaacatacggctaacactaacattgataactttttcattttaattattttaatcatttctgaatgctcccatatccagttttaaggaaaagaaattggaataaaaattagatccgcctatccctgaatttgtaatcgcgtaatccagtgtaagccctctatatctgattccaagacctgcacttggctggaacgaaacttttcttttaagatcctctatatctgttatcgattgaaatctgttaatccccaatctcacaaaaatcattttctgatatcctaattcagctcctgcataagggctgatacttgcaaaatctgtagaaatcaatgaagcggttttagcaaaatctacattcagaccggcttccggaagtacatatacactgctgttgatttcaaatagtttactggctcccacatttagtttgggcatggtaagctccattttatcttttggcgccgggttaaattcttctccgttgacaaccgttgaaagttctttttgattcacactccagaagtttacagttgtggtgatgtccctcaccattcccccgaatttccatccgttatctgctttgtaaatggcacccacatcgaaaccgaaaccataaccattggcaaatttccctacatttctgtaaacaatttttgcgtttaccccgacatctaattttggatttccacccggcctgaaggcataggataaaatagccgcataatcggattgggagaattttgtaattttatcataatcaatattcccttcagaatcgatcatctgcgtggtattcaaaatattatctactccaagccttactactgaaacaccaaaaacaccttcttcaagaacctttgcataagccagataatcatattttgcaatggattcaaagtattccgcatgcattgctgccccttgccagtccctctccacagacatcaaacccgcagggttccacattggagcgtacacatcatcctgattggaaatgactgctcctcccattgcaagtcctcttgctccggctccgatatttaaaaattcattcgagtattttctgataatctgagattgtgagagcccaaaaagtagtgaaaatgcaaataaaaaatattttttcatcatataaatttgatgcttagtttaagtttttagtttttctggctttaattaatccatttgcaatgattgccagtatcataacacctgaagcaatataaaatatggggctcatatgttctgattccccaaagataaaaaaagctagtataattccgtagacaggttccaaattaactgttaaaattaaagtaaaaggtgatatatacttcattaatttcactgactccagcattggaaaagccgtaaatacactggctaacaagcatattaacgccaaatccctgtaatttatttcatttatctgaaaaatctgccccgaaagtaaataaaatatcattaaaataaaccaaccacagaatatttcataaaaaataatatttcctgaacttgtttttccaaacatttttccgttaaaaacagaaaaaacagtcccgaatatagcacagagaattccgtaaataatcccttctttaaagtgaaattctgttttaaagatcaataagatgcaagccacaatgactgctcccattactacctcagatatatcaatttttcttttgaaaataattggctccagaatcgaggcaaaaagtgtagataaagaaagacagctcaatgcaatagagacattggaaactttaatagaataaaagaaacaataccagtgcaacgccatcgcaaaacctatagcagccagctgaaaaaatatttttttggaaacctttatactttctttcttaaaaacacgaataaatatgaaaagaaaaacagaagcgaacaacattctgtaaaataccaggatctgagcattcgcatggattaactttcctaaaattgcagtgaacccccataaaaaaactattaaatgcagcctgaaaagtgccaatttatgcataccctatctccttttaattttaaccctgcaaatttacaaatcacaaacccaaatattgataaaaagataagtttaatgtaaaaaaagttaataaaaattaaattgacatctaattcataaaaaaaccctgaaaatttgttaaactttcagggccttcaaataataaactattaaaaaaataaactaggaacttagagtatttttgcagagaatatcacctctgttactctagtgtaaagttagaaaaaatataaattatttaaaaatattttttagttaaaaatttcacaatttactagaaaccaaactattaaacacttgttttacttcctatttatattcctcataaaaatagtatctttaagcgtaaaaaattgaaaattttatggacatcgaattcaataaacgtgaagatcagaacagactaaaattatctgaaataaatcgcttacttactgagatcaaaaaaggaggaggtgagaagaggcttcaaaagcttcgtgatgaaggaaaaatgacagcaagagaaagaatagattatcttctcgataaagattctgattccatagaagtaggagcatttgcaggatatgaaatgtacaaggagcacggaggatgccctagcggcggagttgtagtagttatcggctacgtttccggaaaacaatgtattattgttgctaatgatgcatctgtgaaggctggcgcttggtttcctatcacaggaaagaaaaacctgagagcccaggaaattgccatggaaaacaggcttccaatcatttacctggtcgactctgcaggtgtttatcttcctatgcaggatgagatcttcccggataaagaacattttggaagaatcttcagaaataatgctaaaatgagttcaatgggaatcatccagatctctgctgttatgggaagttgtgtggccggaggtgcttacctgcccatcatgagtgatgaagctatgattgtagataaaacaggttctattttccttgccggaagctatcttgtaaaagccgctatcggagaaagtatagataacgaaacattgggtggtgctaccactcactgctctatctcgggcgttactgattataaagcgaaagatgacaaggatgctttgaacagaatcaaaaatatcatgaaatctatcggaacaactgagaaagcgggtttcgacagaatagaaagcttcccgccaaaagaaaatcctgaaaatatctttgggatcatgccggtttccagagctgagcaatatgacacctacgaaatcatcaaatgtattgtggataactccgaatatgaagaatacaaacctgattatggcaaaagtattatctgcgcaacagcaagagttgacggctggtctgtaggaattgtagccaatcagagaaaactggtaaaaagcggtaaaggcgaaatgcagtttggtggagtaatctactctgattctgctgataaggctacaaggtttattgccaactgtaaccaaagaaagatccctttgatcttcttacaggatgttaccggatttatggtaggttccaagtcagaacatggcggaatcatcaaagacggagctaaaatggtaaatgcagtttccaattctgtagttcctaaatttactattatcactggtaattcttacggggcaggaaattatgcaatgtgtgggaaagcttatgacccgagattaattgttgcatggccttgggctgatctggctgtaatgggtggagcacaagctgcaaaagtattagcccagattcaggaatcaacattaaagaaacaagggaaagaaatttcagaagaagagcacaacgaaattctggacacgatctcaaagaaatatcagaaacaaaccgaggctacctatgcagcggcaagattatggacagatgctattatcaatccggcagatacaagaaaatggatttctatgggaattgaagcagcaaaccattctcctattacagaaaaattcaatctgggagtaattcaggtctgataaatctacataacaaaaaaaatacggctatctcagtctgagatagccgtattttttatacttaaaaacaagcaatataagttttatttttaaggagctgtttcccgctatccattcatagtcctcgcacctgcaccctcccacgctcaaaccctaccgcactccagctcctgctgcggggtaaccattcctatcggggctaggagtgaatgagtgatgaatgataagttataaatgatgtgacgagattcgggatacaggttctgtggttatcttttcctatgagtaattgattccaatggcgtctttctttttcatttttgctgcttctttctactgtgtcattcgacaggaatccaggttcctttatgagagttttaaacgatttaaaagggtaaaagtaatacttaagttatgtgctaatactttgcagagactcctacggagtgacaatagggtatgtgatgaatgtcaagtgataagtgatggttgataaatgataattgattgatgtatcgtttaccattcatcaattattacttattacttattactcattgcttattgcttattgcttatacgttcggtataaagcaaaaaaaatcctctatcatttgataaaggatttttaaaaataaaataaaaactggcggcggcctactctcccgcgttagcagtaccatcggcgctggtgggcttaacttctgt

SEQ ID NO: 8 - DNA, 123058 bp, Chryseobacterium sp.
gttcccattcctttaaagttttttttcgtctgtctcttgtgaagtaataatgttcctgcttagctaaaagcccttctgcgcttactgatctactctcgttttcagtggggcaaagatagtaacttcctacaacgcaaaacaagtttatttaacttaaattttaccgtttcgtaatatttgctcttaaggcactggattgcagggagaaaaattttaaacatttgtttggggcttgggctggagagttggagtgtatgagagtttgagcgtttgagcgtttgagcgggggagggtttgagcgggggagaaagagagaatgatgatacggggtgtggggttacaggatgcggggttgaccattgatcaaaatagtgtatatattatataatagagaacagactatataagaaaacagggtttcttcgacaagttcaaaattatacctgtttcctattgaattgatgatacaccatattatatatcaaacacagcgttctcactccgcagaagtccgggcaaaacttttccgtagcatgacaaggctaataccaattgttaaaaaagattttagacattatcctgccaacttgcatcctttaagggctttggtcaagaggtttggattcctgcggaatgacacaaggggataaaggcttgtacacactaacccgaagctcgcaacacaataacccgaaccactatattctcctaccatgaaattcatcattcatcattcatcattcatcattcattattaaagactccttccctagccctgatagaaatggttaccccgcagcaggagctggagcgcaggagggtttgagcgtgggagagcgctggcgcgaggagtaaaaatggatagcaggattaagctccataataaagagggagtgtgagagagtgagaatataaaagtattgagaaactgaagtggctcgcttatattatctcgctttaatataaagatggagtagagtgcttagcagtctttcgaaagtgggatcagaaaaaacgttttatcaatagtttataggcatagtaacctaacaggcacccgatagtatctgcaacgatatctaatgtttccatagatctgcccagtcccatttcttcctgcagaatttcagtaaggaatgcataaataaggatgatctgaaagaagtaggagaattttattttaggaaatgtggcaatgaaagaaaaacccaaagccgcaaagatactgagatgcaaaactttgtcgataccattgaacatgaaccaatattcatggttttcttctccgggtttgagaagcatataagtaagaaatgcccaataaatgggcagtatcttactaaatatttttgaaatcttatccaatgatcgctttgtaatcatctgcagaaagtaactctgactgatctgctccatcagcaatttccaatttgatgatccatccgtttccataaggatctgtgtttaacagctcaggctgatcttctaagtctgaattaaattcaataaccttccctgaaacaggcaagaatagatctgaaacagtctttaccgcttctacacttccgaaaacgtctcctccattaaggtcatcatctacagtatctacatctacgtatacgatgtctccaagttctccctgagcgaagtctgtaataccgattgtagcaacgttaccttcgattctgatccattcgtgatctttggtgtactttaattctgatggtgtgttcatttttaaatttttattttgtacaaatgtattcaaaaatatagtagcttcaaatatcggatataaaaaaagtccttcaaaactgaaggacttttaggtttgtatcattttagaatccacctccggattcaccgaatgtaaatgtagctgaaataccggctctgattgtagacagcgggaatgctgtggaaatcttatactttgaggtcatctgttcgtagaataccctcaggttcagattctcagaaacattgtagtctgcggaaagtttaatgttcatcaatctttgtcctcctgtaacctgggcgtcattcaagaggatattcataatggaggttttactgtctcttaatgaaatatctcctctgatgttaagatcacttccttttcctcttgttcctcttcctctgatattagctgttcccaatctgaagtttctgacaatatatccaagtcttaccacatattctgtattggcatcttcagtaagcgtctggtttaccaatcccagcaccatcattctggttctgttatactgtatcccaaactgcatattatttctcatggtaacatctattccaataagcggcgagaaggattctacatatccaacctgtgcaaatgtatatgggttgatcttgtctcctgcatttttgattacattaccagcatcatctacagtctgataatatccgttcggattatcatgataatctacattgctttggatacccgtagcagtataggtcgcggtataagcatgtaaaatatcaaacttcgtgaactgtccgctgatgatcggaatattttttaatcctgaatacgtaattctccagtttggtaaagggaatcctgattttttaggattggtcatcggtgccacagactttccttccatagctgctctaaaggctggaatcaatacataggcgtttccgatgctataatgcggggcaaatccattgttatccaatactgctccaggcccccccaattgctgggaaagcgctcttgcattttctctgattgcctgataaatcgcctgtccatctttaaacgatgtgctgagaagcgttgtcgtattggaataggtcgtcaattcgttggcaaatgtaaagtccggatcaggaacgccattattggtatagttaaatcctgtatgtgagaagttactgttaaaagtatgcaatacattcaggtcaactcttaaatcgttcatcggcattacctgtaagtccgctctcaattccttggtagacattcttacgtatggatctgtcatatagttagaaccacttacccatccgttctccattaccgttcttctgatatctgcctgcgatcctaaaaggaacccaagtgtaggacctcccagtgtctgtccgtatccataccagtttggtgctgatattaatcccggaagcactgttccgtttgtttcattataacttatattcaactgcttgaaagaagtcaggaagaatgctgcactttgaagtggagtaagcctgtttttaaatttatactttttgtatctgtatctgttcttttcccattgttttgcatacacattattcagagagtccatctcctgtctgcgcttctgcagttttgcattgatgtttttaaaatagttaaactggccaaagaacttaggaagatctgctgaagccgttgcctgaataacattggtattctgacccactgatcctaaactagttgttttattattgttgttaggatccacaaatccaagcaatgaagtagatcttgctgcccagttgtaagtaaatccatatcctacttccgcatcaatgaaatccaggtaaggaagatactggaatggcagcttataatttaactgtgctctgtgattatacaataccggtcttcctgctctgaatacatttccgaagatcgacttattatccatagaattcacatccaggttatcattaagggttctggttgctgagttgatttccagttttaacgattttgtgaaattaaatcctaatccgtactgccatccaaagaagaagtttctgtttttgatggcatcaaagtcactgttcatatttccgttcaggattgcttccacgtttctgaattcaagctcgttataatttctgtcgatttcagttctaaaagatattcttgtaggtattggattaaagttgaattccttcacccatctcagatactttgtagattttgcggtatcgctgatcattttgttgaaaggtttgatcacccacggtttgaatgtgtagttgtaatcaatatatcctctcagatactgtctgtagttcctcttggtataaatgtccctgtaatagtcatcgttataaacagcagttacagaaacgttttctatatcatagaatttaggttttttatttggatttactctttccttatgcatatttacaactcctatacttctttgctgggtataagttctcgctacttttttcagctgatctttattaggggccttgctgaactccacatcggtgtccagaggattatatttcggatcttcgatagtctgtgagtaagaataatttaacggaatttttactccggttttttcaggaaggaatttgtctacattaatcgcagtattaatgctgaaggctgattgggtagactgggttctttctgcaggcttagaatcaatattaccgaaaccaacagatgtataggaggcattggcattcactgttgcaaggtctcccatattaaagtttaaactggcattccctgcatatcctccatcattctcaatttcagaaagacggatttcgttaacccaaagaactcttgttatagtggatgcccctcttggatcagagtttcttaccccaatcataatagtggtaatatttcctaaactaggtcgtcctttgatataaatatttttataaggttcctgatatgtaaggtcttttgttctttcagtgattttcaccccagacttatctcttctgattttcgcatctacaaaattctgaacatcaaagtcaacttcattttccattggccagatctccataggggctgttgctgtagtaggagtcatttttaaagatgattcatattcatagtagttgtcagtagcatcgcttccgaaacgtataaagaatttcgttttctcatcaattcctgtgatagtattagaaggatcgtgagcgtgcacaaacagctttagctttttgtatcttctcatatccaacgttgtatttttgaacacacctcttgcctcagtcttaagatctttcactttcatgtaaagtgaagcttcattctgtctttgagctcctgcatttccacttaacacttgtctatcaattcccggaggtaatacatacggaggctggttcagtgcattctcttcaatattcacacttcctacctcaaaattcgggtctgtaacaacccctataccttctcctgaacctggaatatttgtactggcaatgttactattatattttctccagtctgatcttacaagatccattgtcccgaatcttaaagtagacgtttgatcaaatcctgtcagcattaatctcgcaaatcttacgttatttaacacagatggatctgctgttccttcagctggatcataattcgccacaggaattctgaacaaataccatttaacgtctgaagtctgcccgttctgaaatgttgcttttactgtttttacatctacaatattattatttgccccaagtgataaacttggctggtcaagctttataacatattggttatagttttcagtctggtcaaggttataatctttgttgatatcttcagcatccggagtttgtgaagctacattcagagagtttgcttcggagtttccttccgggtttctgaaatatttatatcgttctaccactgaagcagcctgacttcctgtaaatttatcagaaagatagaatacgaagtcatccactgccgggtcagcaatattggttaccgggtttacaaaggtattcccgaacctcatggcttcctgatcagaagtaagaccgtcatatcctgcatcctgaattcttctgtcatctccttctgtagagaatgcatataaaattggtggctgttttggctgtactccccagtttgaatttgttgtagaagaaggtgttcccggagtaggaagtccgttttcatactgcatttttccatctttcagaacatcttcggaaacgtttcctaagtgaagtaaaagctttggatcagcacccagggttttaccatctgcataaggatccatcatccagaattcaacatattcaatatttgaactcacaaagttcggaacgctgatggatctcataatcccagcccatctgctttgtgtctgttctgttaaaggattaacgttatacggccctttttctttagggaaataagaaatatcgaaagtattcgtaaaggtttgttctcccgctacgaaatctctgttgttataaatctcagaatattgcacccttctggaagcgtgattggatacagactgtggtgtgatccctgcaggagctttccctccgacaccccagaatcttggatcaatgttataccatgtcagcaatcctcttccatatccactcgttatatcatcatccgccggtattgtattaaatggtggcaacttatttttttcgggttttgatgcaaggctccatgctgcaggctcttttaatgatattttagaagttgtctgttcaaaatcgtcaatataagactggttattggttcctttattcaatcccggtaataaataggcagcttccatcttgaagtttaagttggatggagcttcggtttttaccatcggaagtttattggtaagtcttgtaaggtaaggagcctgattgttatacatcaggttgatcccagccatagtattatttactgcttcctgcccgaagtttactttctgagtcaatggagattcagaataattgattactgttccacccaggataaagttttcactgaatcttctttctaagtttaatcctaagaatctttttctttgggtattaaatgtaagttgattttccagtgaaatattgatggcctgtccggactgctttacattttcattgatgatggtaaccgttcccagcatatagtctacggtatagtctacaccttcagtaagctgtaccccgtttgccgcgactttcaccgatccctgaggaacgtttactgctcctaaagaaataccttgcccctgaacacctttataacggccttccatggtatacctttgtgaaaggttactggaagaagcttctagtttttgcttggtataaagatcctggaaaacatattgaggatcaaaggttccacctaaagccttttgcatataggcaccaaagggctgtactttggtaaagatgactcttccggtctccggtctgatggtaatcccattgacaaagtcgaagataccgtctcctttacttccatctttattgttctggatatcaccgttcatattaaggcggtcccagttaaataattttagtaagttctgatcttttacaggcgtgtccggaaggtagtttaccttacctcctgttttgggatctctataatatacattaaggataaatccgtcctgagcaacctgtcctgcatctatagagtagatattcttcatcatcagatcccacatcggagactgagtgttgactttgttatttactctcaatactttagtaaccagtacagggctttcttcagaaaattcccctactttgtatactttattacttccgttaacggtataagagtatgaaacggctaaaagctgctggtcattaagtttttggtttaatgaaatatacccaagctgtggctgaaaggtaaattcattagcattcagttttcttgcttttgtagcaagaataaattcttctccgttactatagggagaaggatttcccggaaagacatgcccctgaaaaagagcattgtaatttttcccagcttctctggtaccggctacttttgatacttcatcatataatccattcaatgagttatctggcagagtaattcctcccggaccttcccccaggtctctgatcccgataatacttttctgatacgccagattactgtttccttgatcaagtacccaaacttccattctggtaatattgatggttgagttgatctgtggataattaaggagtgcgtcatcatacttgttcaggaaataatgtcctataaaaaagtgctggttttcttcatagtcaatagcattgactttaaagttattcataactccaccaccctgaactacaatgttacgggcttcaccctgttgctgggaaaggacaactgttccaaatgtttttcctaactgaaactctgtcttcaccccgaacaatgactgggaaccacggataagactggttgaaagcggcatgtttacgttaccgaattcaactcttttgattattttatcttctcctccttcgttaggtttatctacatttccaaggcctttgctttgaagatctttccagcttccttttgcctgccaaacaaggttcatcctgttttcgaaagcaaaaccactctgggtatcataattggcctttaactgtaagttttcccctactttacccaataaccccagttgaattctctgatctatatcaaaggtaaagctagtcctgttttgtggcaggatcatcgggttatctattttctggtaaagtcctgcaaaatcaagagatgcatatcctgaaggaataatttcaattttattaccaccaaaaatagtttcaaaaagcctgttgttgatctgtaatgaaggaataagccctttctttctggcatcagttctgtctctcctgaagagaaggttatatttatcagatttctccttataataagcctttgtctggctggcaagcatatattctttatattcttccggagacattgctgtaggaggacctgtaatggtatttccgattttgggatacacgtagtacatcccggtttttatatcgtaataggcttcgtacctcgtagggtcggccacttcatattgttttcttatgatcgccgtatctttttgtgcctgcgcgaaagcactgacagacatacacaggaacgacaggaacaaaaatatgttaagatgcttaatattcgccaccaaatgttaaatgttttttaagatttgttttaccaattcttctaccgagatgcttggattttgttttataattttatccgcaatcttctcactggttcgtttaggaatgcctaaaacttctaatgcagataacgattcttccttaattttattatctaccatcacagaaatattcgcattaggatcactgtatttctgcactttatctttaagatctacgataattctttccgcagtttttgccccgattcctttagctttctggatcaatgcactgtttcctgaaagtatggctgaagcaatctcatccaggctcaaagttgacaaaagtataagtgctgagacagcccccactccattaacacttattaacagattaaacatttctttttctgaacgtgtgttaaatccaaagagaagatgagcatcctcacgaatgatctgctgaataaataaaaaggtctgctgattcaaaaccaacgtctgtgaggtcatcaaactgattcccacatagtaaccaactccttgcacattgatgacagcataggtaggtgtaagttcctgaactgtgccttgtaaagaaaatatcattattaatttttaaaactcccaaatatagcaatttaaactaattaatgttttcatttgatctgagaatgatttttaacttaaatttcaaataagaattcaaggaattaacagaaaaacaaaagactccaaaatatggagtcttttttgtatctgaacacctcttatggtgttattttttaaataatatttgtatgtctttactattttttctctcttctctgagcatcaagaacggcaatggtagcaaggtttacaatttcatctacgcttgaacgcatctgaagtacatgtaccggttgtttcaatcccatcaggataggtccgattacctgtgctaccttcatacctctcaggattttataagaaaggttggcactttcaaggttcgggaagatgaatgtattggccggagttgttcctaattttgagaacggataatcactcaggtggtctgcattcattgcaaaatcaggctgaatttcaccatccacaaccattttaggatatttttcatgaaggattcctactgctttcgcaactttcttggaagtttcagagatggcagcaaaattttcaaatccaagcattgcgattcttggttcaatagcaaaagattttactgtaaattctgccattttagcaatatttaccagatcttcagctgtagggttctggttgatggaagtatctgcaaagaaaataggtttcttttcagacaggatcatcatcattgccgctactttgtctacgcctttatctttttcaataacttctaaaacaggacgtaaaacggaagtatagtttttagagaaacctacgataagtccgtcagtatctccatgcttcagcatcaaaggtccgaaataatctctctgacgaacatatctcttcgctttgtactcgttcattccttttctctgacgaagcttccaaagggtttctctgtatttttttctgttttctttctgatcatcatcacttggatcaatgatagggacatccagagtaattccgtaacgttccatctgttccttgatgtactttttatcccctaaaagacttgggtatgcaattccttcttcataaaggatctgagcagctttcaatacattgtattcttcagcgtttccaagggtgattcttttcggattggatttcgcacggctctgcatcattcttaccaatctttcatctctgcccattctgtctaaaagctggtgctcatattcatcaaaatccgtaatggtttttcttgcaacaccactttcaatagctgcttttgccacagcgcttgatacttttgtgatcagtctgttatcaaatggtttcggaataaagtattctcttccaaactgaaggttctgaacgttatatgctaagattacagcttccggcaccggttcttttgcaaggtcagcaatggcgtgtaccgcagccagtttcatggcttcattaattcctgttgcctgtacatccaatgcaccacggaaaatgtaagggaatcccagtacattgtttacctgattaggataatcacttcttcctgtagccatgatcacatctttacgggtttcaattgcaagatcgtaagcaatttccggatcaggattagctaaagcaaatacgataggattatcgttcatgcttaaaagcatttcaggagtcattacgtttccttttgataatccaacgaaaacatcagatccttttacagcatcttccaatgtttcgatatcagtctgagcgataaaatccagtttttcaggagtaaggttttctcttttatggttgattacccctttactgtcgcacatcaggacgttttcttttttcaatcctaatgaaatataaagcttagtacatgcaatagctgcagcacccgctccgtttaccaccattttcactttatcaatatccttgttggcaatctgcagagagttgatcaatgcagcagccgagataatggctgttccatgctggtcgtcatgcatcaaaggaatattcaattcctctttcagtctttgttctatataaaaagcttcgggagctttaatatcttcaaggttaattcctccgaaagtaggagcaattccttttacgatttcaataaatttatcgggatctttttcatcaatctcaatatcaaaaacgttgatatctgcaaagatcttgaacaaaagtcctttcccttccattaccggttttgaagcttcagcaccgatatctcccaatccaagtacggcagtaccgttagaaattactgctaccagatttccttttcctgtgtaatcataaactgtttccggcttatcatgaatttccatacaaggtactgctactccaggagaatatgccaatgacagatctctttgggaagagtgcggctttgatggtattacttcaatttttcctttgggttctgctttatgataatccagcgcggcctggctaaagttcttttcgtcacgattgttgttacttgacataaaattttgttttttgttaaagtatatatttaatgtggtaatctactaagctttcaattggtttctgaactacatgtcccacatttaaattaagttccgttgctacagaacgtagtgtattttcataataataagcgatggaaccgatgaaattaatctcagcttcatacgcttcttcataagggagaacctggtattcgaagaaatttttcatttcgtcaaaaaccatatccctgaagtaaggatgatcttttctttcgattacaaatttggtaaaattcgccagataagcattgggtcttggggtatgatacatatttttcaatgcatcttccaccgtaagttgataatctgcttcaaattctttatgaaggtctgcaggcagttttttcataaaatatctgcgcaccagctgttttccgatagcacttccgcttccctcatcccctatcaggaatccgagtgaaggtaattctatctttacatttttaccgtcaaaaaaacaggaatttgatcctgtgcccaaaatgcacacgatagcaggttttccgctgtaagccgcatatgcagcagccatcagatcttccttcacaataatctctgcttttccaaaaacttttttcagttcttcttctatggtttcgcagttttttttcaccccgcatcctgaaccataaaaaaatactttggtaattgaatttttaaccgatatcagattgctatttttctggatttccggagcaataagctccctgttgataaaattcggattgaaaccgattgtttctgttttcagaaaaacttttttaaagtcatcaagaattacccaatccgttttagtagaaccactatctacaatagcaaccatattttagattttaatttaaggatgctaaattatgaatttatcttcaattagcatttaaaacaacctggaagctgtctaaaatcattaatgcttgatctgtgtttttttttcattgaattgtaaaagccaatcttctatttcatcttcaagataggaagtctgtaattccatcgcattgataaaatcatcaggcaccggctcaccagtggagttttcaagattccacaattcgtttgacatattttcatattcggaatacactcttttgaagcgggaattttctttctcaagagcctcaatatttttctgttgaagctggaattttctgtatttgttttgacgtttcatacaaatattattaataattgggtcataaaatgtaggaggatatgctcttagctgcgcactacaagatagaaaaaaccatcaacacaaggcgttgaaaatgaatttattatcaggtcttaattacatcattctgaatattaaaattagacatattttttattaaaaaaaatattttaacaacttttttcagtgtttaacatatagttataaatttgcatattcatattgtggggccgtataattttgggtactataaaaccattatgggaaggcaggaatccgtaaaatgtttatctgctgagaagtatctcattttagtacgctatacaatatgtacaaacatgtttagttttataatcattaaatgaaagaaatactcttacgccagaagcaggttttgttcttcatcattgcaggaggactgagtgctgttgtagagataggcagctttaaaaatttcagcacttatcttccgcatttcattgtaaaagaaaccaacttttatggtgtgcattatcctctgagtaatattttctctaccagctgcgggattattaccaattattttctgagtatatggtttgtatttgaaagaggaaagcattcgaagagaaaagagtttgcttactttatgatagtatcctttttttcgacaatgctcagcttaggatttttccagattttctatagtttcatatttaaagataatatcaatttatttttttataccttgagcccggaaatgatcagtaaaattgctgcaatattgctggtgtccattctgaattattcaataaaaaagaaagtaatttttaacggttaggctgtgacaaaaattttaaactatctctggagattctggttgctgctgctggcattttttctgaccgttacactcggaatcccggtatatattttatcttttaataaaaaacattataaatacggttataagcttgtcaggctctggtgtttcggaatgttctacggaatgggtttccggtatgaccttattaagctctccacccaggaaaaagataaaaatataccgtacgtttttatctctaaccacacctctatcatggatattatgcttgtctgcattttgttccctgatcatccgatatgttttgtaggtaaaaaagaactggtaaagattccgattttcggaactatatataaaaggatctgtgtcatggtagacagggcaagtgcgcgaagccgtgcagatgtgtaccgcagatgtgctgagaagatggaagaaggtaacagtattgccatttttccggaaggcggcgtacccgatgatacttctgttatcctggatgattttaaggacggagcttttatgctgtcctcaaaacatcactcccctattgctgtttatacctttatcggactcaaggaaatgtttccttttgaaaattcaaaaggctatcccggaagagtaaaggtttatttcaatggaattattgaacctactgattcgcccaaagacctgaaggcagaggcttatgaggaaataaaaaaaaccttaatcaggtattccgttgaaagtaaatagttatatttgtttgtgaaatctataataaatatgtcaaattattctaagcaaaccaattgggcccaattcattccgttggttactgtattcttcttttggggatttgtagcagccagcaatgatattctaatcccggtttttcaaaaagccttcaatctatctcaaactgaaagtatgctggtccagatatgcttttatgtagcgtatactgtaggatccttaatttatatgattgtatccaagagtctgaaacaggacctgatcaacaaaatcggatacaaaaacggtcttattgtaggacttttgatttctgcactgggaacactgttgttctaccctgctgccaatatgcattcttttcctttaatgatctccggattatttattgtaggtttaggattctctcttcagcagattgttgccaatccactcgctattgaggtaggtcctacggaaacaggatcacaaaggttaacaatggcgggaggaattaataacttaggaactactatcggcccacttatcgtttcgtttgccatctttggttctgcaagtgctgccaatacggaagcgagtgtggaaagtgtaaaaataccttatctaatactgggagcagcttttgcgcttgtggctttaatgcttaaattttcatcacttcctgcaatcactccaaccaacactgagaatacggatgatgtaattccgggagaacacagaacttctgcattccagtatcctcaattggttatgggaatgatcgccatcttcgtgtatgtaggagtagaggtttctacagcaagtaaccttcctgcttatatggaaaaaagccttggatttgaaacgaaagaagtagctccttatatttcattgtattgggcgtcattaatgattggccgttggacaggtgctgtagaagcatttgatgtgaacgcaggtttcaaaaaaatcttaagattcctggcaccttatctggcgttcggcgtatttttattggtaaacgctattgccaaccatgatctttctcctttctatgtatatggatttatcattgttgctatgatcatctgtgatattttaagtaaaggaaacccggcaaggatgcttttaatcttctctttagcaggaattacagctctgcttataggaatgttcactacaggaatgatatctgtgtatgcatttaccagtgtaggtcttttctgttctactctgtggccatgcatctttgcactggcaatcaacggacttggaaagcataccaaccagggatccggattccttattatgatgattatgggaggcggaatcgtaagtatgttacaaggatatattgcagatatcacaaatattcacttcagctatatcgtgggggttatttgttttgcttatcttgcattctatgcgatccgtgtgagtggaatcttaaaagcccagggcattgatcttgataaaatatctaaaggcagtggtcattaatataacaaaaacaatatataagaagaaaagattttgggcaggtgtattacttgcccaatttcttttattttatggtttctctaaatccaaaatgatggtttctttttttgaaagtttttttgaacttcaaaaaggaatccaccaggtgttgttcagctggatttcgttttctgttggagatttgatttatattgtagtaagcatttttcttttatattgggttatagctttattcaggaagcagcggaggcatgatgcaatgatgaaaatcctcatcttcattaatgctttttatttcacttatcaggtgttttggggaatgctgtatttccagactcctgttattaaaaagctttcaagccaggaagaacccaatatagacaaggcaaaaaaattagcactcatctatcttgaaaagtgtaaggttaccagacaatctgttcatgaagataataaaggtgtctttatgatcacagacttgacctctatacaaaaggaaatcctgcatcaacaagcaaaattaccttcttatatttccaataaaaaagcgcctcagattttaaatattaaacccagcttgttcaaaaatgtaatgaacttcacgggaatactcggatactacaatccttttactgccgaagcccagtataactctgaactgcctcacacttttatccccttcaccactgctcatgaaagttctcaccaactgggatttgccagagaacaggaggctaattttgtgggatatttaataggaattcattccagcaatccggaactgagatacagtacggagtttttcactttaaaaagtcttttaagattcattgtggaggaagatcctgagtttgtaaagaatattcttcatcactattctccggctatgcaaagagaccgtgcttatgaaaagagctttatttatcgtcatcagggctggctggatgacttctttggatttactaataatctgtttctgaaaagtaatcagcaggaaggcgctattacgtattcttactttatagatcttctcctaaactatgaaaaatagataaaaaaagaatcgtatcaggcgatacgattctaaaaacacaaatgatgaaaaaaaatttattaccttgacttgttccctcattcaaggcgatgtaaaagtacgacatattttataaatacaaaaaaaattccgtccttttttaaaactttatgaaaactttatgattttttaagtttttttgagtttatatgtttttgtcacaaattaaatcaaacatctttatttacagccaaaacagcattaaaagcacatacaggctattaaatactcaaaaaattaaacaaatgtttaaataaaaaatattcgttttctatcaagtttttctcatttaaaaattggagttattgctgtattatgatatgatatctctaaaaattgcgattctaaaattctggaaattgtgaatataaaatgcatggagttttatatccattctgtttattgtcccaaactaagaatttatattttataaaattgagatctgttactcattatcaaaccttattttctaaaggatcttatccggaaattatttctgagaagagataaaaaagcatgattctaacaataaattatagaaaataaaatactgaggatcaaataaaatccaacaacaaccgtttatatctcactaataaaggagattttttttgtatatttaaaacatctgtgtattttagataaaaatattaatatgatttttgacaaactaattaaccaccttaaactagataaacaggaatttattttccagttcaactcacatcccaattacccatctgcattggcattcagtgatacgctgaactttatgggggtaaaaaatgacgcctatgaacttgacaaagaatattgggacgaacttccggaagaatttatcgctattgttgaaaattcattttcccttgtaaaaaagtcaggaaacaattattccgtatattctgagaaagcaaagacctttggaaaagaggagctttataataaatcaaccgactttgtacttctgtttgagaaaactgagaatgcagaaaacaaactgacattcaatttcaaaccggttctgtacattatttttgctgttgttcttgcttattcatttataagtcaaaccatttatgaggccgtattcaatcttctttcattagccggagtttatatttctctggaaattttcaaccaaaaatttggaaatacatctaccgttatcggaagtatatgcggaggcggaagtactgctgccagccagacagccaactcgtgtgataagattataaaacaggataaaacaagcattttaggcttaaaattcgcggacttttccctgatttatttcacaggacttacagtattgggtttattcttaccggctacagcttatattgtaaaagcatttacattcgtttctgtacttgcaatcggatattcattatatatccaggcatttgtagaaaaaacattttgtagagtatgcctgttgattatttcaatccttgcagggcaaattgtaataagcagtttactttttgagaatctttctttcagtgtgggagcacttttactgacgattatcctgtgggcacttgttttctctgctgttatttatttcaacactcttcttgagcaaaaagaaacgcttcaaaaatcgaatgcgaaaaatctcagattcaaaagaaattatgagcttttcaaagatcaaatgatgcaaaatccaaaaatagaattccaggataccgaaacctttgctgttggaaaaagagacgccaaacttcgcatatcaattgtttccaatccatattgtggtttctgtaaagatgctcataaactggtagaaggccttttggaaaaatatcctgataatctctcgttgcagatgagattcaattacagtcctgacagagctcctgaaaaatatactcagcttatttcagacttaactcatatttatcataacaaacctgaaaacgagtttttacatgcggtagaagaatggtttgaaaccaaagatgaaaataaaattaatgctctggcaggaggaaaagtaacatccgaaaatctgaacccattagtagaaatgtctaaggaaaacagtaatgcaggattaagctttacccctatctttattatcaacggatatcagtttccagacaagtatgatcgtgaagatattttattctttattgatgaattaatagaggatgatgagatttagtaattaaattttatgcatttaaaaatttcactatcttaggaaaaacaaaataaccatctgaaaagatgtaaaagagtagaaaaacggtgacaaatgggactatttccagtgtaccatttcattgaattataattgaattaaagcaaaaatgtcgccattcactggcggcattttataatgagtagtagttttgaaaaaaaagtttcctttttataagcagccagataccaaagactgcggccctacatgcctcagaattgtaagtaagtattatggtaaaagcatatccctgcagcagattcgtaacctttccgagacaacgcgtgaaggaagcagccttcttggactgagtgatgcggcagaaaaccttggattccggtcaatgggagtccagatcgatttcaatacccttacagaagaggttccttttccttgtatagcacactggaataaaaatcattttgttgttgtatacaaaattgataaaaacaataaagtatatatttcagatcccagttacgggctcatcacttacacacgggaagagttcatcagatcctggatcggagaaaatgcaaatgaaaatacagaagaaggaattgtccttattcttgaaacgactccggcattcttccagacagaattcgatgctgaagaaagtaaggctagttttacattcctttccaaatatcttcttaagtataaaacacttgttattcagcttgctatcgggcttttgggaggaagtttactttccctgatatttccgtttctgacccaaagtatagtagacgtcggaatccagaaccaggatattaattttatctatgtggttttacttgcacagatcatgctattcctgggaagaatgggaattgaaaccattcgaagctggattcttcttcacctttccgcaagaatcaatatttccatcatctccgatttctttatcaaacttatgaaacttccgatcagtttctttgatacaagaatgacgggggatattatgcagagaataaatgaccatcacagaattgaacagcttcttacaagttcttcactgaatacattattctctctggtcaatcttattattttcagtattgtattgctattttatgattacaggctttttcttgtttatctagtaggagctgtattgtatgttggctggatcagtttcttcctgaaaaaaagaaaagaactcgattataaaagattctcccaggtatctcaggagcagagtaaagtgatcgagctcatcaacggtatgcaggaaattaaaatgcataatgccgaaaaacaaaaacgatgggattgggagtttcttcaggtaaaactgtttaaaatccggataaaatctctttcactggagcaatggcaatctgtgggaggtaactttatcaaccagatgaaagatatcctggtaagtttcctttctgcaaaacttgtgttaagcggaaatcttaccttagggatgatgctttccgttcaatatatcattgggcagctgaacagcccgcttcttcagcttatcgattttatcaaacagactcaggatgctaaaatttcccttgaaagattgggcgaaatccatgataaagatgatgaagaagataagaatgaacaatacgttatggatatcccgaaaaaagatattgaaatcaaagatatgtcgttcagatacattggttctgatgttcctgtttttgaaaacttaaatcttacgataccttatcagcagacaactgctattgtaggagccagcggaagcggaaaaacaactttattgaaactgttgatgaagttctatgatcctgaccagggtgaaatcagaatcgggaataccaatatgaaaaatatttcccctagatactggagagatcattgcggagtggtaatgcaggaaggttatgtattcaatgatactattgccaacaatattgctgttggtgaagatcatattgataagcaaaaattaagacgcgccgtagaaattgccaatatcaaagaattcatagaaagtcttccattgagttataatacgaaaatcgggaatgaaggtgttggagtcagcggtggccagaagcaaaggttattcattgcaagggctgtttataaagctccggaatacattttatttgatgaagctacttctgcactggatgccaacaatgaaaaagtgattatggaaaatctcgagcagttcttcaaaggcaaaacggctgtagttattgcccacagactctccacagtaagacatgccgataagattattgtgcttgatcagggaagggtggtagaagaaggaagccacgctgagctggtagatttaagaggtgaatattacagactggtaagaaaccagcttgaattaggaaattaaataagataaagtcacttatagcggaatccgaaaagcttacagagtaggaaaaataaaaactaatattaattatgaaaaatcttaaaaaactttcgagaaaagatttgacatttgtcagcggaggtgttatcattccggacaacaactgctgtggatcgtggtgtcttggcagctgggtaccatgccgcataaagcattttgaatgcccgccggatgcagacacttcgccaccatcatggtatgacgggaactgcccaattatttaaattatattccccctgaaatattgggggaaattttacctcagaacaatgaaagaagacgttttagacaatattgaactccgctcagaaagcgtacaggatattcttacccagcctccgcattggatgatccgctggggaaataccgttatatttgttattctcctgcttatccttctgatgagctacattataaaatatccggaatttgtacctgctcccattattgtaacttctcagaatcctcctgagaaaatagaagcaaggaccagttctaaaattgaaaaaatattcataaaagaccaccaggaagttaaaaagaatgatgtactgatggtgatgcagtctgcagccaattataaggatattttagagctgaaaaaactggtagattccattacgccagatcagttatataatttcccaattgctcaggcttcaagatttaaattgggtgaactacagggtgaatataacagtttcgccaaagcatttcaggatgaagcactctttacaaggttacagccttatgcgcctgaaaacctcgctgccaaccagagtatttctgaatatagagtgagaattgctactttaaagcaacagaaaaaccttgaatccataaaatatgacctgactaagaaaaatttcaacagatctcaggaactattcaaccagggcgttatttcagcgatggaacttgaaaatgaaaagatcaaatatcttcaggctcagcaaaaccttgagaatattaaaatttccatatcacaaatggatgaagggatctccaacctgaataaaaccaaaagcggaactgccattaatacagaaaaagacagaattacatactcttcacagaccttacagcttcttgaacagctgagaaaatctttaaaacagtgggaactgaactatctggtgatctcatccacagacggtgttgccagttttcagcagtttttcggcgagaatcagttcgtaaaggtaggtgaacctatcctttctattcttcctaaaaataaagagcagttggtaggcagaatgtctgttcctacaacaaactcaggaaaaataactccaggtgaaaaagtactgatcaaactggacaattaccgattccaggaatatggtatcatcgaaggaaaagtgcagaatatctctcttattcctgatgaaaaagggaattattatgtagacgttattttgccaaaaggattaaaaacaagttataacaaaacacttacgtttgataaagaactccggggcagtgcagagatcgtgacacaagacctgcgactgattgaaagatttttctatcagatcagaaaactccttggatatcaggtttaataaaccaataggaaaaattaagagccgttccgcaaattgcagaacggctcttaatttatattttaattactacagatactgaaaattaccgtcgattatttaaacaagccattacacgcattattcgactcaatgaagtattaaatccagatattccaaaataagccatagaaaagcgaatatgagggaaatatctgtacatagttaatgcataaactatgacaaaaaataaacaacggatattccctggattttattctaagaagcctaaatattaaaaaaaggaaatcttttagaagaattaaaagataaagttatgatacttttaaaattaaaaaccgcaatcattaaatcaataattgcggtttattgtagcgaagacgggaattgaacccgtgacctcagggttatgaatcctgcgctctaaccaactgagctacctcgccgttttggtggtgcaaatatagaaaatatttctttacctccaaaattattttaacttaaaatattccaaaacatcaccaacatgatctggtttgctgattatcttattgttagcatctaaaataaaatacgtcggagttgcatgaatattgtacgtatctgtataactgctgttccatcctctcaattccgagtcattcacccatggaaacgcggcaatctttttggtataagaattcttatccacatctaaagacaatcctacaacctgaatattttttgatttcagatcattgtatttttcaagaagcttaggaagctcagtttcacaatgtgaacaggtggatgaccagaatacgataaccttcttatctgcctttatatcatgtaaagattttgcggtagtattcacagctgactgaaacttataattagggaaaacagctcctatttcagtgtttgcattcgattttaaggtagaagcaagcctgtcagtaatggtacatttaagatttttagcaagagagagatatttgctcttgtattcatccatctgatatgcatcaaagatatcaatcaattcggataatactgtctgccctcttggcgtctctacttttaaacggtctaaaagcttatcaacagaagctgtaacatttgtgtttcctcctgcattaagataagccaccaaaaccggtctcaataatgaggagctttcaagcatatctcctgatttgtccagaaagttgatgatctcttcctgatctacttttttgactgaatctggtgagttagaaataaatttactgtagttcgtattataataagcaataaacggatgttgtgctgcatcaatggtgcttgaagtcccggaaagcctgtcaatttcagttttcagggcttttccaaagtccgtattgtctttatagtattctttgatttgtgttaaagccggcaaaataagctcttttttttgtgaaccttcctgctgtttgctcatcagactatttgcctcatcaagataaataacatctttgactttattattctggacatccagtttaaagtttacattcttattctcagaaataaagcttaccgtattgttagaaccgggaaaataaactttcatcatccccatgtagttacccggatatttaaaagtccacgtaccattcttactttgttctttagtaacaataatatcttttgagccgttcaatgtatatagaattgcgtcctgatctttaaaatctgcaggagtctggattgtgaccgtaaattgagcctgcaaagcaaatgcagctaaaaccgcagatagcgtataaatttttttcatagagtaaaaataaaaaaactccctgagtaatcagagagtttaatattattttaataaaattttatgcttttacgcttttgtacttttttgtaaagtaggcaataaatacaattgctacgataccaagtacatatacatacatatcaattggtgaggctggtgatggtgatccggtaccatttcccccgtttcctcctcctcccggaattggtggagctgcatttactaaagatatagcaaagagaaaaaaagccaggactagtttattaatagttttcatgtggtttattttaagattttagtgttaacagtttctcccttatcagaaacgatttttacgatgtaagagtttttaactgagccatcaagctcaattacaaaatctctggatgtttcaaccgcttttttagagattaccagtttaccgctcatatcataaacttgaatgtccgcttttttccattttggatcaaatctaacaatgtaatttgtaacagatggatcgtaaacaacaagtgttctcgaaatactaggagctgccttatctacagccagagtaatattacttggctcaccataatacaagttagcttcctcatttgttacaggtacaatatcaccttgtttagcctgtagtaaatttccattttccgctttatagtagaaaccaattcctgaagataactggtgtgcaccggcaggaataagttctgcattttctctgatctcaaacttataagatttaacctgatcaagcttatagttaactaacttaacatttttaccttggaagttattctcattagcttcattaatatataaccaatagttggtatagttgttatcatacccaccattcaatgcttcttcgtaagtaccaataattcttgtacctgctgaactttgaactgttgtagctgcagaaacctggtgtcctgttgtaaatgatggagaaacgacataatatgttctggaaatctcattaccattagcatcaagaccgattactccaagctgcttcactgtattggatgtgttcttaccagccattctagctgcatttacaccgttaggagtacctgcagttcttgctgttgatttaaatcttcttagaggattaaaatctaaagtctgagctgtattgtctcttaactttattttaaatgactgcataggtttaatcaccattttatctaagttgacatcaccaactgccggagctactccgtcacctgtcggcacgtaagtaactacctgagcacctgtagcataagtagaacctccaggaagtgtaacaatagtaccagggttatattcaataccccagatgtttcttaccgcatttccatctgaccctgtaacgctttcagtgtatccgatattagataaatctatattagttagataagggttaccaaattgatagaagttctgaccaaatgttccagcccatgggcttaaagtaaattcaaatgaatcatcaaggtaagtattatacttttcgctgtaagaattcaaagcgttaccaccatttccaaatacgacattggaagggccaacgttagattttcctgcattctgcaatgaagcagttccagccaacggagcaaatggtctgccgttaatattgaaaactgttcctgtagcaggtgcacttggattccaatcattgttggtaactttcagcatataataccctgaaccatcagctgtagtagttgctaaatctgtaaaatgtgcagaaactgcattaccgttatcccattttagaatcggattgctatatctacctgtattgaaggttttaccaacctctgtagataatgaacctaaagctttaccatagaaaggcaaagcgacttgctggaaataattaccactaccattacttgtagttctgtattctttagttacaatacctgtaatattggactgggatagtccatcgatgtacagctggccatacgtggaagtagcaaaggaagcaggggtatttagtcttaagatgatattaccgccatctgtcttatcagaacctgcagcgtctattgtcttaaaagcatctgtaccagatcctacaatcattatatttccatgtacgtccaaaaggccattaccttttgtttgtacacctccaccgctataaactagggtgccttcgctcacatacatattagcattagtgtcaacatgacatagtatctgcgcctgaacagaataactaattgctaaaagacctatagcaaataaactttttctcattgtataaattatttgtgtgttaatacaatcttcacccgcaaaggtattattatttttcttaaaaaaaaaattttttatctattaatcaaaacattatcctccgttaagatgatctctttctcctctcctattgaaaacatatagtcttctagaactttttcggtcgtacctctcagacctcttgctcccaatcctttttcaatagtttcctctacgattttttcaattgctccgtctgtaataaccaaatttgtgccatccattttgaaaagttccacaaattgattcacgatagagtttttaggttccttcataattcttaccaaagtctcttttgtgagtttatcgaggtaagtgataatcggaaatcttcctaaaagttccggaattaatccgaaagtacgaagatcaatcgcattaatatttgttaatatatactcatcttcatcagtcttattgattttttcagagctgaagccaatggcctgcttgttcattcttctttcgatgatctctttgatgccgtcaaaagctcctcctgcaataaaaaggatgttctgtgtatttacctggatatatttctggtccgggtgttttcttcctccctgaggcggaacattgacgatacttccttccaatagcttcagcaatccctgctgcactccttctccggaaacatctctggtgatactcgggttatctgattttctggcgattttatcaatctcatcaatgaaaacaattcctttttcggctttttcaacgtcataatccgccaccatcagaagtctggaaaggatactttcaacatcttcccccacataacctgcttctgttaaaatagtagcatccacaatgcagaaaggtacattaagttctcttgcaatcgtttttgccaaaagggttttacctgttccggtctcccctatcatgatgatatttgacttttccagctctacttccctgttttcgtcctgagcatgaagtaatcttttatagtggttatatacagcaattgaaagctgtttctttgcctgatcctgaccaattacatactgatcaagaaattctttgatctcttttggttttttaagctcgtccatgctttctgcaggcgagtatcctgttttggatgcactgtcttttacaatagcatgtgcctgctctatacaattttcacaaataaaaccattctgcccggaaatcagcatctgtacttcacttctttttctgccgcagaaagaacattggtttgagttcatatgatataatatatgtatatgttaaagaaaatcgtaaaaaattacttttttacgattttccggttgttaagaattaataattgagttttgaatctctgtatattcttcgttcgttaattttaatctttcatttctgaaattcatatcttccatcttatttaaaggaatcagatggatgtgtgcatgcggaacttcaagtcctaccaccgctactcctactcttacacatggaattgcagttttgatcttcttggctacctcttgggcaaatccccaaaggtttttgtattcttcactttcaagatcaaaaatcaaatccacttctttcttcgggactactaaagtatgtcccttcaccaaaggcattgcgtctaagaatgcgataaagttttcattttctgcaatcttataagagggaatttcgccattgatgatttttgtgaatatagtgctcattttatcagaagtttggttagatattttagaagttagaaataaaagaaatatcagactataaagaaatgtctaatacttcaaaagacagtttgtttccgttcggtaaagtaatttcagctgtttcgccgatagcttttcctagcagaccctttgcaataggtgtgtttacagaaatctttcctgtcttcagatcgctttcattatccggtaccaatgtaaatacctgttcctgcttggtagcattatttttaagtttcactgttgttaagattgaaacttttgaagtatctaattggctttcgtctataattttagaagtagagatgacatctttcagcttggaaattctcatttcaagcataccctgagcctctttggccgcatcatattctgcattttcagacaaatctcctttgtctctagcttctgcgatctgctgagtaatttttggtctctccacagtttccaactgttccagctcagctttcattttctctaagccctccttagttacatagcttgccataattttcaaaatttagttttagtataaaaaaataatccgacatttgccggacaatgttttcgtgttgtaatcgtttaatttttacaaatatataaaaatttaaattgaaatgaaaaaaactttttcaatcttatctattttcagcttattgattttcagtaatttaaccataaactcatgtggaagcagagaagatacggtgaactgcttccctaatgttcctatcaatgtctcacttaacctgaaccttccggcgtactaccctttgaacaatatcaacggctggatctacgtcaacgaacaacagtccggaacgagaggattaattattgtacgaacagcaaacggatttaaagtatacgacagaaatgctccccatatatgccctgacagcaataccaccctggaggtgaaagacaatatttctattatatgtcctcaggataatacaagatggattttaagtacgggacagccggaatcgggagctaaaacatctcttcctcccaaaacttatccgtacagctatgatgcaccaagcaaaactttaaatgtttattattagaatataaaatgaagatcgttatacaaagagtctctgaagccagtgtaaaagtggaaggaaagattgtaggtgaaatcggtaaagggctgatgctgctggtaggtgtagatgagaatgatgaaaaaacagatgcagactggcttgtacagaaggttttaaatctaagaatcttcggggatgaagaaggtaagctcaatctttctgtgaaggatatttccggagaaatcctttgcatcagccagtttacattgattgccgattataagaaaggaaaccgcccttcttttataaaagcagcgaaacctgataaagcggttcctctttttgattattttaaagaagaaataagcaaatccggattgaaaacagaaagcggaatcttcggggcagatatgaaagtatccctgatcaacgacggacctgtaaccattgtaatggattctattaccaaaagctaggtttgaaagatgagtaacaaaaatatagtcattgcttatctggcagtgactttaatttttctgttcgggatcataataagcctgaaccactatagtcttgctggctattatacagacaagataattaactggctttggcttgcaatgactgtttttattattatccgcttctggaagaaaaaaggagttaaagtatattttggtgttttgatatcaggaattattctgagcatactgcccatgatgatcccttttttcaatattcttctgtatttttctaccctgggctgtgatcagcaaattaagctcaatgatatttacagaatggaaagaggccgtccgggagcgctatataatcctatgatcacgatttacaaaaaagaggggatttttgaaaagcaaacagcaagggttctttacagagatataacggaagacattttgccaccatcactgcagagaattacagatgagagagagctacccattcaggaggctaaactggtgaatgtgaacaacgacagcattggtattgaataccacattaagaataagaagaaagtgatttatcacaaaaataaattaaactggtttgatgatctgtaaagattcaattgataaacctcaacaatgccattcagtgattttggatggttttttattgtttaacctttaaaagctcctgcacaaagggcaaagaaaaaaatcaaaaataaactcacaaaaatgtgatttgtttttattttattactacttttgatgtaaatcaaatctgatttacaaccatttaacaaaatagtatgaaaacaaaaatcaaccttttcgcattgtttgcgttctgtgcttccctgtcttttgggcaggacagccagcacaggatggctaatgatcaaaattcaattatttatgtatgcttttcgaaaggtattaattcagaaaaaacagcattcagtcgaaatgctgatctggaaaagttttcaagagagtatcacatttcgttcaggtatgatcttgattttacggacagcaggcttgatgagatggccagaaacagtaaggccatcggaaattccacagaatctgtagaaaagctgaaaagaatttataaggctgatcttcctcttcagaacacagaaacaacagagaaaattattcgcactctggaaaggtttccagaaatagaatatgtgtctgtcatgagtgctgatcctgttgccccccctttggtcaatgcttttgtggctacaccggatctggaaagccttcagacttacctgaacgacaatccgggtattaatgcaaaatatgcatggtcaagaggaattaccggacagaatatccgtgtaagggatgtggaatatggtttttacaaaacgcatgaaatgctttccaatcaaaattctatacagcttgagcccggatattctcctaatgcaggattagcgaataataattaccgtgaccatgggactgcggtagtgagtattttaggctcaattaaagataatataggacttacaggagctgcctacagtacttctgaaataaaaggctatatggaatggaccactgtgggatacaacagagcttctgcggtgagcagatctattaacgcatcacaggctggcgatattattttatatgaaatgcagacgggtggcaaagatggccagtattgccctgctgagtatgaccaggtcatctgggatcttacaaaagcagctactgattcaggaatcattgttattgctgctgcaggtaatggtaaccagaatctcgatgatccgttttatgccacctatcttgcgagaggaaacagcggagctatcattgtaggcgcgggatctcccaataccacccattcaaaactgagcttcagtacttatggaaacagagtggatgttcagggttggggaagcagtgtactggcagcaggctacggatcttacgcgaaatatgacaatgataataacagaacctataattatttcagtgggacgagttctgctacgccggtggtgtcttctgcagctattctgatccagtctttttatcgccagacaacaggacaatatttaacacctacggcgatgaagaatcttttgatttctacgggaattccgcagggaggaactgtaacgggacagaagataggccctcttcctaatgtgaagaatgccatacttcaactggaaagtaaatttgccacccctgttaaaaccttatctgcattggaagttaaaatttatcctaacccatccagcagcagcattgctattcaaagtaatgaaaataaaaagctggatattgaaatcattaattttcagggacgtacagtaattaaaagttcagttttacctgatgaaaaaattgatatttcccaactgcctacaggtcagtatatcattaatatcaatgaaggtcagagaagagttgttgagaaattaaccaaaatatagttttaaaattttacatcattttacttcacattaaaccctcttccggaatactgaaagagggtttttaatatcaatttttataggtcttattgcgcaggaacgctgttgaagttaagcgctacttttatattcatatctgaagaggtttgattcttcaattcataaactgttcttactgtcaatccggaactttttacaatttcatcaagaaatcctgtatcattcaaatccagatttaagctggaagaattggtggagatattggaacgtgatgcaaccagtctttctcctgttccgttggatgaaacatagatcttcacgcttttaaatgcgctcagattgcctcccgaaggagaagctacagaaatttttgcatctgatattcttacatctttaatttttgcattattattacccccaaaccaggtctgcacattggtagctgttgcagtagaagaaatttctttatcagaaggtactcccgtagataccaagacattcgttgtgtatggaaatgtattctgaaccagcgactgtacggttccgcaacttacgagtacagctgaggcggccattgctgttagaactatatttttcataattgtaaattttttaaatttcagagtttagtttgcagaaattgtaccaaattgattggttttattctacagttactgtaaagcttcctttggtatttccggaagccatattacttttaccgataatcagccatacttctccttttccgggagtgtcataagtaatttcccttccgaaaggtccatcatagttcccgttcggtagtcttatctgattgaatctgatattgaagtctttttcttttgtagaaatttttgctttaatattcggacgatcataatgggtcagttttaaaacaaagtcctgatcatcttttgtaaattcttcccctatagtaaaaggcaactggctggcatcagccgttcttataatctggccctctttttcatctctcatgacacctttacgaagaacttctttggtagccggtgcattgttaataattgaatctctctttatcaatgcagcagaatcacttttcacagaagagtccggcatttctgtcacggctgtggagtctttctccggaacgctggtcacggcaggctcttttttacaggcaacaattatcaaagggattaacaataagctttttttcataataattaattttaaaaagtgatcaaccaatattctgttgagctcaattaaatgctaaaactgttccaattcatgaaacggtttattttccggctgcattactttttcattatctgtttctgcccatctgaatgtgaaatacatgaaattgagcatgatccccatcagggcagtaacgccccaagtcttggtatattccatcggatagatgaaccttactacaatatcagagaaaagaccaaaaggattattgagcacatcccagctgttccatctcagaaatcttcccagatagactccaaagctgctcataaaaaggaaaaatataattaaaccggtaatgaaatttctcccggcataatctgaaagacgctgttcaatatctttaaggctgataaagccacagatcagacccgtccaggcataagaaagaatcacaaccaggtcataccagatcggaatctcgtttcttgctctcagatgaaaaagatctgtaaggatataaggcgaattgggaaaaaacaaaatccagactataataataaatgccagcgagattttacttctgatattaaaagccggaaccaaagaacttaataacaaagggatccatgccagaaagaggttccagttgagaaataaaaatacttttgtttcactgatataatatctgaaaacagagaggctgaaacaaaatacagtcatcaatataaggagcatactgattttacatcttgaagattctgtgagctttttcataatcaattattggatagtttgataatagataattttggaaagaaacgttttggatgtttcattttttactttgttctgcagtgtctttttaagcttttgatcattttttgcatctgcatacttcaacagcgctttttcactgaaattgacagacgttaaataatagttcactgcaaaatcttttcttttcatattctgagcagtaataaaccctccccaattgaaatagctgcacactaaaatggttccgtaaacataccagatcatggtattgataaggaaaatatttctttttttcttttgaattttaataaaggttaaagccagaccaatcattgataaaacaaggaaagcaaaaacgcccagtcttttataggtaaatccgtaattcacgatatactcatagtttttaaggaccgcagacaaaacaagagcagcattgagaaaaatccagattttagctaatgtttttaacagaccagctttcggatcaaaattaaatcccgatttaaagtagaacatgattaccaggatggccatgacaatagacatgatcacagcgtttactctttcatgggtttcttctgacaactgaacaggagtttttaccgcttcataaaactgttcgtagttgtacgtaataataaagaataccaatagaatattcagcaaaataaaagaaatcaccccactcattctttctgcatcaatgtcaagaaaagaataggtagcctttgggatccgggcatctttgctaaactcattatccagaacatgattgtttttatagatcagcttttctacagcataattccagtaattgaaggcaataaagaatcctaaaacagacagacagaatacctgccacagattaatatccagctcataatctgtgaaaagagctgcaaaatgattgcttcctgcagaataaattccaaagaaaacggaaaccaggatcagcgggatcaaaatgaaagccagtgttttttgccataatccgggaatatttttctttggcagccactcatcaaaactgaaaaaacggcagaatgaagtgcagcaattaacgacaaaaaccggaattaaaaaaaggatttttaatcttttattcttcgacttatatcccagtaaaagcaatgagcttacgacagcaataaaagacgggaagtctccgaaccaggcaaacgcaatgccggacaggatgcttgtcacaaaaagggtgtacaaagttccggttctgcttttttgctgtgttctgaacagagtcagtacggcataggcaattccaagaattccaaggttcagccctacttcctgatcgtagaagacaatgacaaacaagagggctgtaagaaatatataatgatgtgttttcatgaggttaattattgaaagatttaaatttaaaggattgaaagacttgatctatagatatagagattagcaaaaattaaagaacaggatgaggtacagaaaagcaatagggatattaagcaataacagaagcacagagttcccgtttcttttctttccggagatatcactcagaaactccatcaattcatataaagtgattaacagattcactacagctgcaatcatcacataataaaatccgaatatcatgagaaactcggctcttgtaatccaaaacaaaagcagtaaagctgtacccagcaaaaaggagattaaaaatgtcttctcccccaatggactgaattttatttttcccattattttaattttaatgtagaactgctgtttctttctgttgaataaaatctttcacatgttcaaaattctgccagagcagcccttcaaaatcccaatcgtgaaaggctatcatgttctgtccttttttgtaggctttgatataaattttcacatattccggaaggataattgttcccaatacgattgcagccagaaggtgtgcattaagcttgccgttcccaaggagcaggtactgcatggcaatttcatcttcgaagttggttccgcagccggtaatcagatggtgaacatcgtggttttccattttggggatcattgaaaacccatgtttcctgtaaaattccccaagctttctccccaaagaatcttcctggaattccagcagctgtttttcattgaactgccattgtctttttttctttttaaaatattttctgtagagcttttgagttttatcatacacaaatagcagaaactgaacgcgtatttttttcataatgtatttattaacaataatcagcttaaatgttgtataattctctactagcttcccgcaaacggacttccaaaaatccctactgccagttcgagccagattaatgcaagggctagcaaaatgaaaatgcagatcagaattttctgactttgttttttgattttgttcctgacgagattgatcagaaatgctgttgtaaacagtaaaattcctgcgatcagaaaatctgaaggtgaccagtttacttctttagaaaccagatttcccaacaatggaatacttagcaaagccaagggaagagcataaattgtaactgttgtttgtttttgtgtcatcattttatttgattttaatattataaagtactttgtatttcaaagttaattttcaaaaaaatataggactatcgtcccaataatttttcaagagcattcaaatgctcagtaaaagcctgtctcccactctgcgtaacacgataagatgttttaggctttttccctacaaattcttttttcacttcaatgtatcctgctttttcgagtgcgttgctatggctggccagatttccgtctgtaatttcgagcaggcttttcatttcagaaaaatcaacccagtcgttgaccatcagaacggacataatgcccaatcttacacggctttcgaattctttattgagttgatttattttgatcattttatttattttatttattctgaaacaggcaaaatctgactatctctttaattctttataactttagtatgatatttcatagctaaaaaattaatattaatttccaaatgtacaccgctccaacactaataataaaagataaaaacattatcagtaaaggccaataacccataatatctttcttcctttctgaatagaattcagtcacatctactagattgagttttttacctatatgtaaaaaactcaactctttctctgtttgaaaggtttttacatcatttgtctttaaatcaacgaaaaaatattcattatctaatgtctttccaaaaatatggttaccagattcttctattttagcaacagatgagatcaatgtcactccattcccattatttataattgcttgttcgggcaaatcaataaataatagttgatgatcatttttaataggaacgtaccaggaatcaccaattccaacatccacttttttattattagacaccatggataaaccaataactccaacaatataaaaggtataaaaagctacaaaaggagctattaatgctaatattattttccgtcttctattttcttttttgctgataaaataagtgaaagtacaacttatcacagcgaagataaaactgagagcagcaataatgaaaagatggattaatatgacaaaaccaactcccattatttgtacttcttatgcataatcaatccatagataatatgcaaaaccccaaaaccaattgcccaaaacactaacccccaacctaaaatgaataaagaaataagtcctaaaacaatctcaaaatatcccagatactttacgtccgttaatgtataccgttctgccgctaccagagccaatccgtaaaaaatgagtgtaaccggagcaataaaaacgaaaaggtgatgatagagaagcgcaagacaaaaaactcctccagcaaccaaagggactgcaaaggtaatcaaaagtcgctttgttgtggcatcccagatcttcaaacctttctttttgcttttatgggctgtaaaaatataaccactaagaatagctacaaccaaaattacaattccaatcagaacaagttctttaaccaaagcaggtcccagaatatttctatctccatcaaaataactgatcccttccctcaggaaaacaaaatacacataaacagctccgataattgccgttaaccccgcaacaactccggataatccgcttaaagaaataaatctggaagaacgctccatcatggaacggatatgggataagtcttcgtgatagttttttgcatccataaaaagaactttgaattacaaagttataatttatttttaatctgcaaagtttttattttaaaattttggagttgtatttatcgatatattcatctattatcaaaatgcagaacagtcgtataataatattatacgcaacaaaaaaatccgtagaaaataaaatatttctacggattatatattgtattaaaatcctaaaagctaaaaaaaagaactatttcgctctcaatctttctttaattgattcaatatttttctttgcagaatcttcaagaataagactggcactcatgtgaattcttgcaggcattaattcattgaaatgatctgttccttcccatgaaacttttttaattaatgccagggcatcagtgcttcttgaagccaaagtttgtaaaaatttctccagtttttcatccatttcctgaatggtatctgaaactgaatggtagatattatgctgctcagcccactctgcagacctgaaatcagcatcaatagccattgcagaaaattgtgattttccgatttttctttctacgtaaggaccgataacaaagggaccaattccaagattgatttctgtaagtgccaacgctgaatcttttgtggcaaaacaatagtctgctccacaggcaattccaacaccaccaccggtagttttaccctgaactcttacaaccacaatctttccgcagtttctcatcgcattcaaaactttagcaaagccgccgaagaattgtgtggaagcttcaagttcttcaattgctaaaagctcatcaaaacttgctcctgcacagaatgctttctcaccttcactttttaccaaaatagctttcacctcatctttcgctccttcttcaaggatagttgctgccagtttttctaaaattgctcccggcaaagaattacttttaggagttccgaaactgatttcggcaatattatttttaatttctgatgctacaaattcgctcatttttatttttattggattcttacaaaaatacgaaatacagctcgttcagagaaacttaaatcctatattttctttttaactctgcccaatacgagacattattacgtagaaatacggagtttttaatttggtattttctactctagtacctgcctgctattaatcgttcctttgaaataagaaataataacccatggcggcatctgaaaagccattaaaagagtaagaaattaaaaactaaaaacatattatcatggacgagtacattggaattgtaaaattatttgcaggaaatttcgcaccgagaggctggatgttttgcgacggaagcttattaagtatttcaagaaattctgccttattttctattttaggaaccacttatggcggagatggcatcactacttttgcccttcccaacttaaaaggacgtatggctttgggtgcggggaatgtaaactccggtgaaaattatcctttgggaatagtatccggtacaacacaaaatactcttttatcatcaaaccttccaagtataggagccggattccagcttaaagtagccaataagaatgccaattcgtctactcctacagctacctcaacaattgccatttcaggaacgcaggtgggaagagatttcaatgcagtaccgagtttcgtgaatgatgccaaccctgatacaacgattaatccgttaagtatttcttttacaggacaaggtttaccattaaataatatgccaccatatcttggcttaaattatattatttgtgttgaaggaatttatccgccgagggattaatatccttttaaccaacctaacatttaaaacaaacatcatgaaaagcactacttttttagccatctgtagtctgctcatttcaattttctcattcgggcagaccagtacagaattatttgaaacagaatcgaacgggagtacaagcttcaccgacaatggagtcattttcaatatcatttcacatgtaagtgtttttgatatccaggcgaatttcccgggaacaggctggagcggaacatcaaatgataaccggtatattgataattccaatgattctcagtttccgccgtcattcagtattaaaactacttctaacctgtttaaggtaaaccgattctggatgtatctttctgcattaaatctggacctcaatgtagcaggaaccctgaccgttaccggaaaactgagcggagtaacaaaatttacacaaacgaaaactaccggatttgcaacaggcttaggatccactaatggatataccctgatagatcttaccaacctaaacggccagaattattcaaatatcgtgattgatgaattgcagatcactgcaaacggagcctttcgctatgtaggttttgatgcctttacctgggtaaaagacagcaatcttgtattaggtacctcagaagctaaaagcactcaaaaaaacctgactgtttatcctaacccaaccaatggtcctctttctatcaccactgaaaaggctaatgaagctaaagtatacagccttgacggtaaattgctgaaaacggtacaaacccagaaagggaaaaatgaaatcaatatttcagagcttccgaaagggatttatattatcaaaacagcaacagaatccactaaagtcattaaaaactaatatcaggaaattgcatataagttccatatcccttaaagattctaattcataaatgacaaatcccttcatcgaaagggatttggtcattttttcaaggccaaaatgtatttgtttatgtaaagctgtttatcttttgatttgtactgctggatatatcttggatgctccagaacggtcatagtatcgaagagtttggcttctttatttagttttgaaagaaaatctgcattctttttacccaggacaaaaacttctgaagtgtccagattaagactgatatgcttcttcagcgattcaatcataaagtcttttacaaaattgaagagctccttgtcatcataataattagcattgagccatccgttttttgtttttctcacaatcgccaacggaaaaggagagttgatataaatgtctttataaaaaagatctgcgccgccatattcttcaatcatatcatacatgaatacggaagatacttcatgggtgtacgctgacttcattttgattccgcaaacactttcaagtcttttggtatcggtaaacggaactcccgttactcctgctccatgacggcttggattaattccaatcataaatttcctgcggactgagtcatcataatatgtatgataaaattcctgcatgaccgtcaatgtttccggattatccagatatggattcaggacttcaaaaccctccggtaaatttccagtatagctaagattcttattgaactcaatgacatggtctgcaaaagttgtattcatgaattattgctttaaaaatataaaattatccggctgttcagaatcctcatcattgtcttcttcctcttcttcggatagcataagttcaatatcaataaagtgaatataaagtcctgatatttttccctgagcatcgtaagcaaagtaaacagggtacaggccatctcctaaaccgcttgcaaagaagggaatatgatattcggtattaggaaccttccagttgatccagtcaccaagatctctctgatttttagggttttctttgtagctttcagcaaagagttctgcaaaataatcatcgtaaatattattaacatgcaattctgaaagaaacttctcaacaaaaggcaccacctcaggatccgtgatacagcctaatcctgcatctactgcaaaaccgaaatactctccttcactgacaccttcaagattttcgattccaatcaatgcttcctggtaaagtacaggtttttcttttgtaaattctactttcactgcagcataccggtctccccatccttctaattttgctacggcaaccgttacggaaaagtctcctttgggaacttccacaaaataaggtttctcatctgcattcagatataccagcggatccctcacgattacttttcctgaaggcagggaaacttttccaatttccatgacttccatactctgtcccataatcacttctgaagtaaaataagtatcaatatctacgggagatgtgagaatttcttttactccttcccatttttgcatccagctttcgttcattattgaattgattttaagtctgaaaataatgaataaatttaacggcatcaaactcaaaagaatttttaacaaaagattataagaaagctgcaaactcatggaattgcagcttgttgtattgtttgaaattataaaatctaagaatcagcacatatataacatgctctggcaatatccggccatcttcccggaaggcagcaggtgcctggaggacaaggattaagggtacaagaccagtttggtccggatcctttaagtgatctcaactcatgtcttgaaagttttttaaaatttttcataataatcagttttgatgttttctcctactctatatgcttttcggattgcgcttattaaagttaataattttcatccgaaaacctacataataaactgattaaaagcagttttctacatttccaataataaatcttctcatatttagtcatcgtagaaaaaaatctatcagtctatcgatgtatatcttaacactattttttgtaaatattttaaaaattttcacttttgacaaaaatttaaacactttggttgcgcacatctattattatcgaagattctaaaaacacattaatgatgagaaattaaactattgttatgaaagtgattttttcaaatttgatctgtagccattatttggctgaaaattgagaaattctaatttttgcaaatccctcaaaagcaaaaacttaagaaccagcagttttctgatcattatgacattaattgtcaatttccctaagacattgtttactttttaaattcccaaaactcatttttagaatgtcattgctctttaaaaataatgacttactacattgtatttatagcctaaaattctaattaaaatatgattaaaaaacacaaattattaatacttcctttttgtttctttacctatgtacttaatgcacaaataggtataggaacaaataaccctttaggaagtttacatgtggatggtgctaaagacaatcccgcttcaggtgtaccgacatcagcacagctttctaatgatgttattataaataaaacaacaggttttattggagcaggagttcttaatcctctggttcagttggatatgagatcagcaggaagtgaaaattcacttggtttagggacgaccagcatgtcggcagtggcagcaggtgcgggtgctacacggtatgatgtaaacaatatacctgtaggagctaaaattcaggtatctgatggtgcagtatggaacaaggtttatcttgcccctcaaaaagcagttgttgtggtccgtaaaatagtaagccagtcgataccaacagccactcccacaactatcactaactggagtgaagttcgtgatatgagcaatagctttgatcccagcactggtgaatttacagctccccgaaacggaacctatacctttttgttaacattcaatttcacaggtgcagttattaatgatggttccagagttgagtcccagttttataatcccgctacaggtattgttcttgccagcgtatataaaacttttggccaatctatgactggtacagctgatgatgcaaatgctacacgttcaacacaggccggaggatcaagtactgttacccttactttaactgcaggtactaaggtaagtgcaagattgtatcagaaccttacctcaggtgctattcctctgagagttaccagtaattcttcagatcctgccaatccggatgatggatttaacaatctaactataatagaacattaagatatagatcatgaaaaagaaaatcaatataacttataaactattttcttctcttttatttcttttcgccattaaaacaactgctcaggttggttttttcacccctaatcctgcgcaacccttgcatatagatgccggaaaagataacggttcttcccctgatgcgacaaaaatatccaatgatgttgtcattacatcagaaggtcagataggggttggagttttaaatccggttaccagggttgatctcagatcttcaagtgatcaaagaattattggtttgggcagcaatacacagagcccttcttcagctggcggaggagcaatacgttacaacaccggcggatatctggaatattctgatggtgagcaatggatagctttgccccttactcctcctaccaaagcacttgtaaatgcaagtaacagttctgcacaaagtattcccagtggaacaaccaccaccattacaggctggacagaaacagtggacctaggtgcaggaggtggagattttgatccggttaccgggctttttaaagctccgcgtgatggtttttaccttgtttctttcaatattactctggctaacggaaatatccctaaaaatacctttatagaaaccgcaatagaaagcagccaaagcaccaataatattcctgtatttaaaacagtaaactcttatcctgcttttcaggccggtgcagtaagtaattttataagcggtaattgtaatgctattttcaatcttaaaaaagatgatactataaaattcaccgtgaagcataatataggcagtgcgagaagcatcctcaatgacagcaaattgaataatttaagtatcagtgaattgtaataatatataatgatgaaatcaaagaataaaataaaaagattgattagtatttttattgctttatcattcaacataaactatatcaatgctcaaataggaataggattatccaacccaaccaaccctgtggaggttaagacagatgcaggtaacattatcattgataattccggaaaaataggcgcattagttactaatccaaaagtagcactggatctgcgcagcaatgtaaatggttctgtagctatcggaaatactactaaaacagcagcccaggcgggtgcaggtgcattacgctatgtagcaagccctgcaattggtgtgaaaggctatcttgagttttccgacggttcaaactgggtgagcttttttcctaaagggaaaccgcgtatcattgtaatggcaagcaaaacaactcaggatacttatgtatttgaaagtgctacgccttcagaaataggaactaaatccggcattgttcaaagaagatcttcttatttaactaactggactgagaaattagactcggattcaggggttcctacctcaaatttcaatccggctacaggtgaatttgtggctccgcgtgatggtgtctattttgcaacttttaccttcgcattacaatccagccaggtaaatacaggatctaacaatcaaactgaagcaatctgggaagtgagaaatccgggtggcacaatcacacagaggataaagacaaataatggatattcttctgatacaggtgcaagtcccaatgctgtacccgtagggtctgcctgtaccgtaagtgtatatttaaataaaggggacaaattaagaccttttacctggattaccgtagcatttgatggcacaatcagccagtttgatacttcaggaaatggagcctataattcacttacaatagttgaacagtaatcgattcatatttgatatttgatatttaattacataaaaaaacagcagtttacttaaactgctgttttttattttatacttagttttaattaaatcaatccgaactgctgaaagtggtgagtaaaatgctttctgtgcatcagttcccacatttctttattcagctttccaaatacataattcatgtgttctgcctgtggattctccttgtaatagatcacaaatttcttcagattatccatgaatgactgctttgctgcttccaggtttttgtggacaggctcaggaagtgaaccatcctgcggaaggaacggagctgtgaattcttttggcatcgctctgtgattataaagcgagtcctgccatttttcaatattttcttcgggggtgaaacatttttctgcttcaggttctccaaagcttaccaatactgctttttccaaatgttcaatcatctgctgaggagacatttttccccaaagtgcaggagtgttttctgttaacccgctcagtattttctgaacattctttacattcagatcaatgaaaggagattgcttagcaaccaatgtcaggattgttgccacgcaaaccacctcatctctttggttcactacttctaccagccattttacaacaccggaaggaatatttctacccttgactcctctgtttattttttctttagccgttaaataaaccgtaatggtatctccggcgtataccggtttgaagaagctgcagtcttccaatccgtaattagcaataacaggtccttttttgcctgaaacaaataatcctgcagcagctgaaagaatgaaatatccgtgagctacggttttatcgaagatggtacctgttaaacttgtggcatccgtatgggcatagaaatgatcccaggaaacattggagaagtttacgatatctgcctctgtaacagttctaccggccgtttctaaagagtctcctacttccacttcttcaaaatatttctggaaaggatgtttgtctgagaattttttctctgctccctgctgatagatcttggtaattgctttcagtacatccggtgatccctggatagctgttttctgcaggaagaaatgaaggccgctcaacccacccatttcctcaccaccgcctgctctaccaggacctccgtgcatcaatgtcggaagtggagaaccgtggccggtgctttccttggcgttatctctgttcaatacaaagattcttccatgctgggaagccattttccatgaagtttcagcgatgaagttctcatcgtgagaaacaatagatcctaccaaacttccttttcctctttttgccagtgcagccgcctcttcagcatctttgtaaggcattaatgtagatacaggcccgaaagcttctacatcgtgagagatattcttttcgaaaggcttatcattcaggaaaagtttcggactcataaatgctccgttttcatagttcgcatctaccagttcgtgttttccgtcatagaccagttccgtttctgattttaataagtttacttttctcagaacttcttcatactgctgtcttcccaccaaagatcccattctggtctctctgcttaatgggtttccgatttttgtctgatccaaagctttagataacgcattctgaacatcaccaattaagtgttcaggaacgataattcttctgattgcagtacatttctgaccagcttttgtggtcatttcgttacgaacttctttgatgaaaagatcaaattcaggagttcccggttttgcttccaatcctaagatagaacagttcaatgaatctgcttccatattgaaacgaacggcatttcctgcgatagaaggaagcgattttaactttcttcctgtatgggcagaacctgtaaacaatacagaatctccatcctgtacataatctaaaatatttcctggctctccgcacactaactgaacagcaccttcaggcaatactccactttcaatcatatcctggaacaccgcattggtaagataagatccaaaaggagatggctttacaatggaagggacacctgccagtaaggaagtggaaagcttttccagcattccccacaccggaaagttatatgcgttaatttgtatggaaacgccttcacttggtgttaaaatatgggttcccaaatgagtaccatttgcagagattttctgtgtatctccatctacccagaacggagtattgggaagcattctttttgccaatccggaataggtgaagaaagttccgaaacctccttcaatatctacccatgaatctacgtgcgtagctcctgttttgtaggagagttcgtaatattttttctttctttccaacaggtaaagggccacttttttcaacatttccccacggtcgtagaaagtcattgaagaaaggtttttgtatcctactgttcttccatagtcaagagcctgttcaaaattaagtccttcagtatcagaaacagctacctgctctcctgtaacggcattgtacaaaggaactccgtttccggtaccttctacccattgtccgtaaatataattttttaacttttccatatagttttttactttttgcttagattattgtttttaataaaattactgatgaacagataaggaataaaaagtaccagccagcaatctaaaataaagacaacttcaacaaataatgtgtagaaatagtctttgctttttagatgagcaatgacctcatccaactcagcatgttccaaagtatctgaaattcctattgactcttttgcaaagtgaaatcccaaagcatttataaagattataacaatcaatattacaagccagtactttttcagaagacttaccattggaaactgatttacttctgttcctgataaggaaacattttcaccaatccttcatataaacttctgtgaagaatggttgcatggttgtctgtttccatcattttatattctaatgtccagtttttctttcctgcttttttcaaaacatcataaaagttttctgcatcttttatcatcacaggatgttctccttttcctacggaaacataaacaaactttttggtatccggagattttgaaagtaattgaggagcctgttttaaaaggctttcgtcatcccaccacaaacttggactaataataaaatagttattgaacatttctggttttttcaaaaggatttctgtcgccaaaagcccacccaaagactgaccgaaaaggtatttatctgtagttttgaactggctttcaacatatggttttaactccttttccatgaattcaataaacttatcagaatgtcccgttgtagggtaatctttctgcagatcttttaaatccgtatggaaagtaaagtccctttttctgtctacattagcaacccccaccacaatggtttccggcatggaatacatctgattaaagaactgtactaatcctgtcacatgaataaaatcttcattgatacttccatccaaaagataaatcaccgggtatgattttgttttgtcatatccctgcggaagataaatattcagcgttctgtcttcatttaacgttttggacttaatggtccttacttctcctattgtaagcggttttgttgtaactgtctgtgctgacactacactattcaccgccaacattatgctgcatgcaagtgcaatttttttaatcatattatttttgttaaacctaacaggttttagaaacctgttaggttttcttgtatacttattttatatcatcccagatactgtaatccacaactttagttgggatctgctgtacatattccgtaaatggctcacaaggcagaatagcttcttttccttctctcgccagctcttgatatagtttagttccttctgttttccagcgaatcatttcatcagaaacatcacggataattttcgcagggcttcccaccactaattttcttggttcacatctgaaattagcaggtacaaaagccaatgctccaacgatactttcatcaccgatataagctttgtccattaccacagaattcattccgatcagacagttttttccaatatgccctgaatgaatgatagcaccatgtccgatatgtgcagattcttccaatatggtttctatatttgggaaaacgtggagggtacagttttcctgtacattggctccatctttaatgataattttcccccagtccccacggattaccgcattgggaccaatatatacttcttcacctatttctacattcccgataataactgcctgcggatgaatgtatgcagtaggttttataatgggacgaatcccgtggtatgagtagatgttcattttttttaatttgaaaatctgagaatgagctaatttgaaaattaataatgtctttcatcattttcaaattctcaaattagctcacttttaaattaattatactttttcaatgaccatcgcatatccctgtccgacaccgatacaaagggtacacaatgcatactttttatcctgcttctgaagttccattgctgcagaacctacgattctggccccggaaactccaagtgggtggccgatggcaatagcacctccgttcgggtttattcttgcatcatcatcttttaaccctaagcttcgggttacagccaatgcctgcgctgcgaatgcttcgtttaattcgatgatatccatatcctcaagggatagatttaatcttttcaacaatttttgagtagcttccaccggtccgattcccataattcttggttcgacacctgctacagaagatcccagaatttttgctttaggttttaaaccatattttttaaccgcttcttcgctcgctaaaatcaaagcagcagctccgtcattcattcctgaagcgtttccggcagttactgttccttcttttcggaaagccggacgaagttttgccaacccttccatcgatgaagaaggtttaataaattcatctttttcgaaaatgattggatcgccttttctctgaggaatttcgacttttacaatttcttctgctagtcttccgctttcctgagcttttgttgctttctgctgagaccaaagagcaaatttatcctgatcctccctgttgatctggtgaatatctgctaaattttcagcggtttctcccatcccgtcaaccccgtacatttctttcattttagggttgataaaacgccatccgaaagttgtatcaaacatctggctgtctcttccgaaagcagcgctgggctttgacattacataaggagaacgcgtcatatgctccactcctcctgcaatataaatttctccttcccctgcagcaatggaacgaaatgcattggctaccgcagacattcctgaagcgcatagtctgttgacagtttcgccaccaattttataaggaagaccagccagtaaaagtcccattcttgcaacgtttctgttatcttctcccgcctgattagcacaaccgaaaataacgtcttcaatttcctccacaggaacttcaggatttcttgctactacttctttgattacaatagcagccagatcatcggctcttacttctgataatcctccctgtaattttgagatgggagttctgacatagtctatgatgtatacgttgttcataattattttaatataacaatctgataatgtaacagtataacaataccggatttatttgtttttatttcttaattctaaagcctgttttaaagtataaggttcatatttaaagtccggtccgaacattcttttggcattttcttcaagagtagaatcgaaacctgcttcttttcttcttttattaacatttttaagatcttgtaccggccatacaaaattgacaaacacttgtttaccatctttatcttttgtcatttcaccttttccctgtgttccatagatctgttctttatcttgctgcatcaggtacctgtcctccatcatagcaacccaggtgaaaggaatttccttcttttttccagcttctttaatgagaggcaggtattttccaatttttgttgaatgctgaattacataccaggccgcctgattggtaggttctcctaccagggttttcccgggatagccatattgagcaataattttttcaatcttctgcatgttcagactatcgtgttcggccaccaacatccagtttttctttttgaattcttcttggtcaatattcaggtctttcagcagctgttcttttttctcgggagtgatctcagtatcaaaaagcattctatacccctgatccaccttcataatagcatcaagttcttttttcaacacttcattcactttttgctgggcattaacgagaagggttaaaatcccaaaaagtaacataaatatttttctcatgttggttaatctggtgtttggtattaagttttataagtcggttacttttttccctattttgtagactgttcctacaaattttgcaatcaactcgctgttttgatttgtgatctgaatgtcatacactgctgttttccttgtatcattaaccaaaacactttctgctctgaaaacatcaccttcttttccggctttggtaaaattgatgatgcagtttaaggccacagcagcatctccggtattattggaagaaaatgccagcgcagagtctgcaaatgcaaaggtaacaccgccatgaactgtcttaaggccgttcagcatatccttcttgatcggcatttctattaaacagtaattttcttttacttcaatcatcctgatattcatccactgggaaaaataatcctgattgaacatataatctgctacttgtcttggattcatttctattaattatatgtttgttatttcttcatacagctcatcggataatctgtcgtaaacattcattgttttacccagaatgatctgcccgtatgaaagattttctgagtccgatgaattttcagagggataggattcgtttaaatcaattccattttcgttggctaatcttttgatcagctctttatatttttcattaaactttcccagtaactcgagtctttcctgctcattaacagaggatgcttcctgagttaaatactgtttctcaatcagcagcctggtttccagctcagccctgaattcatctatattcataattataagttaatttattcattaataatcctattcaaatctttaattccattttcataagatcttttgaaataaaatttaattacgaaatagattattgtataaaacatagcaagtggtaataataatgctaatgcaattactccagtttgaaagcaattaacaattatcgcaaaaaccggaagaataccccaaacaaataacattattctaaaagttttatgaaattttgaattcaactttattattgtctcatgttccttttgaaacaattgaccttcaaaaacacacaaagctcccaatggtacctcggcacttattactttaaaaaaatttttctccgtatatcctcttaaaaattttctagtgcggttcattgttagggaataacttttctcactattgctatttatatttgataaaatcttttcaacagagtttaaagattttatttcatcatatctttcaggaaaatatttcatattatattttcttcaacaaaggactttgcctgtatctttcttcctgatattcttcgtaaaggttttgtagggtttcggagatctttgtatatccaatctctttaccccagcttaataatcctttcggatagtttacgcctttctgcatggccaactcaatatcttcgtcattggctactcctaatcttttcgcttcaacagcctcattgattaacatggaaatgattcttaaaaagatctgctggtataaagcatcgtctttctgagcaacagatttttctgctccttcactgtaatcgtagaaaccttttcctgtttttctgccgtgaagtttggcttcagacattctttgctgtaataaagacggtttgtatttcggatcgtagaaataatctttgtaaactgtagttgttactgcaaaatttacatccactccgataagatccatcaattcgaaaggtcccattttgaagtttcctaaagttttcatggcatcatctacctgttccggtgttgcaatattttcttcaacaattctcaagccttccccataataaggtctggcaattctgttgacgatgaatccgggaatatctttggcaataacaggagtcttcccccattctttcatgaggttatagattttttctgctaatgttttttctgttaataaggatggaataacttccactaaaggcatcaacggagccggattgaaaaagtgaattccgatgaaacgctccggtttctttagttctgcacccagagaggtgatagagatagatgaggtattggaactaagaatacagttttctgaaacataattttcaagctctgtaaaaacttttgtcttgatctctttgttttcgataatggcttcaataatcagctcacaatctttgaaatctttcagttctgtagcaatggaaatgttggctaaaatttcagtcattttctccgctgaaattttttgtttatccaccaatttggtcaatgttttttccaaacctaccgtggccgtttctacttgttttgcgttggcgtcatacacccatactttgcatccgttcgttgcggctacctgtgcaatgccgattcccattgttccggcaccgataattcctacattcatattttaaatttgaaaatttgaaaatgagttaatttgaaaattactttaattttgaacttgaaataattttagacaggattaatagaatttcttttaaatcagatagtaatttttcgtttggagatttcaaatatggagactttaagcacagcaaaagccaatattctgtctcatcagcctctttagctgcaatttttaatttatgaataaaatctgccttactttctgcattttgagcttctcttacatttgctccaattgaagttcctgatttaaaaatttgatttgccaaaggaatttttttcgcatcgtataaatattctgaaaattcaatgatattgagtgcaaaatcaaaagtcttatttacaataatattttctttgtcattcctcattttcaaattctcaaattaactcattttcaaattaattatcttcctttataattaggttttcttttctgtaaaaaggcgtttacaccttcaatgaagtcttctgtttctgcagcttcctgctgaagatcaccttccaattcaagttgttctttcaatgtgttgttataagaatgggcaaatgcttttttcgtaagctttatggctgctgtcggcatgtttgccattctttcaaggatttccatagattttggaacaaattcttcttcactgaaaacttccgctacaaggccataagatttggattcttctgcagataattttttacctgtaaatgctaaataattagctaattgtctacctaaaagtttaggtaagaagtaagttcctccggtatcaggaatcaaaccgatatttgaaaatgcctgagcaaaatatgctttttcatttgctaaaacgaaatcagagatcaatgccaacatcgctccagctcctactgcaggaccattgactaaagcaataaccggttttttgcaacgggtaacttccaaaaccagtggattataataatcgaccacaatttttctgatgatgtcatgatcgtgatgttctttgcctaccacaaaagcttcatccagattctgacctgagcagaacgctcttcctcttccggaaatagcaacacatcttacggtttcgtcttcactgcattctttgacaaagtctctaagatctgctaaagccggcttggtaagggcattcatggtttccggttgattaagatatgcgattttaagcttcccgtcaaaatgcgtttcaatatcaagttgtgtatacatagtttttattaatttattatttaacaacgcactaatttaacaatataaattcatgtaaccacctaagattttaacaatctagcaataccatcgttatgctctgcatattcgtcaattttattgatgggctatggttaattcattgtttacagttattgcattattaatgacatttaaaataatcaaaaggctccagacagtctaagcattgataagaggccttacacaaagtagacccaaatctgctgatctgcttggtattctcagaaccacagcgtggacattttttcggttttccgatgtgatgttcgtctgctcctttttcgggaggagtgattccgtacgcgcggagtttttctctcgcttcatctgttaaccagtctgttgtccagatcggaaacattttggttactacttttacttcccatccgttttctttcatcattttgataatatcctcttcgatggtaaacatagcaggacaggcagaataagtaggcgtaatgatcacttcgcaggtgttttcacctgtaacctttgcatctcttacaattcccaattctacaatattgattaccggaatttccggatctgggattgtttttaataaatctaaaagctgattcatattttattttttatcagaatcaagaattattttcattgctttctgataatctaaattatctgttatgccgttgtgatactgatcttttaatataatcaggctatcatcttttttaaaattattcttaagttttaaagatgccctgtaattaataatctcatctttatcgccatgaaaaataattatcggtgacttaactgtttttaaatatttaccggtctcaaaattatatttcagtaaaaatctcggaagaaatgagaatttctgactcatttcatcttctgtgctataatatggagcctgtagaataagcaattttgcataatgctctgacgccagttttgcagccagtcctgttcctacagaatatcctaaaataataatcctattctccggatatcgtttcaaaagttctttatacgcagcatcaacatccgaaaaaatctgatctttactgctaattttatcttcactttttccatagccccggtaatcaagtataaacgtatcatagttcatacttctgtataactgagctacttctccccagtcttttattgatcctccatttccatgaagataaaagatgacgccttttggatttcgagctttaaataaaacagcatttaagtgcttactatctcttgttctgatcgttacttcttcaaaatctccatcaaatttaaatttgtaattatccggcagcttttccggataaaaaataattttctcctgatagaaataaagtccaacacataatatcaaatataccgcaaggaaaaaagccaatattcccaggagcaatctcttcatgactttttaccaagtacatccaggatacgctctctgcatatactgaagctcacaaaggatatatccgaaatattctgtgtgatatcctgttctggattttggttgcatgaaaggattctccggatattctaaaccgaaatctgcaaaatctttctttgtaatcgcaaggaattctccataaagggcatctgtatccggagcaatattcaaagctaccaagtcttcctctccttctgttttcgcaaaaagaccttttgtatattcccagatattttcaacagcttttactaaacgggacttactttcttctgttccctgggcaaagattttcatccatgatgcggcgtgcgtataatgatatcttacttctttcaatgatttctgagcgatggcgctcaattcttcattagcagagtttgataatgcttcatacatcagtttctgatatactgcaaaaacataaactttgagaattgtttgggcataatcttcattgggaagttctgtccagtgggcgttcagatactcgtgctcatatcttaaaaacgcgatatcatcttcacttttaccgttatcaatcactcttgaagcataaacataaaagttattcgcctgccccagctcatccaacgcaatattggtcaatgcaatatcttcctctaagtaaggaccttcaccgcaccattcagacagacgctgtcccataatgaaactgtcatctgctagttttaataaataattatataatgggttcattattttagcttttggcttttggcatatagcttttagcaaattgcaagcagctaatagccattagcgtttttacatattttttacatcgttaggaatctcgtagaaagttggatgacggtatagtttatcgtctgccggatcaaagaaagcttctttatccactccttccgaagtcacaatatatttgcttggaacaacccaaacagaagttccttcttttcttcttgtataaacgtctcttgcgttctgcaaagccatttctgctgttggtgcctgcacaattccaacgtgtttgtgagataatcccggtttagtctgaataaacacttcccacatatctaaatttgccatagtcaaattaatttaacaatgtatcaatgtaccggtttaataatgagatgcttcgacaagctcagcatgacaatgatggttacatttctacattagtatattgttacattattatattacttctttttgttgtttctcagcaaaagctgctgcagcttcttttacccaagcattctctctctgagcttttctcttcgtctcgatacgcttcttgttacaaggtccgtttcctttcagaatttccatgaattcgtcccaaggaagttccccaaaatcgtaatgctgtctttcctcattccatttcagatctttatccggaatagttaatcctaaaaattcagcctggggaacggtaacgtcgataaatctctgacgaaggctgtcattactttctctttttactctatagttcatagaaattttagagttgggtgagctgtcatcattaggtccgaacatcatcagagccggccaccagaaacggtttaatgaagcctgagccatttctttctgctgttttgtaccacggcaaagtgccatcaggatctcgtatccctgtctttggtggaaagattcttctttacagatcttcaccatcgctcttgaatacgggccataagaatttcccatcagcattacctggttcataatggcagctccatctaccagccaaccgatggcgccgatatcggcccaacttaaggtaggataattgaagatacttgagtactttgcttttccttccaacatatcatcataagtagcatctctgtctgctctgatgcttccgtctcctagagtttcagtagcagagtaaaggtataaaccatgacctgcctcatcctgaactttcgctaaaagcgccatttttcttctcaatgaaggggctctggaaatccagttggcttccggcagcattcccacaatttcagaatgggcgtgctgtgaaatctgacgaaccaataatttcctgtaatcatcaggcattacatcttttggttctactttattttcttcgtgaacgtattgaacaaatttttctaagtccataattttttaatttgaaaatttgagaattagttaatttgaaaattattttgagaaactgagaataagttattaatcattttcaaatttccaaattagcacattttcaaattgaattaaacatcataattaagcatcaccacattcgttgtcgggtgacattggcaggtaagaacatagcctctggctacttcttcttcggtaagcgcatagtttttctccatgaaaacttctccttccagaacttgtgctttacacgtacaacaaacacctcctttacatgcaaaaggcacaggaagattgtctttcaatgctttatctaagatactctcttttttggaattaaggtggaatgaatattcatcatcatcaatgattaccgttaccatactttcaatattggcaatggctttgaattcatcgctcatttcctccgtattttcttcatccggagcggtgaaatattcaaacaatacctggatagcaggaacctttttatcttttttcagataatctgcaattcctttgatcatttctgaaggtccgcagatgaaataagttgcttctcttacatcaatatctgcgtatctttcaaataactgctccagtttttcagcagaaattcttccttcgaatacaggatcttcgtgcttttcacgacttaccagataaactactttaagccttccgttgaactgttctaccagcttatcaatttcagcttttcttaaaacatgattcatacttctgttgctataaaacagatatgcattactgttaggttcctggtaaagactttctttaatattggataaaacaggagtgattccgcttcctgctgccaatccgacataggtcttcacatttgtcggatgataagatgtattgaaaccacccattggaggcattacttccaatacttcatccatatgaagatgctcattgaaatagcctgatacttttccgccttcaagcaacttcaccaatacttccagtgtattgcttttttcactgggcgcattacagatagagtaagaacgtctttcctcattcccgttgatcatcatccggaaattcagatactgtccctgtttgaacctgaacttatctttcagctcttcaggaatttccaccgctacatttactgcatcgggagtgtctttctgaaccttaactgttttaagtttataaaatgaattcattatttttttagtattctgttaatttttccaccttcgcactttggcaggctgtcctgggcatgaactttcacttttgtagtgatgcctacccgtttttttatttcgttttctatgttttttccaaagttcccgacaaaattaaaataatcatcggtattggcttctattttctgagattttaccaggtcatcatctatttcaacatcaatatccaaagcgatacacatgtgctctttctccacaggagttaaatagtagttaggaactactccttttacatatgaaaaggcatcttcaatctggcttggataaacattaactcctcttacgatcagcatatcatctgctcttcctacgattggcttcattttcaccattgttcttttcgcattttcatcgtagtaaaggcttgtaatgtcattcgtccagtaacgcaaaagcggcattgcttttttagttaaagtagtaattaccaaaaccccttcttctccgaaaggaacaggctgctttgtgatcggatctaaaatttcaggatagaaatgatcttcccagatataagctccgcctttttcctcaaaatcctccatggaaactccaggtccgataatttcgctcaatccgtagatattggttgcatgaactcctaatctttcttcgatgtgccctctgataatttcggtccacggctctgaacctaatacagcatatttaagactgatttcatctgccgaaattcctctttttgcaaattcatccgcaatcgttaaagcatatgatggtgagcagcagattacttctggcttaaaatccataatcagatccacctgtcttgccgtcattcccccggaaataggaagaacgctcattcccagcatttctgcaccataatgaagtcctaatccaccggtaaaaatcccgtaaccgtaagcattatgtaactgcattcccggtttggcaccagcagcattcaatgatcttgccactacttcactgaaaagatcaacatcttctttagtatatcctaccacagtcggttttcctgtcgttccgcttgagcaatgaatacgctgaagctcgcttttaggaacggtaaataatccgaatggatagttatctcttaaatcctgtttgtaagtaatgggaagtttcgtgatatcctcaatcgaccttatatcctgttgagatatttgcagttcatcaaatctctttttataaaattccgacttctcccccaaatagctgatcaggctgatcaaccggtcggattgaagctgtctcaactgatccagcttcagatattcaactgaaaaatccataaaactaactaacatttgttaggtgtaaatttaaaaagattttggaagctggcaaaatttttatgacttttgtcatattttgaatgattctaaataacaaaataaaagctcaatgcttttcttgtaaaaaaatataatgtaaaatgtattaataattcttcttgtcaaagacctatgaatgttggtttcccaacaggccgaaaagaatcttttcccttatttcatctgtgatttcatccgtggaatcactgcttcttttgaaccagaaataggagttatttaaagtatgaaggataaatcttgtggtaaacgacggagatttcagttcccagttttcagctttataaatttcagaaattagtttttcaacctcctgttgataattttttctcaattcaacaaattcgggaagcctttcttcaagatgcttccattcattggaataaatatgggtaacgtcacggtttttaagaactacggaaaggtgcttgtccagcaataaattcaatttttcccttggagttacatcagtattttttacttcctgaagctcatcaaaaaaatcctgggcaataccaaaacaaatccattccaaaatttcttcctttgaacggatatgtgcatacaatgaagctgctttaatattgagtttagtagccagatcccttaccgagcttcccatatagcctttttctttgaaaagctctactgctacatctagtatttttctctgtttttcttttagttccatctggtaaaatgcaaaagtaattattctgaattaaactgctcgttttttgatcataaaagattaatccatctgaatcaattcaatccgtgcatttaccttctgttgttagctgctgtaattataatatgactatttgttcatagattttaaataaataattacgaaatcggaaattttgtcaagttaaatttccgttaaaaatgcaaaatccggaaattttgtctatattttttgtaaatttaataattgaacagtttttgcgatacagtcatcgattaaatgattaaataattgattggcattaagaaactgagcctcagaatttggtttcttgatgttttttaaaaactaaactttgaacgaatcattaccaaaaatatataaaatatgaacttaaaccaatatactgtaaaatcacaggaagccatccaggcagcacaacaggttgcgatggaatttggcaaccaaagcattgaaccccaacatctccttgaaggaatttttcaggtagatgaaaatatttcgcctttcttattaaaaaagtctgaagcagatgcagcattagtaagagagcgcaaccgtgaaaacttagaaaagcttcctaaagtacagggaggaaatatttatctttcacaatctgccaacaaagtattgctggacgcccccaatattgccaagaaaatgggtgatgaatatgtaacgattgagcatttatggctatcacttctggaaaccaactcagaagtatccaaaatgctgaaagatatgggcgtaaccaaaaatctcctggaaggtgctatcaaagaattaagaaaaggaagcaaagcgacttctgcaagttcagaagaaacgtatcaatccttaaacaaatatgctaagaactttaacgaattagcagcagaaggcaagctggatcctgttattgggcgtgatgaagagatcagaagagttctgcagatcctttccagaagaaccaaaaataacccgattcttatcggggaacccggagtaggtaaaacagcgattgctgagggaatcgctcatagaattatcagcggtgacgttccagaaaacctgatggataaaacattatattcattggatatgggagctttgatcgccggagcaaaatataaaggtgaatttgaagagcgtctgaaatcggttgtcaacgaggtcatcaaatcggatggtcagattattcttttcattgacgagattcacacattggtcggtgccggaggtggcgaaggagccatggatgcagccaacatcttaaaacctgctctggcaagaggagaattaagagccattggagcaacaaccttgaacgaatatcaaaagtattttgaaaaggacaaagcgttggaaagacgtttccagaaagtgatggtggaagaacctgatactgaatctgcaatttctatccttcgtggtattaaagataaatatgaggctcaccacaaagtaagaatcaaagatgaagcaattattgccgctgtggaaatgtctcaaagatatatttcagaccgttttttaccggataaagccatcgacctaattgatgaggcttcggctaaactgagaatggaaatcaattcaaagcctgaagaactggacgtactggacagaaaactgatgcagatggaaattgagctggctgctatttcaagagaaggcaaccaaaccaaaattgatcaccttaaagaagatattgccaaaatatccgagcagagaaatgagatcaatgccaaatggctgaaagaaaaacagaaaagtgaagatcttacccagatcaaaaaagatattgagtctctgaaattggaagcagaaagagcttccagagctggagattatgccaaagtagcggagatccagtacggaaaactccgtgaaaaggaagaagagctcagcaaagtggagcttgaaatgcagaatcatcagaatgaactgatcaaagaggaggttactgcagaaaatatttctgaagtcattgctaaatggacaggtattcctgtaaccaaattacttcagtctgaaagagataaattattaaatctggaaactgaactgcaccatagagttgttggacaggatgaagcaatccaggcagttgcagatgcgatcagaagaaacagagccggattgagtgatgataaaaaacctatcggatctttcctattccttgggacaaccggagtgggtaaaaccgagcttgcgaaagcactggcagaatttctattcgacgatgaaaacaatatgacaagaattgatatgagtgaatatcaggaacgtcacagtgtttcaagattggtaggagcgcctccgggatatgtaggatatgatgaaggcggacaattgactgaagcggtaagaagaagaccttactccgtggtactgctggatgagattgaaaaagcacacccggatgttttcaacactttgcttcaggttctggatgatggacgtcttactgataataaagggcgtgtggttaatttcaaaaattcaatcattattatgacctcgaatttaggttcacacctgattcaggaaaattttgaaaatcttacggaggaaaaccaggatgagattgtggataaaaccaaagaagaagttttcgatcttcttaaacaaacccttcgtccggaattcctgaacagaattgatgaaattgtactgttccagccattaagaaaaaaagaaatcggaaaaatcgttcagtaccagttgagaggtttcaatgaaatgttatctaaaagaaacatcattatgactttcactcaggacgcagtggattatctgatggataaaggttatgatcctgccttcggagcaagaccattgaaaagagtgatccagcaggaagtattgaataaattatcaaaagagattcttgcaggaaatgtgaatgatggagacagaatcactttagattattttgaagaaacaggactggttttcagacctactgaacaataaaatagttttttttcatatacattatttttgtgaataagtgctgtagattactctgcagcacttattttttatattgtcattcatgcaaaatttctataagcttttgctaatatatacaatccgtaaaatcccggtaaaaataacagtataattccctgttcaccaatacttattctaccatattttttccgagatttgcatattaattgagttttatccgtaaaccactaagttatgaatacagaatcaaacaacccactacaacctggaataatgtcaaatagtctcatccagactctgatcgacaattaccgtcaaaaccatctagcagctattaatactgctttaggaatgcaagatgctcattctatctggtttgaccttccaaaattaaaaaatttcattgcaaagattgaagaagaagtagccaaagtgaacccagctgcatctgcagaagatttaggaatcagattttattattctgcctatccgaagcaagaaaactggtctatcatgcaatcacatcctgtcccaacagaatatgctgaaaaacatacattagtactaatcccaacattgaaaagagccaatgaaacaggagagcttattgattatgatttcaatccttttcaaaataccgaaggaaaatctttagctttaaatgcacgcaatggaaaaggattgggagatgatgatgacgacactggtcttggagaaaatttgggaacattgatcccacctggaaattctatttcggaaacttactaatcttcattttaaagcattcatattaataaaccaatgactgaattccaaaagttttttttacaaatcatgtacaccggtgaaggaattgcagccttaacatccatcatttattttaaccgtgtaaaaaaacaatattggaaatatttcgcattatatcttatcactatttttctatgcgaatctgctgtaaaatggggtgagaaacctcttcacattaatagagtactgttttacaattactttgtaatgcccttacaatttatcttcttttattggttgtatgcaaaaaaatcattaaaaaaaacaaaactgttttatacattttctgccacacatcttctatcatatatccccagccttttattctttccggataataagattgttttttcttttaattatactttcggctgtttatttttaatgattcttgttatcatggaatattataagcaggtaaattcatcggagattttaaaattcagcaccaataagatgttttatattaatttaggtgtcacacttttttatataggaactcttcctttcatgactttcatgtctctcctatggcagtatagaaatatttgggatttatattttgcttattttcaggtttcaggagcagtgatgtatattttatttgcaagttcattcatatggggaaaacagagctcttaataactattatttcattcaacatcttttttttgatgtttgtaatcgccgtaattatttatatacggaattacagacagcgcaaaaaagaatacctgaatgagatcgagatgaaaaatgaacttcatcagagagagcttctggctacccaattggaaatccagcaggccaccatgcagcagatcggaagagaattgcatgataatatcggccagaaacttaccctggtaagtctctatgttcagcaaatgctttatgaaaacaaagtcccggaggcaagtgaaagaatagatcaggtttcacaaatcattaatcaatctttacaggaccttcggagcttgtcaaaaacattaacggatgacaatatcaaccaaaaggaaattgtaactttgatacaggaggaagtagacaataccaattcttttaaaaagtgtaaagtaagttttgagcataattttaaacagctggatttgggttttgttcataaaaatatgctgctaagaattacgcaggagtttattcagaacagcataaaacattcccgctgtaaaaatatttttataactctgaatactactgaagacatactttgggaacttgatatccgcgatgacggaatcgggtttgatacatcacagatcaaatccaacggaataggtcttaccaatatgaaaaacagagctgaaatcataggagccagctttcatatggaaagtaaagaaaatgagggaacccaacttaatattatcttaaaaaaacagtcatgaaaaaaagcatcgtaatcgttgacgaccatatactcattgctaaagccctggagggcattattggtaattttaatgaatttgaagtcatttatgtctgtgagaatggcaaagatcttattcaaaaatttgaagaaggaaacgctattccggatattattcttctggatatcagcatgcctattatggatggttttgaaacggcagtatggcttacaaaaaatcatcctggtattaaaatcatggctctgagcatgcagggagatgacaacagcgtgattaagatgatcaaaagcggagcaaaaggatatcttttgaaaaacacgcatccgagagatctggagactgctcttacgcgactgaacagtgacggcttcttttacccggactgggcttccaaaattatattcactaaccttaataaagaaactgaatctgaaattgttgtgaaaatttccgacagggaaaaagaattcctgaaatatactgtgactgaactcagctataaggaaattgcagacagaatgtgctgcagcccaagaacagtggaaagctaccgcgaccagctgtgtgaaaaactcgatctgaaaacccgtgtaggccttgcagtttttgctatcaaaaacggttttgccaattaagactcaacgcgaaaattttattttaaaaattaaattcaaacgaaaagtattcatgcaaaatcattaaaaaaagtaaaaatgcataaatataatttgaaattaattaaaattcaaaacatactcaataacattaaatttaattcaaataaaaagacagatacttgataatatcttaaatattttcaaaaaaaatttgcatatcaatttcaaataatataatttcacatcctcaacctaaacgatttttgatatgaaaaaactattatttggagcttttatgctcactgtaatggctgcgtgtaacactgacagcatcaccaatcaaaacgaaaatccgactgacgaatcagttaccactccgggattagttcaaagaggctgtgcttctgaggaaatcagacaggaggcattaaaaaaaagccctgaacttcagcaaagatttgctgctctggagaccaacacagaaaaatttgccaacgatcttaaagtaggaaaagttcttgcggacggcagtgtggaaattcctgtgattgtaaacgttttatacagaaccactgcagaaaatgtttctgatgcaagaattgctgagcaaattgccgtattgaatgctgactattcaggcaccaacagtgatgtcagcaaaattcctactgaattccaatccgtaagctccggtgatacaaaagtaaaattcagactggtaaatacggttagaaaatctactacaaaaacgagctgggctactaatgatgatatgaaaaaagcctcaaaaggaggtattgatgctactaatccaactaattatttaaacatctgggtagttggtaaaatgaccagccagggacaaactattcttggatatgcaactttcccggagtctgcaggattatggaacgacggtgtagttattggtgctccgtattttggaaaaactggagcttcttcacctttcaatcttggaagaacagctacacatgaagttggccactacttaaacttaagacacatctggggagatgccaattgcggaaatgacctggtaagcgatacgcctacacaaactactgctaattacggaaaaccttcttatccgctatacaatacatgcagcggtgtacaaagatctgtaatgttcatgaactatatggactatgtagatgatgcagctatgtttatgttctctgcaggacagaaaacaagaatgcagtctgtagtagcttcttctggtgcaagatccggattaagagtttattagaatatatttttaaattatattaaatctatcccaaaccaatggggtagatttttttttaccctttagcctggcaaaatgtttacgaactctatgaaggcaactttataggcagtatcagcatttgaacaaaagccgggataagataataatctgcacagctggaatattataaaaatattaaaatagtctgtctcaattttttggatagatttttttaatatttttacccgattttaatttcagcaccactaccgatgaaaaaaacagcattagcatccggaatactattgcaattatactgtattaaagcacaggatactatccaatccagaaacctcaatgaagatctggcactcatcaattcagggtatacaattcaggagaagacaccgtttttcaaaaaagaatgggttaaaaaatcagtggctcctgcaattctttttactgccgctgcagcaacatggggagagaaagagaatatccgtgaggtaagaaaccgttatcttcccaacttcaaagtcaaatatgatgattatcttcagtatgctcctgctgtcgctgtttacggattaaaactctcaggtgtaaagggccggaacaatattgggcgggcaaccttatcctatggtacaagtttagccatcatggctattttagttaactctatcaaatatacagcaaaagttgaacgacctgacggatccaaaaataattctttcccatcaggacatgccgctatggcttttaccaatgcaagttttcttcacaaagaatacggaatggtaaacccggcatacagtattgcaggatatggttctgctactttaacaggccttggacgaaatttaaataacagacactgggttccggatattcttgccggtgccggtatcggaattatatctacagaactcgggtatttctttattgataagatttataagaacaaaggggataatttgagcctcttatccagaatacagggaaatgactatccttcttttcttgctctgaagatgggtacagcattaggtacaaccaacttcctgaaagaatcagagcttgatgacaaaaaacaaaccgggtttgagggcggactggaaggtgcttattttttctctaaaaaatggggtgtcggcgcagatatagctttcagcagcttcccaattaaatctcaaagaataacatttgatgatgggcaggattttggtgatcatgaaatcaaaacacaatctatgggattccttgctgcaggcattggtccctatttttctcatgaattatcagataaatggcagcttactttaaaattaaccggaggatatgccgcaactgcaagtggaaaagtatttgtaaaaggaaacgaaatagacactcctaatcacgaactgcagatagccagatataaacctaaacccgccttccgatggaatacaggagcttccatgacttataaatttaatccaggattaggtcttaccttttatacagattataatcagatcaactctactattcgttattacttcagtgatgagattaaagaaagcgctgaactggaccaggaacttaataacctgattgcaaaagaaaaagttaattatatcacattaggtttaagattaacagcctatttttaaaatacaaaagccttcaaaatctgaaggcttttatattataaatttttgcggttattttccggagtataatccataaacaggtcaccatccagctgcaccgattttactttcttcttaattggaatcacaagatcagccatcttctgatctttttcccagacagacggtgaaaaatgtaacttttctgtacttccgtcttcataagacagtattacatcaaaaggaatggcaaagcctcctacattggcaacatttacagtaagcatatcattcatctgggatgcccctgataccttcaagtcaatataattgttggtataaaaccagttctggaagaaccagttcagatttttacctgaacctgtattcatggaattgaaataatcccatggaaccggatgcttcccgttccagttgttcatataatgatgtaatgcttttttgaacagctcgtctcccagataatctttcagagccagataagacaaggatgcttttacataggaattatttccgtacccggcaccactcacctgcgtactcattgtaattacaggctgatcctgttcggcagatggatcattaatccattttttaacgcggaagtttttataaaattctttagctgcagcttctccgttttcatcaattcctataagatattccagtgtagtagcccagccttcatccataaaagcatatcttgtttcgttgattcccatgtaaaaagggaaataagtatgggcaatttcatgatcagctgtcaatctcgcatcctgaagatcatcgggaatacttgtatcattaatcatcatcggatattccatatctgcatacccctgaatagctgtcattacattgtaaggatattctacgccaggccagttcttggagaaccaatccagattataacgcatccagtctacatagtgttcaaaatctttcgctccggacttatatcctgcctgaacgcttgctctttttgtttttaactgaacacttgcagcgtcccaaacataatgattactcagtgcaaaacagaaatctgtgatatggttagccttaaatttccatacattccatttattaggtttggtcacttttccggacctcatttcctgttctgtagcaacgtgtaccagcttatcgctttttaacgaagctttataccgttttaaatattccggctgaagaacagcttccggattaaggaaatcaccggttgcccagaccacataattctttggagctgtaatactgaaactgtaatcattaaaatcattataaaactcctgtctgtctgagtgctgaatcatatcccatccgttataatcatcatacacggaaattcttggaaaagaataggctacatagaatgtttcaggatcaatctgaccttctctttcactctttacggacaacggatactcccattctattttaacctcagctttggattttgactttaaaactgttttcagttttactttttcaaccgtactccagtcatcactgttgatgtcatattttgcaccatttacgataaaagatttaatcttaagccctgaagacaggaaatctttggatacaaaccctgatcttggcgactgtggtttatgaaggttatttacaaagcgtatggccagctcattcagactatcaggactgttgttgatatatacaatcgtttcttttccggaaactatttttgtactggcatctacttttacctctacattatacactcctttgttctgccagtaatttttacccggtgctccggagatatcacgggttcctctttcgtatgcttttttgatattcctcggcatatacaattcctgtgctgatagttgcagcaaagaaactgctaccagcatcatggaaaaaattttcttcataacgatctttttaaagattgacctcaaaaatagcgaaaatctgacatcggtagatcatttgttatataataatattttattgtaacgattcttatattaaattcgcttacaatctttcctgttctgcagttttctttattgtttttgcatttttcacagactgatttccaaaattgaatttcaaagaaaatgtaaaactctgagtatcccggtaatctaaaaaataattatcctgattggcatactttgtacttattttttcctgtgaagttttaaaaatatcattaaacaaaaagcttgcttccaattttttgttaaagaattttttattgaccaccagatacgttgcagaagattctgagatcctgaaagttccctgtatccccggagaataataacggtgtccgatttccgttttccaatcgctgtttttatcgagtgtaaaactcgttgagatattggatgctaagttccagactttgtttttatagattactccatcgattcccttgaaataattctcattatgctcaagattttcagacacaataatattccaccatggcttgacctgaaagtttttgtaaaggcttaatccaaaagcttctcctttctcaatattggtaaaataatagataaggctgttggtacttggctcctgataggagatttccatggatggatagatttctttccggtaatataaatccacattccactctttccatgaataggtaagattcagattgtgcgtgatggtagcctttaactttggatcgccctgatagtaggaaaacaggttataataagatttcgcaggattcagccatgaataggaaggtctgctgattcttttcccataagaaaatccgaattcctgcttattttctgtggtatactgtacataaaaagtaggaaagaacttccagtaattgtttttattcagctcatagggctcagagaccaccccttcaagatctgtcatttccgcacggagacctcctttgaaattccatttcccgatattgtaagctaatgaagaatatagggcaaaattgtgttctttataatcaaaaacactgcttttttccggcctgtattgtaatgctccgttctcattatctgagaaatcaagcttactgtttgtctttacaaaactatatttcaccccggattccaactccagtttatctcctttccactgataatcgaattgagtggaatacagctggacatctgctttattctttgtaataaaattatcttcttttggaacctgtcctgcgaagttgagatagattatcacattctgatatttatcggcattatttccggtaaagtaactgatccaggaaaggcggcttttcttattcaacttacggtctatctgaaaacttacggcgttattgatggaacgtgaacggtgatcattgatcgttgtataattggattctacgatatcctgctgattatagattaacgtaggcacattgtagaccccgaaggattttggagaaaaataccctgagtagttgaggctaatattggtcaggctgtccaattcatattccgcattaaaattcagggtattctggttattgtttttatccttcctgttcattgtactgatccatcgggtttgactttccgggtagttcacataatctgttccttcccggtagtatgtccccaatcctctataatagcttcccataagagaaagtttattctttttataatattgggaaatcccaaagacacctttcgcatattgtgtctgtatatatttggaggagagaattccgcggtagccttcaatcttatttttcttcaggacgatattcagtacagcacttcctgacgcttcatattttgcaggcggattggtaatcacttcaatcgacttcacctcatccccttgtgtattttccagaagatttttgagctcatcccccgtcagcattacttttttgtcattaattgtcaccagaattccggtacttccctttacactcaatacactgttgtttattgtaacacttggagtattttttagaatttcccaggcattaagtgatgaaatattactgttttccacattaaattccagccggtcaacttttcttttcaccagaggtttacgcttggtcattaccactccttctatttcgtgagattcttttttaagaatgatatccagaggttcaggttcttttaaatccaattttttctcaaataaagaatatccctggtttttaattaccagctttatatcctgatctgtaatatcttccagcacaaacttcccattcccgtctgtttttaattctttgattaatttattccgaacatcatacacttccagctttattgatgacagcttttcattttcagtgttcataactgttccttcaagtttttgtttctgggcaagaatcaaaaccggcaaacacagaaaaaaaagaattttatacatggctattttttttattctaacaaaacactgttctgttttatgcctacaaaattctatattgaaagggagaatttcggttaacgatgggttaatgataggttaatgtcttttctttacaataacaaaacctgaattcgtaaattcaggttttaaaatcaacagagtatattttttatggataaggaatggctttatccagttctatcggattataatatttttttatgtctatctgcgtttgtttagtcaaacctgcaaattcttctttgcttttgatttgctgtccattaatgcggacattccagtccggctgaaattcagttctcattctggcataaggatcattataaaactccagattctgtttcacccatttcttaaaatcaatggcaataggagacaatgaataatgcttttcgagaaaacctgttgtatcatatattttggagaggttaatatttctggagaaagagtatatgaagtctttcttatcatcctctacatacatcaccaatcccggcaatcctctgaatttataaggaccttcaggaatattgatgtccggagtaaaccaggcagtccagtttcttcctccaaatactgcagttgctttttgcaaattataattattgatcttttgggtatcagcctctattttccacggaacattatcttccgtttcaaaaacataataatagggcatcatcataatctggacaaaatttttatttttattgcccccttttttccggataatagtctgtccggactggctggtatgctgagaagacatctccccatgaagaatattcagagaatcgtttaccaaaaatgcaaattcataaaatttcacttcctccggattgacatccagtaccatttcttctttctcataatttgtacctttaggatcaggcctgtattgaagttcgtatataaagcgatgggtctgggctttgatccccatcccaaatagcagaacaagaagaatgaatacctttttcattacatcgttttaattttctaaaattaccaaaaaacacactaatcatcaggttaataaaaggttaatgataaaaatactatttcagtaaaatgttaaagttttatctttgtttttaatgatagccaagagtaaaattctgatcccggtttttgccgctctgttcctgcttttactgggaatacaggtttactttatgtataaaacctatcaggttaaagagagagaaatctacagaacagtacagtctcctctcagagattatactgatgaactggaagataacggcggtgcaaaaaaagctgataatgattctttacaatcttttttcatccattataacaataaaaaaatcagtaaaaaagatttcctcaagttttttgaagaaaacaggaagcagacgatggaagcattcagtaatcatgttgacagtatgtttagaaaagaaggatatagaattgcagtaaaaatagaatacctgtctatttctttcatgcctgacaatatcaatctcctggacaggcccattgtactatacgaaacgaaaaacaaaataataaacccggaaattttaagcaggggaaaatgggaaacaagttctacttcaaaaatcaatcataagtccgggaaagatgatgtttttctggtaaaaagcagaaccagtctggaaatattaaatattaaaagtattgttttcaaagaactggcatttctttttctgtcttgtattgcgattttatcctgcgttctgatgctgtatatttttactattaaaaatctggctgcccagcaaaagcaggtagaagttctccacaacattgtagataacatttcccacgagtttaaaactccgattgccactttaaaaatagcttctaaagcattaaaaaaagaatggaatcaggaaacacttcctcttattgacaggcagatttcccggctggaaagccttatgttccagcttcacaaggatgaaatacctgatgagatagttgaaatccatcctaaagactgggattttttcattcaggatcttgcgcttacttatcctgatattgattttaaacctgaaaacaaaatttcacaaaaacttccttttgataaaaacctgatggaaacggtgattaaaaacctttgtgaaaacagtgtaaaatatggggcttctgttgttaaaataaatatctgtaacagttcccaacaattggaaattgaagtttctgacaatggtcagggcatggaaacaaaagaacttaataatattttcgaaaaattttacagaatacagaataacaatattcataacagcaaagggcttggcttagggctttatttcgtaaaaaaaatcattgcttattacggtggaaagattgatgtttccagccagcttcatacaggcagtacttttaaaatatcaattccttatgaaaactaaaatccttctggcagaagatgatccggatttcggaatgatcctgaagcagtatcttgaactggaagattttgaagtcatttggtttcagaatccggaagatgtcattccattacttcatactgattttccttttcatataggaattctggatgtaatgatgccgaatatagatggtttctcactggcaaaaatgattttgaataaaaaaaatgatttcccattgttgtttttaacagccaaaaaccaaaaaatagaccgtctgactgggttgaaaataggcgctgatgattatattgccaaaccctgcgatcctgaagagctcgttttacggatcagaaatattctgaagagaagtcttcctggtgttgcagaaacccaaataaaaataggggaattctcactggatactaccaaacttctgttgtcacatcctaacggaaacaaccgcctgaccatacgggaacaggaattattgctgtatcttctgaagcataaccgatctattattacaagggataatatactggacaatctttgggaaaccaatgattattttaccggcaggagtcttgatgtgttcatcagcaggctgcgtaagtacttcaacagtgatccccaaataaaaatccaatcccttagaggaattggatttgaagttgattttccaatcaagtgattttttatagcgacagatgtacaatcaccgggaaatggtctgacgggtataaaagattttctcttctgtcattgatatgccggtgagatcttattttaaagccttgcgtaaagatataatcgattctgtctttcgggactgtattaacatcaaaagctgtaaaagttcctacagggccataatgcttggtttcagaatggtaaaaagtatctttcatattccgggaaagaattttaatcggttctgaatcatctgtcaggttaaaatctccgcttagcgttaccggaaggttctttggattgagttctttgatctttttcaggatcaattcggaagatttcactcttgccacatttccaatatgatcgaaatgaagattcattgcgagaaattccttttttgattttttatctttaaatacagcataggtacagattctgttcaatgcagcatcccagccttttgaaggtttttccggagtttcagataaccagaaggtgcctgattttacgacatcaagtctgttggtgtcataaaagatagctgaaaactcccctttttctttaccgtcgtctcttcctactcctatataatcataattctttaatcctgttttaatatctttcatctgctcaggaagagcttcctgtacgccgaaataatcgggatggtaataggtaagtaaatctgcaacgtcctgcttcctcttcggccaggcattgtctttatctgactctacattcagcctgatgttaaaactcattacggtaaggtcctgtgaaaatcccaatgcaaaaagcatcaggaataccattgaaaatctgaaattcatatgttatgttatcaataagaaaacaaaaataaaacttctctttgacagagaagcctgatttatatgattatattgttaaattatctttttcttcttctacagatataaaatatgcctgaaattcagtttcagaaaccggcaatgcactttcgagtttcacaacgccaatggttttataatgggccgcaagtttgatctctttacttttaagaaggatttcaagctcgttaaaattgatatttttttttaaaactgccagataagttttcataagtatacctgtattaaaccatttcctatatctctgtattttatgccttcaacgggccttgctttatgttcaataagctcccagatttctctggctgatttatcaggaaactgctccatatataaggctgcaagtcctgaaacatgtggtgcagccatacttgtgccgctcatggtataataaaatttttttttgttctttgcatttttaggataggcgcttacaatatccactccgggagcacagacattgatacttccaccggtagatgggttaagccctgcatttgaaaattttgcgatcttcatctggctgtcaatagctcctacagccataatcgattttgaattggcaggcattgaaacgggttgtggaatctgcggtctgttgctgtcatttcctgcagccgctataataagacagttattttccaatgctctttccccaatggtttcaaaaagaacagaaggctggtcgtcaagctttaccggacatgccagcgataatgacagtattctgaacttcttcgtaatcgcccagtctattgcatcaatcacactgctggtagtacctcttccgttatcagccaatacttttgctattttcaggttggaatccttagcaactccataacgttttccggtatcacttcttacgtttccggtggcaattcctgcacagtgtgtaccatgtccattgggatcccttttccagtcttcaccatctatgaaggatttaccttcaatttcttcagatgaaaaatcaggatgggaggtttcgagacctgtatcaagaatacagatatcaattccttttcctgtgtaatgagtattttcgagaccaattgcctgtaatccccattccatctcaatgaatgagttttgaggtaaaggcttgctggtcatatatttttcaagctctgaaattttttctgcgagccctgcagactgttttttaagttcgttgatcagctgcagttcatctgccggaaaaaactcacgttctttttcatagtaaactatagaattggattcatctttaacagcgcttttcaattgttcttcatccatatgatccaccacaagaactccaagatttttataaagcacactgttatcctgatcgatgacttcataggaacggttttctttggaaagaaattctgaagaagtaatactcacttccagttctctctctatttttttaagcgatgtcttctgctgatctttaagcaagacaatatatcttccggtttccataaggttcttttttaaattaacttcagaaatactttttccagaataagaaaaatatcctcaggaataatggtcagcctgagcttcttattaattccggatatggctgtattctgctcagacagagaagtccagaaacgttcaattttgggaacagaattcatttcttttaatttttcatcatcaagaatcccgttctgatacagggatacaatgattcccgaaataagttcttccgcctcctcaagctttttattttccctggtatatatctctatcagaattccataaatactttccattccgttgaatgaaaatcctccaagaatttcacgtcttccagttagtattttctccatttttataggattaaaacctcttttaacggttgcaatcatattcataattttcagcacttcagattcatggcttgtgtttccttttgtacggaaatactccagcacttcgttgagaaatacatcaaaacgggcatcaaaatcaaatgatttcgacagataaagcgtctgaacttcattgaaatgctccagcagttctttgattttctgtaccgtaaagtgaataagttcctgcattactcaaaagttatctgttctatttcattaccgtctttatctttataggagacaatcctgattccttcttcttccatttccacatggagattgataaacagtttatctttatcttccgcagcgcttgtattgggatctatgtaaatattgttcagctttgcgttcaccaatgtatatttattcagcaacacttttgaaaaaatttctttcagctcatcagtttcttctgctgttccttcctgaggcctgaagattccggaattaagaagctggatttttttcctgagatccagcttaagaacttctgcagaagggagcttaccgaatttctgatcatttttttccagtgtgttgaacagcgttttgaattcctcggtctggagctgtcttttactgatttcaggaatattcaggtttttctctttgtttgcgagacggattctctcatttatttcggtaacgaactgatcctggttcagcttaaaattatatttggaatctgaatcgatatccgttattttgatgggaatatccatctttacactgggcagtgcatatctcgggaccttaaaatacttaagatattcatgacgggcatattctttggcaataagaacagcattctcgtcagcttttttacgagcctgaattatctcattgttgagataatccaggtaatctgataattttatcatttttcgtaaaatgttttattgtgaaagaagtccaagtactttttcaagtcctgcaggcatttcatcattggttgcgcgtacttttaccccaagagaatattctttttccactttgattcctgtgctggaagttcttttgtaggagacatccactttgaatttcacaggaccccagccaccggatactcctgcattgataccgaactcgtcacttatatctttggtgtatgtcgaattaagtttcacattaaagtctacttcacaggtttcaattctgaagctcggaacattcagcaatgcaataaacggcactgaaatttccacatcattaggaatcgttttagggttggtatcacttactggctcatcttctttaaaatccggattgggaatattttttttgtatttgaactctgccattctcagttttttagcactggctgcattggcaggatctgtaagctcaaaaccgacttcattgatgaaattaacggtagctatagaagcgttggactgcgcttttacacaggcatccaaaggtccgccaataatggtagcgaagtcaatacttcccagttctgcagcaaaatctgcgctggcagcatctgaagttctgaagatctcgtcatcggcagccattttaccggcaataagcttcataatttctgaagaggcaccggaaaaagatttttcccacttttcatcataattctttttgaattcgtctacaatcgctaacaattccttattggttaatgaactcaattctgaagtttcaattcctgacactttttcatagaccgcaggggtcagtactttttctactcctgacaagagatcaattaactcattttttgtttttttagcgtggcttgcttcaagcactgattttaatgtttccatgttttttgtttttgattaatattgtgggacaaaattatatcactgatagacaaaacatttcaggagaacacctctacttgttcaggaaaaacaccctaaaaaataaaagcctgaacttacgatggtaagttcaggcttttgtgatgcattttgcagatatttattttatagacgcaaagattatattaactattattattaagtaagctaagaaagcaacaagttgctgatgaagctgcatgaatatgctcatgcttagaaaaaatcaattccattgattccatctttgcccccttaaaaatcaaacagcggataccagatctttgcgttaaatttaaaggtaattatatacaattttacattaatctgctatcttacttattattatgacactaccattctgaatgtaacgcagtgaaatgaagaatccaggttttacatgagattcttccttcgtcagaatgacaatggcgtaaaattgtatatagtcgccaatttaaatagattcaaacgtttctatgccggctttttactgttgttttccagattgacatcaggaactacggaatccggatcaagctttacctcatctatttcctttttagaatccactttgaatgtccattccgtatttcttttccaaacttcaacaggaattttcacgatctgagctgttccgtctttgaatctgatctgtactgttgtaggcattggcagctggccaatattttcaaccgtaatctgaactccatttttaaagtctccgttaacatattgtacatttttaaccgactgatcaattttccatttgttaaagaaccatcctctccagaaccagttcaattcctctccggaaacattttccatcgtgtggaagaaatcccatggtgttggatgtttaaaagcccagcggtctatataggttctaaatgctttgtcaaacttttcaggtcccagaatggcttctcttaaaacctctaatcctgttcccggtttaaaatatgccaaggctccgatgcttctttctttcatattatccggtcctaccattacaggttccagattgtcattcagaaggtaaactcctgatcttgccagatttggtttacgataatattctcctttattgaaggcttcggtggaaagtccgttgataaaagtgttaaacccttcatccatccatgcaaacaatctttcattagatcctacgatcatagggaaccagttgtgtccgaactcatgatccgtaaccccccaaagatcttcccctttggaatccatatgacagaaaacaattcccgggtattccattccaccttcgtttcctgctacattggtggctgcaggataagtatattcataccatttttttgagtaatgttctatagctgcctttgtatattctgtagatcttccccatgctttatcaccggcactttctacaggataagctgaaatagccaaagatttcttgccacttggcaaattgatttttgcagcatctaaaatgaatcctgcagatgaagcccatgcaaaatctctggtctgattaattttaaatttccaggtctttgtgccggatgctttatttttaccgatttcagactcgggacggatcattaccgttttatcactgtttctggcctcattccatctgctgatttcttctttgctatacacctctttttcattcagaagttctccggatgctacgacataatgattagccggaacggtaatattggctgtgatatttccatattccagataaaactccgaagctccaaggtacggaagcgtattccagcccatcacatcatcatacacgcacattctcggataccattgtgcgatggtaaaaattttaccatttttagtctcctgaactcccatcctgtccgaaccgtaatccggagaaacaaaagagtattcaatttctattttggcaactcctccattagctttcagttctttcggaagattaatctgcattcttgtatcagtaatggtatattttatttctttaccatcaagcctgactgatttaatcgtatatccaccattaaattcttctccatgagcaccatttctgcttcctgaaagcggaactacgccatttcctctggaatcttttgcaaacaggttctgatccagctgcagccagagaaaacctaatttatcaggactgttgttggtataggtaatctgcgctgtgccggtaatctcttttttgtcttcattaaggcttacatttaaatggtaatctgctgaattctgccagtaagcatgtcccggctgcccgcttgcggaacgggttgccgtacccgtctgcgggtagaagaatggcttaaatgcttctacgtaatcgtatttcggagtctgctgtgcataggcagatcctgtgaacagtactactgcaagcgtcgaaacaagggttggaagtttaaaattcattttgaaaaagtattatttactgtataggtaaaaaaaaatcccggatttgttacatatccgggaacttttttaatataagtttaatttaatttgacttttttgctttaatcatggcttccaaagcatcccacatttcacgaggaattgcttcaagcatattgaattctccggcaccctgaagccattcgcctccatcaatggttaccacttcaccattcatataggctgaataatcagaaaccagataagcggcaagattggccagctcctgatgttctcctactcttctcaacggaactttctttttcatatcaaatttctcctgaaggtctcccggaagaagtctgtcccaggctccttttgttgggaaaggtcccggagcaatggcattgaaacggattccgtattttgcccattctacagccagtgatctggtcatcgccagaactcctgcctttgcacaggctgatggcactacataggcagaacctgtccatgcatatgttgttacaatgtttagtacagttcccggagttttagaatctatccagtgttttcctacagaaagtgtacagtttttcgttccttttaaaacaatatcaaggatagagtcaaaagcagagtgagtgagtttttctgttggagagatgaagtttccggcagcattgttcaacaaaatatcaatcttcccgaattctttcaatgtagcctctttcatggcttccacctcatcccagtttctcacatcacaagctacacaaagaactttacctcctgtttcgtcttccagttccttagctgtagcctgcagcttttccaggtttctggaggtaatcactactttggcacccaattcaagaaagtatttggtcatcgcttttccaagaccgcttccgcctcctgttacaattgctactttatctttcagtgcaccttcgcgcagcataggttgtgtatatagactcataaaatattttttcttaaaaataataaatattgaaatgcaatcccttaaaacaggttgataaataatgctacaaataattattctttacattattcatcaaatcatcactctgttttaaaaaaaatagcctgataatttctaccagactattttttattttctaaaacaatatattaagatgctgtaaccactcctttgaacgaaagtgttttaggagttttactgtcactggttgtaacgtttacagtcttcataaacggacctgccgctgctgcgttgtaacttgcttctacaaatcctttttttcccggctggataggtgtttttgtatagtctgctgtagtacatccgcatgaaggggctacgttttgtataatgatcggctttgaacttgtgttggtgaattcaaatctgatgagtttcggttttccctgaggaatatttcccacatcaatagattctgatttccatttaatagcatcagctaccatttttacaatggaaggtgcatctgtagatagtacatttgcataaaacggagagaatgccaaaactgctaaaagagctgtaatttttaattttttcatgagtatatattttaatatttgaaactgattgttttctttcggtatcacaaatgtaaaacagaccgtaattacaacttgttaaccgctgtctaacatttgttaatgagttgttaatgataaaaaataaatagatatttttggataatattgtttcaggaaatgaaaataaaaagactcaatattattataacgctgggatttgttgctattatcggaattttaatagcacagctgatgtggacgatacaggcttataatcttgaagataaaaaatttaaccagaaggtcaacatcgccttaatggaggttgcagaaaagctctctggcggaaagacatcctatacagaaaatcctgtgcagaatattgcgaatgattattatgtagttaatattaataatgaatttcatcccgtagttctggaatattatctaaagacagaatttacccgcttccagatcaatacagattatgtatatgcattgtacaactgtcacagtgataaaatggtgtacggaaaatatatgacatcccatcaggaaaaaccgggcaacaaagtgatcaatttcccgaagcataaaaacctgatctattacttttccatacggtttcctgataaaacgacttatctgatcagctccttaagattctggtaccttcttacatttgctcttattatcattcttctggtatatgtatattctatctataccattattcagcaaaagaagttttcagaattgcagcgtgattttatcaacaatatgactcacgaatttaaaacgcctctatcctccatacttttagcgtcagaagcacttaataaacaggatcaggtacaggataattcaaaactgcagacctacacctccattattatcgaccaaagtcataaacttaataatcacattgaaaaaatattgaatattgctaaaaacgatgccggaggattatcgttaaaacctcagaaaattctattacttccttttattcaggaaattgcagacaatattcagcataagaataaagacctcaatatcgagattgatattgaaaacagcacttcggtaatggctgatgaatttcacttcaccaatattatttacaatcttttggataactctgtcaaatattgtgaaacaaaacctgttattaaaatttcagcttataaagattcaaaaggattatatttaaagtttaaagacaacggaatgggaattcctgctaaaaatattcctcatatttttgataaattttatcgggtacataccaaaaggagtgaagaggttactggttttggactaggattattttatgtaaaaaaaattgtgcagcagcaccactggaaagtttttgtggagaataatgaagataaaggaataaccactacgcttttctttccgttttcaaataatcatgtgtaagtatggagaaatctaaaattttatatgcagaagatgataaaacaatagcattcctggttgaggacagcctggaaagttattatgacatcagctgttattctgacggtgaatctgcattggaagcatttaacagtcagaattttgacatctgcctgctggatattatgatgcccggtatgaacggatttgaggtagcacaacagatacgcagcaaaaatgctgaaatacccattatttttatttctgcaaaggcattaaaagaagacagaatcaaaggacttaaaattggtgctgatgattatctggtaaaacctttcagcattgaagagctgatgctgaaaattgaagtctttctcaaacgtacaaaaaaaacagatatagcacctgcgaaatataaagtcggaaaatatgtttttgatcctaaaaattatactcttcaaggtgtggaaaataatattacccttacccaaagagagtctgatcttcttttatattttatccgccataaaaacctggtcgtcaaaagacaggatatcctgaaggcaatctggggtgatgacgattattttatgggaagaagcctcgatgtatttatttcccgattgcggaaggtattggcggaagaacaggatgtattgattgaaaaccttcacggaataggcttccgtttttccgagaaaaagtaataataactcaattcaaataaaataaagaacagcaaatgctgattttaattaattttaaactttgaaaattgatcattaatgaaaaatcataaatattctgtttttttattccttttatttttaagtgtacattttaaggctcagaaattcgagaaattaatccggtatgtcaaccctctgatcggaaccgaaaaaatggggcatacctatccgggagctactgttccttttggtgctgtacagctaagtcctgaaacagacactatctcgtacgagcttaacggaaaatataatggtgaggtttataaatactgtgcaggttaccgttatgaagacaaaaccattgtaggcttcagctctactcatttcagcggtacaggacattctgatctcggagattttctggtaatgcctacggtaggaaaactccagctgaatccgggaactgcttcccatcctgaaaatggttacagaagcagattttcgcatcagaacgaaactgcagaagccggatactacaaagtaaaactggatgatcacaatattcttgcagagctgacagcgacaccaagagtgggaattcaccgctatactttcccaaaatctgaccaggctcacattattctggatctgatggccggaatttataattatgacggaaaaaatgtatggacctacgttcgtgtagaaaatggaaataccatcacaggttacaggcagaccaatggctgggcaagaaccagaacagtttatttcgccatgaaatcttcaaaaccttttaaatcttacggtcagcagaactatgatgaaaaacaggtttacaaaggattctggagaaaattcgaccagaataagaacttccccgaaattgcaggtaagaacctgaaaatgtattttgattttgacaccaatgaaaatgaagcgatcgaaataaaactcgctatttcaccggtaagccagtccaatgcattagaaaacctggaaaaagaagcgggaaatatgacgttcgatcaggctaaagctcaagcccaggaaaattggaataaagaattaaataaaattgtcatcaaaggttctgatacagaaaagacaaatttttatacagccatgtatcatacttttattaatcctacgacttatatggacgtcaatggtgaatataaaggactggatcagaatgttcataaagcagatggctttaccaactatacaaccttttctctgtgggatacataccgtacacttcatcctttctttaatattatccagcctaaaagaaatggcgatatggtaaaatccatgatggctcattataatcaattttcaatgaaaatgctgccaatctggtcacattatgcgaacgataactggtgtatgagcggctaccacagtgtaagtgtagtggctgacgctattattaaaggaaattatgacggtgatcctgaagaagccttaaaagcctgcatagaaacagctaacaaaagaaattatgagggtatcgggcagtatattgatctcggatatattccggccgagaaaaacggaacttctgtttccaatacattagaatatgcctatgatgactgggcaattgctcagttggcaaagcatttaaacaaaacagaaatctacaatcagtttatcaaacggtctgaaaactggaaaaataattttgacaaaaccatcggctttatgcgcccacgtctgacagacggaagttttaagaaagattttgatgtcttaagtacccatgggcaaggctttattgaaggaaattcctggaactacagtttctttgttccgcaaaatccggatgagcttattacgatgatgggcggaaagaaaaaatttgcgtccaaactggatgaactgtttaccatgcatttacctgatgaattctttgcagatactgaagatattacccgtgaaggaattattggtggatatgttcatggaaatgaaccggcccaccatgttgcgtatttttataactgggccggacagccatggaaagcacaggcacagatccgccgtattctggaaatgcagtacaaagcaacaccggatggcctgggcggaaatgatgatgccggacaaatgagcgcctggtatattttaagttcattaggcttttaccccgttgctccgggatcagagaactattctatcggaagccctgccattgatcatgctgtactgaatctggaaaacggaaaaacttttgaaattgaagccatcaatcaaagtccggaaaatgtgtatgttcagaaagttcttctgaatggaaaagagattaaaaactttatattaaaacattctgagattatgaatggtgggaaacttacgttttatatgggaggtaaggcaaaaaagtaaaaaggcgaaaaagcaaaagaaaagttctctacggcggaactgtcaatcagtgagattgcttatgagccgggatttgaacattcacagtcttttaattaaaataagttttggctaaagccaatggaaaggttaaatataaagtgagcgggctaaagcccgctcctattaatcattatagtttctattttgtatgaagagagtttttacgattttaccatttcgcttttttacctttttacactattaatccctcgcttcaaaaagcagcctctctccgaatttatcttctgcaattttaccattatcatacaccagatgtccattgacaaaagtatgagtaactttcgaatggaaatttgttccttctaatgggctccagccacatttgtacagtaaattgtctttagaaactgtccagtcctgatttaaatctaccaaaacaagatctgctttataaccttcccttacaaaacctcttttttcaattttaaaaagaatcgcaggattatgagccatcttttcaacaattttctcaagggatattttaccgttcttatagttttcaagcattacaatcagtgaatgctgtaccaaaggtgcccctgatggacatttggtatacacattatttttttcctctgtcgtatgcggagcgtgatctgtagcaatcacgtctattctgtcatccagtaatgcttcccaaagtgcatctttatctttttgagtttttacagccggattccatttgataagtcctccttttgtttcgtaatcctcgttggtaaaagtcaggtggtgcacacatacctcagcagtgatctttttatcttgtaaaggaatatcatttcggaaaagttccatttcttttgctgtcgaaagatgaaaaacgtgaagtctcgcccctgttttttttgcaagttcaatagctttggatgaagatttatagcatgcttcttcacttctgatcaggtgatggaattttacaggaatatcatccccatattcatccatatatttctgagtattggctctgatggtagcttcatcttcacagtgaacagcaatcagcattttggtattgctgaaaatattttccagcgtttccggattatcaacgagcatatttcctgtagatgaacctaaaaataacttgattcccggaacatttctggggtttgttttcaaaacttcctccagattatcatttgttccccccatcataaaaccatagttggcatacgctttttgaaaagcaatctcatatttgtctgctaataactcctgagtaacagcattgggaacggtattcggctgatcgataaaactcgttaccccacccgcaatggcagcgcgtgattcactttcaatatctcctttatgagtaagtccgggttcacggaaatgtacctgatcatcaataactcctggaagaaggtatttacctgacccatcaatgacctgatctgcttcttcagaaataccaaccgctattttagagattaaatcattttctattaagatatcactttcaaaaatttttccctcgttaacgatatttacgttttttataagaactttcatttcaatttatttccctgtaaaattaagattttaagttttaattcactccaaaatcgcaaaacgaatgcttaaagttttacatttgcaaaaaaatttcgactttgtataagaaactattaggacagacaatcatctacggagtgggagcaatagcgccaaggattatcctattcatccttaatccacttttgatctataagattcccaatgaaggttttgcgattttcacacagctatatgcatggatctcgtttgttaacattatcctttcttttggttttgaaacagcgtatttcaggttttcagcggaagaggataacgaaaaaaagactttcaatacctcgttctggtttttattttcaacttccactatttttctggcattgtgttatttattcaaccagcccattgcagattatgcaggataccatgacaatcccgaatacatcagatggtttgcactgattgccttttttgacaatttactggttatcccttttgcatggctgcgttttcataataaacctatcaaatactctgcagtaagaattgttcagtctacatttcaggccgtttttaccgccgcattatttttctggatcccggaaaatatatcaaaaagtatgggactggatcaaaatgtagattatcctttcttcagtaatctcgcaggaagtgcacttggttttttattattgttccctattatattaaaggtaaggttccagtttgtgacttctctattcgggcgcatgatcaaatactccttccctcttatgctggcaggtcttgccttcatggtgaatgaaaactttgacaaatctattcagaggaatcatatttcagatgaagaagccggggcttacggaggctgctataaactggccgtactgatgacattatttgttaccgcctacagaatgggtattgaacctttcttttttaagcaaatggataaaggtgatgctaaaaagacttatgccaacgtagctgaatactttgccttttttgcatgtgccgttgctttagggattattgccaatatatcctggctgaaagccgtttttattcctaataaatcctactggattgctatagacatcatcccgattatcgttattgccaacctttgcttcggaatatactataacttttcaacctggtataaagtaacggacagaaccagtatgggaacggttatttcatggcttggagcaggaattaatattgcactcaatctggtagcgctaaattactatcacagcatgattggctctgcatgggcaacctttggagcgtatgttattatgatgattgtttcttatctgctgggacagaagtactatcctattccttacagaatgaagaaaatgtctttctttctgatactgcttggaatttttagctttatcattgtaaagtatctcaactataatgttctgacaagtaatctgctgtttctgatcttcaccggaattttgatttattctgagaaaaacctgattttatcaagaatcagaaagaattaaactttggtctttattttgcttgtaaacaaacctattgttaatttaaacaaatatttaaaaagatataaattataccacatcaaatgttttaattattatctttagccttaatataaataacaactaataaaacatcttttatacatataatttatgaaaattattgtccctatggctggacgtggttccagattacgtccacataccctgacagttccaaaaccccttattcctattgcaggaaaacctatcgtacagagattggtggaagatattgctaaagttgcaggagaaaatattgaagaggtagcttttatcatcggagattttggtcctgagatcgaaagatcccttattcagattgctgaaaagctgggagcaaagggtagtatttattatcagaacgatcctctgggaaccgctcacgccattaaatgtgctgagcagtctatgcagggagatgtcgttattgcttttgcagatactcttttccgtgcagattttcagctggacaaaaattctgacggtgtaatatgggtgaaaagtgttgaagatccatctgctttcggagtggtaaaactggataattacggtttcattaccgactttgttgaaaaacctcagacttttgtttcagatcttgccatcatcggtatctattatttcaacagtgcagaaaaactgatggatgagatcaattatatcatggataatgatattaaaaacggtggtgaatatcaattaaccacagcacttgagaaccttagatccaaaggcgctaagtttactctaggaaaagtaaacgactggatggattgcggtaacaaaaatgctacggtagagaccaacagcaaaatccttgaatatgaaagagaagcaatgactcattatcctgcttctgctgtgattgaaaattctttgatcattcagccttgctttattggagaaaatgtaaaaatttccaattcaaaagtgggacctggcgtttctttaggaaacaacaccactgttgtgaattctaatatcgaaaactcgctgattcaggaaaatacaagaatcaatcatggaaacctgtccaactctatgatcggtaactcggcacagtatttcggagttgccagagaaatttcattaggtgattattccgttttagattttttatctaaataggaaagaaaatatttaacttaaacaatctatgatcaggccacacaaaacattttgtgtggtttggcgttaatattgcaacgtatttttaattaaagataaatacatgaaaaactggatcccttttcttttgttacttctagccttatcatcctgtaagacccgtaatgctgctcaaaatgatgcagatcatacacaggacagtattaacgctacaaaagataaagattatggaaatccaaaggatgccaatgaaccagtgagagacaagctcactttttatgaacatgtactgatcccgccaaaatttgaacaaattaaaatagacagtaaagtaagagtagaaacaggaagctatgttcctacgctggatgcaaccatctatattgaaaatgataaaaaggtgtggatgaatctcagagctttgttcatcaatgctgcaagaggtattgcaactccagaggggataaaaggacaggataaaatcaataaaacctatatagattcggattttgattatcttaataatttactgaatgttaacttcattgattacaaatcactggaaaaaattttactgggaagaacttttgtaaaaatcaatgacagacagtttgaccttacccaaaatgcacagggttttaaaatgatttccaataccaatcagaaaattgtaacggatgaaaaaaacagagagtataaagtagctctccaatatgataccaactatgatttactcaatgtcaacttaaaagatattctctcttcagatgagctggatgtttcttacagtgactggaatgaatacgcaggaatccgccttccgaaaaatgttaaaataattataaaaggctcaaaatctagtcagattttactggaaaatacgaaatttgacttttcgaggatggaaacaccttattctgtaccatccagttataagaaaattgagattaaatgattaaaaaatttagctttttaataggtgttttgatgtttggactgcaccatggacagcagaacaaagaacaactgcagaagcagaatgccgaacttaaaaaacaaattgcccagataaataacgatttagccaaaaccagaagtgaatctaaactttccatcgcctatctttccagtgttaatcaaaaactggttttaagagaaaaggtttataataatacccagaaagaaaaaagattcattgaggacgacatttatttacgtcagctggaaatcaaccgtcagaataaagagctggctgttttaagaaaaaactacgctgaggttttagtgaatgcttacaaaaacaaaggagtacagaataaagtaacgtttatcctttctgctaaaaatctgggagaagctatacgaagagtacagtatctgaaacagtattcagattatcaggataaaaaagctgctgaaattaccaatgcagctaatcttatcaaaaaaacaattgcacaaaaacaaaattctgtaaaagcaaaagagacccttttgatcaaccagcagaaagatctggcaaccattaatgctgaaagagctcaaaaagaacagttagtcgcagaattcaagaaaaatgaatccaaactgactgcagaacttaagcaaaaacaggttcagtctaaagcattagaaggacagatcagggctattattgctgaagagatcagaatcgcaaaggctgaagaagaagccagaaagaaagcagaagcagaaaaaatacgtttggcaaaattagctgccgaaagagagaaagcaagaattgaagcagaggctaaagcaagagcagaagccctggaaagagaaagaagacttgcagaagcagaagccaaaagagctgcagatcttgccgcaaaaagagcagaagaagaaagaaaacgtaatgaagaggccgcgaaagcagaagctaatgcaagagatgaagcaagaagagtagctgctaaaaaagcttcggatgaagctaatgcaaaagccaaagaagctgcagataaactggcagcagcaagagcagcagaagcagcacttaccaagagaaaagaagatgagaaaaaggcagctgaaacaaaagctatgacaagctacggagtttctactgcaacgggaagcagttttgcagacaacagagggagacttggttatcctgcagacagagccggacaaatcacccaccgtttcggaagacagccgcacccggttttcaaaaatatcactgaagaaaataacgggattaaaatttccgtcccatcaggtacacgtgcaaaatcagtgttcccgggatcagtatcttcggtactggcaaacaatgacggaacaaaaactgtcattatcaaacacggaagctattttaccatttactccaacttaggaaatgtaagtgtttccaaaggacagcaggtttcctcaggaactcctgtaggaacaatagctcaggattttgatggcgcctatacccttgatttccaagtatggaacggaagtacaccagttgatccgttaggttggatttcatattaaaaaaagtgtacctttgtagaaattttaagagatgaatacattaacaatacttgccttatcttggcagcatatccttatcgttgcaatcattttggtattgcttttcggaggaaagaaaattccggaattaatgagaggagtaggttcaggaatcaaggaatttaaagatgcagtaaaagaagaagacaaaccaggttctgagaataaatcggcttccaacaataacaattcttcaagcaactaaaattccttagaattaatgaaatttactgagactgcatggaaagtcttcaatcaagctattgaagactatcacgtgtctgatgacgttaacactctaattaataacccgttcgaaaaagatagtttggaacggattttgtatgcaaagaactggattgataccgttcaatggcatttggaagatataattagagatgaaaatattgatccggctgaagctcttcaactcaagagaacgatagatgcctccaatcagaaaagaactgatctggtagaatatattgatggctggttccttaataagtttgaaaatataactcctaaaccggaagcaaaaataaatacggaaactcccgcttgggcagtagacagactctccattcttgcactaaaggtttatcatatgtcgttagaagctaacagagaatctgcttctgaagaacacagaaacaactgccaggctaaactggatgttctgcttactcagaaagaggatttatcaacttctatagatcagttgcttgctgatattgaaaacggtaacgttaagatgaaagtgtacaaacaaatgaaaatgtacaacgatgaaagtcttaacccaatcctttatcaaaaagggcaacaaaaatgaaacgactatttttctttggagtacttatcatattaacatcttcctgtgcaacggaaaaacttaatctttctccgttgtcaagtaatttttatagcgatgccaaaggttctgattccgacagaggctcaaagaagaatttcaatatcaatataaaacagaatgtaaatgcttctgaaatttcaaatatgatctccacttttcccaagtttaaaaacaacggattaaatgatgagattaccagcatgaaatacagtcttcagaattatttatatgctattgatgccagcaattctgcaggaaagagcagagccctgaagagcttcgaaaaatcatacaaaaaaatacagaagctaaggcagaatcttgacagagatgaagatgaagttcttaacagatatcttgttcgtttaaaaacaaatgtttctgttattgaagatactttgccaggaagttaaaaactaattgaactatcaatgattaaaattcaggcggaagccaatgttcctacagagcacggtactttccgaatgatagctttctccgaaaacgaaaatgactggatgcctcatatggccattattgcggaaaacacagatttctcaaagcctgtcaatgttcgttttcactcagaatgtattaccggagaagttttccattcaaaaaaatgtgaatgcggccagcaactggatgctgcaatgaaatatatccatgaaaacggtggaattatcatctaccttcgtcaggaaggaagaaacatcgggatcatcaacaagctgaaagcttactcactacaggaaaaaggattggataccgtacaggccaatcttcagcttggtcttcctgcagacgacagaaactttggagtagccattgaaattcttaatctgctggatgtaaaagatatcaatcttttgaccaataatcctgaaaaggtaaagtatgtggttgacagcaatattcacctcaattcaagagtaccgctacagattcctgccaatgaaataagcaaaggatatctgcagacaaaaaaagatttctttggacatcttctggatgacaatgataactaattttataaactaaatattaaaaagctccaaaaaatatattttttggagctttttaattactgaaattaataggacattccatttctataacaatttcaccaattagtgtattttttataaagttttatttttgcgatgaaattataattttatgaaaaaaacactattcgttatttcttcattatttttcattggctgtgcaagtagtaatgacatgctttatacccaagatgaagaacaaaatttaaacttaaaagaagctttaccatctgtatcaaataaaatgttagccttaaatggaggtgaaattcctttaatggatttggatttaaataaacctcttggtcaaccagatggtggaggatgttcattcaaaaccggacatagtgttgacaatatttatacgtcaaccgctgcatttggccccaatccactatctttttttggttatacatttagaggatatggaaaaccaagaaccgatggatttaattggaaaggtataagatttcaagcaggaaatcgtcctgcaactgtcttaagtagcagaggacaaagccgattagttaatgatctttttgaaaatgccttatctatagaatttccttttgaatcaaatgcaacttacgaaatcatattagatacaattattgaagactttatatacacagagcaacatgatcaatatgaccaaaacgatgactaccatggtttacaacaaagtcaagcattccctacattagcagtggaattggcaaacacacctgaaatttatggcagcgctccttgcgcaggaaggccagtattaaacaacagattcatttcagaaaattactataaaacacaaaaagtagaaataacagttccaccatcatatgagaaaaaaacatttgtatttaatttctctactacggagtcaaaggctgcatttcttatttactacctacccgaaagaggatcagacccttatatccctgaaagctcttttaaaatgaatctaacaggtataaaaataataaaaaaagcatttgatccaacctatattgtccccccaaaagttacgactccagaccctagtcttccctgtggttttagaggaggatgttaatcacaatacaatctaataaaaaatcaaaagccccggaaaatatttctcccgggactttttttaattataaaaaactgaaaagatatttctaaattacttagtcttgattttagactcgtcaatattgtaatatttgattacactattgtagtctgaataatcaactgcagcagcagctgcactcttagatgtacctgtttttgcaggaacaattactactctgaattttttgtttgtataatataccgggttattatccaagttaactccaatagtagatcttacatcaattccgatatcaaacttactgaagtcatatgaatattcaactttatcagcaccgttattaggatattctgtataagtaagcaatttccagattggagaattattattggtaagacctgtctgtaaataaatcagaactacatcagattcaagtaaaggacttttaaatgcgtcatcaaaatgataagtatagctatcctgtttattaaatttcgggataatatcataagctgttgaatatgtatcattatcctgaccttgtactaccacatcatcactattatcacagctataagctgtaaaacctacagcgcccaggaataagaagagaagtatttttttcatttctattaaagtttagttattatttatattgcgtattcaaatcatataccaaaaatttcaaaaactttgttttcatcatttttttaattgtatttttgttcttattcaaaaagtcatgaagaaattaatatatacttcactctttattgttgcattgataagccctaaagttaaggcgcagtaccagcctaaaaatgcatccaaagaagatttgaaaaaggctcagcaatgggttgataaaacttacaaaaatctttctcaggatgaaaaactaggacagctttttattgttgcactgtataccaataaaggagaagactatatcagccaggtaagaaatattgttacaaatgataaaataggcggtctgattttaatgcaggatgatgctgcaagggaaatcaatctggtgaatgaatttcagcaaaaatctaaagttcctctcatgatcggtatggatgcagaatggggattgtatcagagaattgcaacagctcacaaatttccatgggcaatgacgttaggtgccatccaggataaaaaccttgtctatcagatggcagcaaaaattgctgaagattgtcacaggatgggaatcaactgggattttgctcctgtagtagatgtcaataccaaccctgataacccgattatcggtaacagaagtttcggatctgaagtgagcaatgtaatcagctctgccctatcctactctaacggtcttcaggataacaatatattagccgctatcaaacatttcccgggtcatggggataccagcacagattctcatcttgatcttcctgtagtttcccataatattgacagacttaatacagtagagttggcaccattcaaagctctgatggataaaggaattggcggtgtgatggttgctcatttatacgttccgaatttagaatcaggaaaagggattcccgcttctgtttccaagaatatcattaccggtttacttaaagacaaactgggcttcaaaggcttaatcattacagatgcattaaatatgggtgctgtagccaacaaatataaaccaggtgaactggatgctatggcctttaaagcaggaaatgatattatgcttttctcacagggagtttctgaaggcaaaaaactaattcagaaagctatagataagggtgagatccctcaatccagagtagaggaaagtgtgaaaaagatcttactgaccaagtatttccttggtctgactcaatatacccctaaaaatcctgaaaacatcaatgcagatcttaataataattctcataccgaattggtacagaatctttattccaatgccttgactttattaaaggatgaaaagaaactgcttcctcttaccggaaagcaaatatattatgttcctctggaggaagcgccttaccagacttttgccaacaggttaggaaataatgtgatcataaaaaaagccggagaaattactactattccggcaggttcaacagtaatcgtaggtttccataaagataattcaacggcttataagccttataaaatttcttcagaatctaaaaaaatactttctgatcttactcagaatcaaaatgtaattctgaatgttttcggaagcgcttatgcactgaaagatattgatatttccaaagtttcaacagttcttgtctcttatgaaaacaatgacgattctatgaatgccactgctgatgctttaaatgggaaaacaaaaatatggggaaaacttccggtactggttaatgaccaattaaaaccgggaatgggcatagagcttaatgcagtaatctctgcaaacaccaaacaatacaatatcaaacaacaataatctaatgaaaataggcatactttgctatccgacatacggaggaagcggaattgtagcaacagaattaggaatgtcccttgccaataaaggatatgaagtacatttcatcagttctgcacttcctgcaagattagacatcaccaacccgaatattttctttcacagggtaaatgttcagacttatccgcttttccagtatcagccttatgatattgcactgagttcgatgatctacagggttgtcaatctttataaactggatcttctgcacgcacattatgctattccttacgcatatgcagcatttaccgcaaaacaaatgcttaaggaagacaataatgatgttcctttggtaacgaccttacatggtacggatattacccttgtaggccaacatccaagttataaacatgctgtagaattttcgatcaatcagtctgatgcgattacttctgtttctgaaagcctgaaaaaagatacccttcagtttttcaatatcaaaaaagaaattcaggtgattaccaattttatcgacaattctgaatttgatgactgcactgaatgccagagaacacagtttgccaatcctgatgaaaaaatcctgattcatgtatctaaccttcgtcctgtaaagcgtgtggatgaagtacttcagatctttaaaaatgtggagaaaaaggtaaaatccaaactgatcattattggtgaaggtcctgatatggaaaaggtcaatcagttcctggaagaaaacccggatcttatttccaaaatccgtcttttaggaaaagtaaatgatctttataaaatcttacagctttcagacgtatttttacttccttccgagcaggaaagctttggtcttgcagcgttggaagccatggcagcttatactccggtcatcagctctaacgctggaggaattcctgaggtaaacattcagggagaaacgggatatcttgctgaaatcggaaatgtggaagcgatgagtaattacactatcaaactgttgagcaatgatgaacttttagccaaaatgaagcaaaatgcgaaagatcaggcaataaaattcgatttgaaaaacattcttcctatctatgagaaaatgtatagaacaaccatagaaaattttaataaggagctgacgaaagtataatatttctattatatttacgtcacacttatgacggaaaaactacttcaatatctttggaactataaggttttcaaaaattttgacttcaaggatattgaaggaaattccgttgagatcatccattccggtaaatggaataaaaatgccggccctgattttcttgataccaaaatcaggatcaacggattacttctcgcaggaaatacagaactgcatgtccgttcctcagactggatttttcacaatcattcacaggatcccaattatcagaatatcattcttcatgttgtctttcagcacgacatggaaattcatgaacataccggaaagcatattcccactttggaacttaaaaattatattgatgaaaatatcctttggaagtatgaaaagcttatcaacggagacgaatttgttccctgtgaaaaaatctttgatccgaaaaaaatcccggtcaactttcatgaagagaatattctgcaaaagctggatgagaaatcctctgagcttgagcaaagcttagatcaatacaaaaataattttgaggctgttttattccacagctttgcctattcatttgggttaaaagtaaacgcccatattttccggcagatggcagaaagcatcgattacagcattattaataaaatccgtcagaacccgcttcagcttgaagccctgttatttggaatttccgggtggcttgatgatcctcaagatggtcagatgaaaatatggaaaagagaatttaatttcattaaagctaaattttctattcctgatttaaaattccatccgaaatttttaagattaagacctcccaatttccctacaatccgattatcacaattagcagacctgtataaacatcagaatttattttcaaagattatggaagctaagaatgcagatcagctatatgctgttttcaaatctgtaaaagcttcagaatactgggactttcatttcaatttcggaagtatttccaaagtgcagcctaaaacattgagtaaagattttattgatcttcttattctgaacactgtacttcctttaaagtatacttatcataaatatcatcatgaggaaactgcagatgaaatcattgaattgtacagaactatttctgccgagaaaaacactatcattacaggttggagaaagcttggattaaatgtgaccaatgccttggagagtcaaagtctgatttaccatcacaagacctgttgtgaatttaaaaactgtctggcctgcagtatcggatttaaacttttaaaagaataatcttatctggacagttttgtcatcaaaaatctttgtcaaaaaaatttcttaccttgcagtattggattaaacttttaaatacaatctgaaaatgctgagtaatatccgtcataaaatggaaagagaatggtttggtgtactgacaagaatgggtgccaagttgggaattcctgtttctaaactgagagttttcttcatctactctacttttgctaccgccggttttttctttctgatttatctgggattggcatttaccctttggattaaagacattttcatcaccagaaggcctagtgtctttgatttataaattatggaatttttaccgattacttccgctgaagacccaagagttcaggaaatctatgcttcttatacagccacttttcctgtagatgaacaaagagataaggatcagtttatgggcttgttttcaaatccatatgtaaaattcatgtctgtaattcatgaatcggaagctattggatacctcatcctttgggaattgagttcttttgcttttgtggaacattttgaagtatttgaagcattcagaagtaaaaagctgggttctcatattatgaatcatttatcagaaaattatccgagcattatcctggaaattgaacctgcagaattgagtgaagatgcctcaagacgatattctttttatcagagaaataatttcagtctgatagataccactcatgtgcagcctagttatggtgaaggaaaaaaatctctgaacttatggctgcttgccaactacactcctgaaaatatagaggaagctaaaaatgaaattcataaaattatttatgcttaaaatataaaacgctggaattgtttttccggcgtttttaatatcttgataggcttgttaatttacttcgtactcaagctttattgtaatactggcttctttttctttggacgaagtattgaaagttcctccgtaagaataatcctcgttagagttaggtgctgtaatctggatcactcccatggttgctttcttcagatttcccaggctgcttcctgaattttctgcaattttttcagcacgttcttttgcatccttagttgcgctggcaatcatttcctgttttacagttgccagtttagtatagaaataagcaggagaagaagacgtgaattcaatgccacggttgatgatttcggtaatatttctggataggttttctattttaccaacttccttactttcaatagaaactttttgggtaaggttatagccggagaattctccctgcatataatttccgtttgaatcattatagcttctgaactgtttttgaatatctacggaagaaaatacgatttctttttgctgtatccctttggaaagcagataattattaattacctttctgtctgttgccagttcatcataagcagatttcagatctacattattcttggagaaactcccggaccaggtaatcagatctgaggtaaattgttttgttcctaaacccgttacggaaatggtgttctcggatttattcctgttcttaatggcatttcctaaaaagccgagaccaatgacaaaaccaagtgctgcaatagctacggcaagaatgtttttattcataaaatttgtgaattgagttggttacattatgactgcatcaatttctattccaatattttaagattttattaacatttctatttactttgattctgctttagcctctccatgaagagaggtactgtttcttccagcctcagcattacgccggaaagatttcttgcttttacataggttcgtacctgaggttttgctaaaaatgaaaactgaataaactctgaaatcctgtcaccaggaattcctgctttgataaaatagtcatcacttattctgtcccgtacccaggcaatatgctcctgaagatcatcatatctgtactgtcttttctgtctccttgctttaccgctgatcaggtcatatgcgccctgtacattcaggtttcctaaaagtattggcagaagaacactttttacctcagctggtttttccctcatttttcctaccggctgcggaagacctacagcatctcttacctgttctcctttatctgcttttgctacaatgcgggaatccacttccaggtctcctgtgagttttttaacaatctttacttctcccacatctttcggaatctgataaagagtgataaacaatggtaaattgcttccgttggtaagaacccttcttgaagttctgttgaaatcttcctttacaaatcttaattcatcattaggattggcatcaatagagaatataccttctgtatcagaatatacttttttatcggtagacatgttaataacaattactttactcagattttctccgttatcatccactatccgtcccgtcacggtctgttgggaaaaaataaaaatactgcacagaagcatcaggaaaacaaaaattttccgtcttccaaatacgtcaatattttcagtactataactcaacttttagttttaataagaactattctttacttccttctaatttattcattttactgtattccccgaacgctattttaagctcatattcaataacatcgatactaaaatccttccggtatctttttgccagtgaacgggttttatctgcatagagaagaaatatatcaatctgctcttcatccattccatatttcttcagaaagctcagattcacttcattccttactcttttaagaaaatcctgagtttcattataattcgctttggtgaccttaggcttcgctaatttttttacagcattaaagacaccaaacaggttaacctgccctgcattaaaatcgtgtccggtaaaagttttagatatggcattgcttggtaaaggctgattaagcgggctcttcatatactcttccatatctgatttcaatgcctaaagttttctggattcattcaaatgctgattatctttcgcaagatttccggtaggcctgtattgaattttcacttcgggaatctgaatctccatttttctcagaatgatattgaacggagaactgatatcttctttggtaattttcttatcaacccggtaatatccttcttttacaaatcttatttcatcattttcccttgcttcgatttcaaatgttcctgacatatcgctcaatatgcttttgcctgctgaaatattaacaatgagaacaggagctaagtccatttcatctcatgtgattacctttcctgatactttctgctgtccccacaatactgaattgatacaaaaaagcacaataagaaaagttctgctgatatattttgcttccatttttatctttgagtttgcggagcacgataagatgaaattcttgtcaggacaaaacgctgaaacctgttcaggtctgcatcactgcaaaatccgtatttcagtattttttttctttcaaaaccgcctgcaaaaacataataaataaaatggtctatcagaggcttttctattttaagattggtaaaataatcgtctcccagacttactcttatatatttcattaaatctacgtcgtcccatttatctttaactttcccaatagagaatccctggccttttggctgtacaaattctccaggttttgcagccaggattctgggatctgatttctgagcaatataccgatccatatctttgagtagtttttcaacctttttaggtttattatagagttttgaatcaatcttcaggtttccggtcagtccttgttttacttctacttcaggaatctgaatggtctggcgaacaatatttatatttatcggagattgtgtattttcctgagaaactattttggtgatacgttcataacccgcttttaaaaaacgtaattcatcaccctgccttccggaaatcataaagtgtccgtcccggtttgaaactacaatttcatttgttctgatattaatgacattcacatcctgtatttcagcaccgttttctgaaacaatcttaccaaagatatagctttgggcatgggtatgaataaaaagaatgaaagatagaaaaaagaatagtttgagtttcacgggctattttttataaagcaaagctaaaattatttttaatttataccataagtttaaccacagttaacgcgttttaatatttctttttgatttttgctctgtaaactgttaaataggctgattaaattgttaaagtttcttttaaattttagctaacttgcagtctcaattctctttcaacaatgcaaaattcttatacagtcatcaatgcttctgccggatcagggaaaacgtatgctctggtgcaaagacttctgatgatctgtctccggtatcctaatcagcagcagacgatcaggaatattctcgcactgacttttaccaataaagcagccaacgagatgaaagagagaattttatcgtggttgggcaatttttcagcaaaagattatgcagagaatgtggatctgaaaaatatccagaaagcatttgaagaacagggattgaaaattaccattgatgatcttcaccagcgttccaaaaaattactggattacgttctccacaattattccacattgaatatcggaacaattgaccgctttaattcaaggttagtacgaagcttttcatatgagctgggactggctaagaattttaatcttgaaattgaagcagaaccgtttctgatagaagcggttgataaaatgctggaccagatcggagaaaatgaaaccatctccaattctttcatggattatgtagattacagtcttgaaaataatgaaagaattaatctcaacaaaaatctgtacgattctgcaaaggaatttgtaaaggatattcattacgagcatctgaaaagcaataaaagttttgatgatgccaattatgaaaatataaagaatgcgctccgtaaagagatcatacaaaataaaaagcagtccgcagaactggcagctgcttctattgagttattcaaatcaagaaatatagatattgaagactttgcccagggcaaaaatggaatcggaggtttctttactaaagtgatcgatttttatcagcaaaaaaggcctggctttccttttccaactactttggaggaatctgttattaacaattacaggaaaggagcttcatcaaagtcaaaacataaggaatccgaaatttttgaaatccttgatcagcttctggaaaacaggatgaaactgattcttctgtatattgaaactcaaaagaaagagaaagttttatcagcgcttcttcctttaaaggtcaacaaggacatccaggatgaacttcaaaaaattgaggaagaaaatgatcttgttcttctttccaagtttaatatccttattaatgaaaacctgaaaaatgagccctctgcttttatttatgaaaaggtaggttcacagtttcagcattatttctttgatgagtttcaggatacttcagagctgcagtggcagaattttgttccgctgagagatcacagtgtttctacagaatatacttcttttacactggtaggggatcccaagcagagtatttaccgtttccgtggcggggaaagtaaactgatgcttgatattatcaacaaaaaagaattctcaccgaaagaagcagatcttcttgtcttaaaggacaactggagaagtgccagaaacattgtacagttcaacaatgaattgtaccgtttccattctgaaggacttcttgaagagcataaaaacatcttcggtgctgatgctgaacaaagttccaaatcaaagattgaagggcgcgtaaagatcaacctgatcgacaatcttacgaacgaagatttttataccgatacttccgcacggatgcagaaagacatccaggaatgtctggacaatggatttaagttctctgatattacgatcctttgccgggggaattttgatattttcagttattcccaaaagcttggaagcttaaaagttaattataaaggagaagaaaccaatattaaaacgatctctgataaaggtcttacccttgagctttcaaatactgtaaaagctgtcattgaatttctgagatgggaacttaacccaaagaataagccttgtctgatcatgatgatgtaccatctgaatacactagggaaaattcatatgccggattttacttcaggtatgaaagaaattctggatattgacggccaggaggaaatattgcaattcattcaggagagatattcaattcaacttaaacaggataattttccaagatttaatctttataattttattgaatattatatcaacgaattttctgttgaaaacaaggaaactgatttcttgttgaatttcctggaaatgcttttcaactttacacaaaatgccggtgctagtaccaaagagtttctgaaatactgggatgaagaagcatcgtcgtacaccattcaggcttcggaaaacattgatgctatccagatcatgaccattcacaaatccaaagggctggaattccccatcgtttttattcctatgatgaacaaaaaccgtgacagtgaatttaccaactggtttgacacgaatgaaaatgaaacactaaaatctgtgaatatcaaccagttcagtaaaaatctggaggcttatgatgaagaaattctttttttcaacacaaaaaatgcctataaaaacctgattgacaggctttgtttacaatatgttgctaccacaagacccgttgaacagctgtttttctatctacagaagcctaataagacgtctaacaatctggagcttctggaattccttcaaacaaaaaatccggaacaggccgatgaatttgatgtgtatcctgtacatcctgaaatgctgaagaaacattccagggataaaacttcttcttttaaaacccagaatatccggcatctgaagaacattaatgaaaagagtacatccatcaagattgctactccgtctaaaaactatcaggtacggaatgaaaaggtaagaatcggactttttgtacatgagcttttatcaaagatcaatacagaaaaggatatcattaaggtattggaaggatatgctttggaaggacagattacattagaggaaaaaaatgaaatacaggctacactacaggaaattgtaagaacttatgcagaattcttcgatgagaaatgggaagtgatcaatgaaaaagatattatgatcactgagagaggagaaagccatatattcaggcctgaccgtatattaaagggtgaagaagggtatattattgtggatttcaagaccggtgagccaaaggcgaaggatgaggcacaggtagaaggttataaaaacatacttgaacgcctgggcaaaaaagtactcaaaactcagatcatttatctataatctgaacatttccaaaatattactataaaaatttctgtaaaaaatctttcaaaatataaaaggttttattatttttaattaaagacgaatacaatacagtctttgattatattttgattacaactaaccaaccatgagaatatacttaaactcctttttaataagtctgatcatcatgttattttctacagtggtcacttacaatattgttgattgtttagatccacccgttacagcagatggtcgccattatatgcctgctgaaaacattgccaattctttatttctgggttttgtattgggagcagtagtatttattttcgctgtgaggatccaaagacagccgtacaggaaataactatatcatctcaacaaaaaaaccgctatcccggaagataacggttttatattttgaatgtttttcaatcttaagctgttgtatcaggagtaaacactctctgagacaattcctggtcaaaaaggtataatgctgatggattatcacataccattttgattttcgttacatattgagaggcacttgcttcctcttctacctgctcattgataaaccattgaaggaatgatgttgttgcaaaatctccttcctcatttgcattttttacaatattgaaaatacttttagttacgattttctcatgtgccagtgctttctcaaaaatatctgttgcgttttcgaactcatgcggaggttttggaatttccccgatgataatttccccacctacatcattcagataatcaaacattttatctgcgtgcatcaattcttctttgctctgtactctgaaatagttggcaattccatccagatcttttcctgaaaaccatgcagacattgaaagataatattgagcagcgtattgttcgtgggcaatttgttcgttaattaatttcgcaattttttcgctaaccataagtattaaatttatagtcaaaaatagggaataaaagcccgaaatcaaaagttttagggaaaattaatacaaaaaggatggaagtatatccatccttaacacattaaaaaactaaaattacaaactgttattttacatcagcagttcctgtattcataggctttttcatcattcttctttctttcattgccattttcattttctctgcttttgcttttctgtcagcctgccatttatcgtattgatcaggagtaaggatttttttcatgtcagcatccatttgtgctcttttagcctgcatttcctccattttagcttgtctgtccattttatttttttcaaactctgccttcatttcagcctttcttttatcctgaagagcctttatctgagctacctgagaggcattaaggttaaggtctttctgcatctggtctaagcgttcctgttgtttctgttccattctctgcttcatttcaacagctctggtctgtctgtcctgtggggtttgtggggttatagtttgttgtgccattgcaaaacttcccattccgataaatgctattgctaaaactaattttttcatctttttaaaatttaattaattgttatatgtctttttgattatgaattaaaacacaagttaaattaataaattcataaataatgttaatttttaataaaaataaagcaacataaagcaaaaaaaaggacagattataaaaacctgcccttcacaccacttaaatataatatatgaaaattaattccttactaagctgcctctaaagccgccaccgccaccacggttttcttgtctcggagcagacgtttcagatctttgtctgaatccacccccgttatttcctctgaaaccgccattgtcttctcttttaggagcttctcttcttacttcactgtttcctctgaaaccaccaccgttattcctgaagccaccgccatctgcatttcctctgtttcctccattatcagaattccctctgaaaccgccaccattgctgtttctgaaacctccgttattatcatttctgaatccggaattattgttatttccgttattaccacggaatcctcctgaattctcatttcttgtgtttctgaaaccattgtctggtctgctgtctcttctgataatattaaaagtagggttatccattcggcggaatcttgaacggtctactctgtagatattaacattgatatttcggtatcttggcattacagtataccttggcacataatacgttcttctgtaattctgaaagtatacaacagggttgtaacctctgtaataattattctgaaaaactacaaatactcttggtccaaggattctttgcagtgcataaaacctgtcatagtaccatctgtccggattatatctgtagaaattattccatgctgagaaacttgcatacagattattcaatctcatgatctgatctacctgccatctgcttaatctgttctgtacgaaaaatccgttccagtctatattaataatacttcctctgtagtcgttataatagctttgataataatcatttggataatagtcctgaggataattgtagtaataatcgtcaggaaaataatttctgtcatcttcatcgctgtaatagcctccgtcattctgataataaccgtcatcattccaaccattattcggatattgctgagcagacgtcaaaacgcccaacccaaaagctaatcccaaaaatatttttttcatctctatagtcgttaattggttaatatatagcagaatatcttaattctatctctttgatataaataaaaaaaagaagttaaatcctaaaatcaaacttcttttaaaatattattaactaattgataatcaattattaaatttacactcttccactatcttttatccaatgggcgatttttttattgaaagatgttctttctttcaggtcttccagttttatatgcatcctgtaacgccagtaatgtggaaaaactgcgggattattaattctttcattatcaatttccttattggcaagttctgaatcggttgccaggaattcctgaatcggaaaaatagcaagcatagcctcattatacagatgttgtttcataataatttctgcaagatgaggattcaggtcttcaggtgctttgccatactgtatcagctgttcattataatatctttgtgtaagaaccggatcttctttccaccattgccttaatgttgagctgtcatgggaagaagctgttaccacattcatataattggcatatttaggattatagaatggtatattttcagaaggcattctttgcactttaagagctataatggccaattcatccattacaacaggaacacatgccggtaccattcccagatcttctccacagatcagcattttagtagcattcagaataacgggaagtttctccatggctttttcataccacaaatgatcctgtcttctgaagaaatagtcatggtataggtcataaatatttttctgctcagattccggaaggtacttataagattctgtattgtatacattgaatcttggatggtaaaccgttttcccatttctttcctctggaaggaataaaacgttggcacatagagaaatcagcttttcttccaatggaccatatgattttttcttaaagaaattaaccagctttctctgggtatcaaactcttctttaaaagcgtaggtcccgtcatcattacgattcataaattcaagagcctttccgctttcctctccaaaataatcccataagatcttgttgttgataaacggcttacaatacctgtcaaaattgaaaggaatctgccaggctttaaattcatccgcgacaataggaacagcgggataaaagtaccctaaaattccttgtacagctgaaacaggcattctccatattctgaagaaacctaaaatatggtcgattctcatggcatcgaaatattgttccaatgctttgaatctgtttttccaccacctgtagtcatctgctttcatagcttcccaattgtaagtcgggaattcccagttctgacccagttctgtaaactgatccggtggtgcgcctgcctgaaaatccataccgaataactcaggttctgtccaggcttccacagagtatctgtaaataccgataggaaggtcacctttcaacgaaattcccaggttatgggtataatctacggcatccttcagctgcaggtgtaattgatactgtacccaggcatggagcattgaagtatcataatctttgcttttcgtgctaaaaaactgtgaaattttaccggcaatatactttttgtgggttttccattcattaaaattcggtgtcttatatttatccctcaaaacacagaatgctgaatagggtaccagccagttttcattatccttgatgaattttttgaaatttctgtctttataaattttatctttttccttattgaaaacagctataagatatttccatttccccgcaatcatcttttcatagtcgatcagatctaaggcgtttaaatcctctttttcagacagatattcttcgactaattctttcggtatagagtaatcaaggttttctaaagagatatactgtggatgtaaagcataaacggatactgcagcatatggatacgaatctgtccaggaataattggctgtcgtatcattgatcggaagaatctgaataataccaagattggtttctttcgtccagtctgccagtttttttaaatccgtaaattcccctactccgaagccatcttcacttctcaaagaaaataccggaactgccacaccggcatcatggtacatctggtatcctttaaacctgaaataatgattggaaacaatctgcagtacatcattaaacagattgggagccgtggatcggtttccaccggtttccacatctatgaccctgttttctttggtatcatatatacaatatttaaactcgataaattcattctccggaatttctacagaagcttcccacattccaaaatcggtttgctgaaggtgaataaccttgtcatagttccagtttcccaaagatgctgtacttccaaaaagaacaattctccaatccggattataaataggagcttctattctgaagagatgggtatgtttttttaaaaccgtgattctttcaggaacaaaatcatgtagtttgttatagagaattttgttgtttaaataattttcaggaaagtttttattgttccattcgtcaaaaatgataaactccttataattatgaggaaaacttaaatgatgaggaacgaattcttctcttaagacatttcctttttcattaaccacccgatattgatacgtaatggattttgagaaatagtctacttcgcatttccataacccattttctgcataaaacatagtatggacgtgtaaggcatgttcatcttcaccaaataccagctgcaagctctcccccgcctttacaatatatcctacattaaagtatagtttcatctatatttttttataaaagtacattttaatatcgaaaaataaaacttattgaatatcaaataatcattaaaaaaccttctcaaaacagattgaaaaggtttttatatattgatttatagcaacctattatttggttacaagaatctttttgttgaatattacttttcctgattcatcagtaatatttacaatataagcaccggtcaccagtcctttaaggtatactttctcatctgatgagccttcttttactgaaacattctgagtcataacattcttacctgccatatcaaagatattcagcttaacagtgccttttattttgttgccagcatgcacattaatgtaatgttcatcaactcttgtagggtaaatatcaagacctgcaaaagtgtttactattgaaggtttatcattcacaaaatatttacttgccagatcataaatatgaagcccttgctctcccggaagctgttttgcctgtaaagttgcaagatctacttcatagaatgcccctccttttgcacttgctattacaacttttccctgagcatttacagctgatccgtttacagaatagttatccggaatgcctgcaatcttacctataaatttagcttttaaatcttttgtcaggactttgaaaacatttcccgaagccgaaaaaatataaaaattattatctgcatctgctaccatatcccctccaaaaccagtttcaatagcggtaaatgaatttcgcccattagaagtatcatctttgatgattcccaaatcattcacaagatattgtccatcttttctgctgatttctaaaaattgcgttccggcattatttacagcataaattttaccgttatatccggttgccatcctggtaatatgagaatttatgtcacatgacgacactcttgccacattattttccaccaaagtgatttcttttgttttcgggtttaaaatatagatattcgaggaaaacataggcatgtacaccagattattattcgaagcatcatatgcaagcgcagctaatgttacagcctgtgaattgctgtaagaatttttgtcttctgttacaactcctctttttgtctgtgaaaacacttttgcagaagaatctgccgtaaaaagcttctcaccagaagttccgtttgtaccgtcaatagcacggaaatcattgaaagtaatactttgattgttttttccggtaatcgcaaagaaatcctgctgtgcttgtgcatttacacctaatagcagtaaaaataaagggaataaatgttttttcatattatatatttttagattcataatgaatttgatcttactaagttacgcaattttagaattctaaaaacaaaaatctcttgtaaatgaataaagttaattacaaattaaaatgtaccagctatcatcaagagtggggtatatcatttatttctgttgttcaacatgctgtgatgaacatcaggatgataaatgatgaatgataagttataaatgatttgacgggattcgggatacaggtttgctgttttggatttctgagatttgaactggaagtgataaaggtaattctattctcacttgtgtcattccgcaggaatccaggcttacttatcagagccttaaaggttcaagatgaatgatgaatgataaatgattaatgattaattataaaagcattgaatgcttaagtaatttagtgaaccattattgcttgaataaatggcttgtttagactcctacggagtgacaatagggatgtgatgaatgatgaatgttaagtgataagtgatggttgataattgatagttgattgctgtatcgtttatcatttatcaattattactcattactcatacgtccggtataaagcaaaaaaatcctttatcatttgataaaggatttttaaaaataaaataaaaactggcggcggcctactctcccgcgttagcagtaccatcggcgctggtgggcttaacttctgtgttcggaatgtgaacaggtgagccccaccgctaaaaccaccctaaagaaggtatacaa

SEQ ID NO: 9 - DNA, 339508 bp, Chryseobacterium sp.
accagacagattttgaagaaagtagggtaaaaatcaaagaccttcaccctacgcaagctaactcaaggtcgcttttataaatataaatgtataaaaaatatttggaagttaacacagaatctaaagccagcagagaatgtatttttgtaaacgggttaaaacccgtttctactgaatgtcttttctttttaaccgcagataacacagattgacacagattatgatatattttttatacatatatggaaactgtttttattttgtcgcgacttattacttattacttattacttattacttattacttattacttattacatccctgcttccctagccctgatagcaatggttaccccgcagctggagctggagcgcaggagagtttgagcgtgggagagcgctggcgcgaggagtatgaatggatagcaggaaatagctacataagaaagtgggaatatgggagtgtgggagtgtgggagagtttgagtgtgaaaaaggttaagagtattggtgaagagatataaaaaagaggaatatgaaattctgatggattttctgctgtatctaaaaaaaacattccgtaagaatcttagtaatagtaattcttacggaatggggataaaacgaagttatattctagttcagaacgtatgatgttccgtctcttccgtcttttaattcgattccttctgcaagtagtttgtccctgatctggtctgaaagctcgaagtttttggattttcttgcctggtttctcaattcgatcaagacttttagggtctgatcaagtttctcattgttattttcttctacggtctgtaaccctaaaacatcaaagataaaggcgttaagcgtagtttttaaatcctcaagatcagcagttgaaatcgtttctttaccatcattcaaagcaaagatgtattttaccgcttcaaacaggtgggcaatcaggattggtgaattgaagtcatcagttaaagcgtcatatgctttatttttccattcctgcagattgaatccggattgttttgtatcatccggagtaatagaattcaatactttcactgcttccattaatctgatgaatcctttttcactcgctatcatggcatcgtttgaaatatccagaacacttctgtagtgtgcctgcaggaagcagaaacgtactattgagggatggaatggtttttcaaagaagtcattatctcctgtaaccagctgcatcggaaggatatagtttcctgtagatttgctcatacgctgagaattcatcgtcagcatattggcatgcatccagtaattcaccggcgcagcatcattgcaagcttttccttgtgcaatttcacattcgtggtgaggaaacttaagatccattcctcctccatggatatcaaatgtttcaccaagatattttgtactcattgcagtacattcaaggtgccatcccgggaaaccttctccccaaggggaattccatctcataatgtgagctggagatgcttttttccataaggcaaaatcctgtgaatttttcttttctccttgtccgtcaaggtctctggtattggcaaaaagttcttctatattacgttttgaaagttcgccataattcaagcctcttttgttgtattctaatacatcgaagtatactgaaccgttactttcgtaggcaaaacctctttcaatcagtttttgagtcaattcgatctgttctacaatatgtccggtagctgtaggttcgatattcgggggtaacagattgaacatatccaataccttgtggaaatctacagtgtatttctgtacgatttccataggctccagtttctcaagtctggtctgcttaacgaacctgtcgttatctacattcccatcatcggtaaggtggcctgcatcagtaatatttcttacatatcttactttataccccaaatgcatcagggtacggtagataaaatcgaaggaaaggaaagttcttacatttcccaaatgcacattgctgtacaccgtaggtccgcagacatacattccgacatttccttccaagataggtttgaatatttctttttccgctgtaagggagttatatatttttaattgcatttattttaagttaaagatttaataattttaaagattcaaaattgagttaaaatacttttgtcacaacaaataattgtcgtgataaaaattttatctgaaacttttttaaattttatcataattaaaccgcttttaaatgatgctgcagatggtctacataatcattgataataaactccagcgtaaaaacctgaggtgttgttttggtagtatcacaggttctttgtaatgcttcatccggaatattttcaactacatgaacaatctgatagttcaaagatttccacagatcgataaggtctgtagtaggaacattctgatagttctgagctttcacccaaaagttttgatcataaacaatattctcgttctctttgtattgggtaacaacaaatctacggatatttgttaaagcactgtcacaaagatggccaataatttcttttttggaccatttttccggtgtactcttgtgattccattcctcttcagatatattttgaaatctctgaagttcagtatcaataatatttttgagaatctggtagttcattttttatcaatctagttttgcgtggcttcctacgtaatgcaagaattcctgtcttgtaatagggtttgttctgaaaataccacttaattctgctgtaattgtagaacttgcagtatcttttattcctctgcaattaacacagaggtgttttgcatcaatgatacaagctacatcttttgttcctaaagcttctttcaaagcgtctacaatctgcatggtaagtctttcctgaacctgaggcctttttgcatagtaatcaacaatcctgttaatttttgaaagaccaattacttccccattggaaatataagcaacatgagctcttcctatgatgggtaaaaagtggtgctcgcagaaagaatatacggtgatatctttctccaccaacatctggcggtatttatatttattggagaaagtggagatccctggtttgttttcaggaagaagtcctccaaaaatctcattcacatacattttggctacacgtcttggggaatctttcagagaatcatccgtcatatccaatcccagcgtttccataatctcgccaaaaagctcagtaattttttcaattttttcctgtggcgatttatcaaaagcatcttcccttataggcgtatgttcttttcctgtgaaaatatcatcgtcgttatcagtaaaatcaaccatttttatttaatttgcagcaaaaatacggataatatctgttcatctctattcaatgaggatgaaaaacattatcttttataaccagctctgattaaaaagcctatgattattgtcgaagaagtacaaaaccacctccataaaagggaatttctggaattcccggcccgcctttaccgggatgacaaaaattatatccggcctttagataagtatattgaggaaatttttgatcctaaaaagaataaattctttaaaaacggagaatgcaggaggtttctgtttaaaagggataataaaacagttggtaaagtggctgtttttatcaatagctgttatgagcaaaagcaacctaccggaggaattggttttttcgactgcatcaatgatcaggtaacagcgaatttcatttttgaccattgcaaaagctggcttcaggaaaaaggaatggaagcaatggacggccctattaattttggagaaagagataaattctggggacttttaattgaaggatttattgaacctttgtttgggatgaactacaatttcccttattacaaggatctttttgaaaattacggatttaagatttattttgaacagctttgttttaccaggccggtttttgcagaagtttcacggatttttactattgctcatgaaaagaacagaaggaatcctgcaatttctgcacaacctatgaaaaaaaataatctgccgaagtttgcaaaggattttacagaaatttataatagagcatgggcgtctcatggggaaggaaaacatctggaagaagtaaaggttctgaaaatgttcaatacgatgaaacctattatcaatgagcatatttcctggtttgtctatgaaaacgagaaacctattgcgatgtggatcaatattccggacctcaaccagtggtttaaatatctgaatggaaaattcggaattttggaaaaacttaaatttctgtttttaaagaggtttaagaaaaatgagaaaatggtgggacttgtttttggcgtcgttcctgaatggcagaagaaagggattgacggatacatgatctgggaaggaacccaacatttgagaaaacatacagactttacgattacagaattacagtggatcggtgattttaatcctaaaatgatcaagattgcggaaactcttgatacaacggttacccgaaagcttgcaacttaccggtatttgtttgacatgaataaagagtttgagagacatcctaatttatgataaataacaatattattttaattgaatagttgtatttttgaaagtaataaactaaataagccatatacaatgaaaaaaataattacaagtattttattagtattagccattgctctttctgcacaacagatgaccacattgagttatgatggatcaagattactaaatcatacattttatcagaatggagattcaagtggcaagggaatcagttatgatgacatacaaggaagtccgtactacgaaaaggtattttctcctgctaaatttattgttgctgacaaagctgaaactgctgtagcgcgctataatatgtactttgatgaagttgagttcaagaaggatgaagagacctattctctagttcccgacagcccttttaccagaattgaatttactcgaacaaaagaaatattggtaaaactagacacagatgatgatttgaaaggatatttctttgaattagtgaacggtaaaaacgcactttataaaaaagtaaagtctcaatttaataatgctgttgctgcaaaaaattcatacgaaatagacagacctgcaagctttaatactttagatcccgtttactatattaaaacagaatcaggatatattaaaaaaccaaaaaaaataaaagagattgctgaagcttttccagcaaagaaggaagagattgaaaagttcgcgaaatcaaataacatcaaaataaataaagaagaagacctcatcaaactggttaagtttttaaatcaataaaaaaataaacccctgtgaaaattcacaggggttccttcatttttggtacttctattagaatagctcaccggctacttttttaatattatcactttttcccattgaatagaaatgcagaacaggaactccgaagtccagtagttctttgcattgggtaatggcccattctattccgatctgttttactgcttcattattttttgcactttccacttcattaatcagttcttcaggtagatctattttgaatacctgtggcagaattttcaggtgtttttttgttgcaataggtttgattcccggaataattggaaccgttattcccatttctcttgctttctgaacgaattctatatactttttattgtcaaagaacatttgggtaacgatataatctgctccggcatctactttttgtttcagccatttaaggtcataattcattgaaggggcttccatatgtttttccggataaccggcaacaccgatgcagaatttattcaactcatcactgacctgttcttcgttatgaagatattttcctcttccgagatcattaatctggttaaccagatccatcgcactggcatgacctccctgggtaggctcaaagtactgatgtcctttcatcgcatcacctcttaaagccattacattgtctattcccagatacatacagtctaccaacagatattctgtttcttcttttgtgaatcctccacaaagaagatgtggaaccgtatctacattgtatttatgctgaatggccgcacaaattcctaaggttcccgggcgcattcttgtaatacggcgttccataaggccatttcctttgtcgatgtatatatactcttccctggatgtcgtaacgtcaatgaaaggtggtttgaattccattaacggatctatattcgtgtacagatcttcaatcccgattcctttctgtggcggaacaacttctaaagagaataaagtttttccatttgcatttttaatatgttctgttatcttcatgtcaatgttaatctgctaaattgggtgacaaccatttttttgcttcctggatgctacagcctcttcttgctgcataatcttcaagctggtcttctgtaatttttcctaatccgaaatatttggcatgtggacttccgaaataatatccggaaacagatgctgtcgggaacatcgcaaggctttctgtaaggaaaacacctgtattttcttctacttttaaaagttcccatattgttttcttttccaggtgatccggacaagccggatatcccggtgccggacggattcctttatatttttcggcaataagctcttcgttgcttaagttttcctgattggcatatccccagtattctgttctgacttttttgtgtaagaattcggcatatgcttctgcaaaacggtcagctaaagcttttaccatgatggaattgtaatcatcatttgctttttcatattcagcggacagttcatcggttccaaaacctgttgttacacagaatgctcccacgtaatcagtttttcccgagctttgaggagcaatgaaatcacttaatgccagatagtcttttccttttgatctttgagcctgctgtcttaaggttaaaaatttcgcctgttcgttattgttttcgtcaaaaatcaaaatatcatcagaatcattggaattggctttaaagattccgaagatagcctttgctgtcaataatttttcatccagaattcttttcagaatcacctgagcatccttaaataattctttggcctgaacacccacaatctcatcttcgagaatattcgggtatttcccgtgcagatcccagcttctgaaaaacggagaccagtcaataaaaggaaccagttcattcagatcctgattttcgattatttgtattcctaaattattcggagtgaagatttcttcgttttcccaatcaattttaaaacggttttctcttgcctctccgatcgaaacataatctttatctacctgtctgttcaggaacttctctctgaattcagagtagtcattctttaaatccgaaacatattctttatttctgtctcctagcaatgcgctcaccacatttacagctcttgaagcatcattcacatgaacgacagcatttttatatttcaaatcgattttcacggccgtatgtgcctttgacgttgtagcaccgccgattaatagaggaaaatccaaattttgtctttctaattctgaagcgatgtacaccatttcatccaaactaggggtaatcagtccgcttagcccaataacgtctactttttcttcaatagcagtctggataatcttttcggcaggcaccattactccaaggtcgacaatttcatagttgttgcaacccaaaacaacgcttacaatatttttaccgatatcatgaacgtctccttttactgttgccattaatatttttccgttggcaggttttgttccgtctttttctgcttcaataaaaggctgtaaataagccaccgcttttttcattacccttgctgactttaccacctgtggaagaaacatttttccgcttccgaataaatctcctacaactcccattcctgtcatcagattcacttcaataacgtgaaggggtctttcagccaacagccttgcctcttctacatcttcttcaataaaacgatcgattccttttaccaaagcatgagtaatcctttcctgcaacggattatttctccactctaagtcttcagtcttttcttttttaacggatttatgcttttcggaataatcaagaagcctttctgttgcatcatctcttctatccaggattacatcttctaccagctccagcaattctttattgatttcatcataaacttccagcatggccgggtttacaatacctatattcattcctgcctgaatggcgtgataaagaaacacagagtgcattgcttctcttacggcatcatttccgcggaaagagaaagaaacattgctcactcccccacttacagaagcataaggaaggttttgtcttacccagcgtgtggcttcaataaagtcaatagcatttctcctgtgctcttccattccggttgctacagggaagatattcaagtcgaaaatgatatcttcggcaggaaaaccaatctgatttaccagaatgtcataggatctttttgagatttcaattcttcgctcaaggttgtccgcttgtcccacctcatcaaatgccattacaatgactgccgctccgtatcttttaatggctttggcgtgcttgataaattcttcctctccttcctttaaactgatagaatttactacgcactttccctgagctacctgaaggcctgcttcaagaatttcccatttggaggaatctaccataatcgggattcttgcgatatccggttcagaggcaattaagttcaggaatttgatcatggaagcttttccatcaatcaatccatcatcaaagttcacgtccaggatctgggcgcctccttctacctgatggcgggcaatatctaatgcttcggagaatttctcctctttgatgagtcttaaaaactttttggatccggcaacgttcgtcctttcaccaacattgatgaaattactctccggtgttatgataagaggctcaaggcctgataatcttaaatacttcattttattcttctaaaatatagtaggcattattggcattctgcctcaataaatccctatgcttacttaaagctgtaatcagtggaaatctcttgtacgctaaattgtgttctttagcaaattcctcaatttcctcagtaatttcattataatacatataactgtagtttggaaacagatgatgggccacatgaaaattaaagtttcccaatacatttcttacaaaccagttattttctgttaaatcattggtcacctccaattggtgacgaagccagctgaacggaaggccgttctctttatttaacctcggaaaggcattatcaggaagcggatgcaaaggcaacagcacaaacaaggcaaaaatgcttgctgaaatcacctgtaaaaaccacgctcctaaagccagtcctattgatactttaaagaacacaataggcaccacaatctgataaaagaaatagaacagcttataactcaccattttcactttttcaacaaccggtattcttccctgggtttttaaaatcactctttccttatcaaagaaatcccgaaagtctcttataaacatccaattgaacaaatacaacggatatactagaaagaaaaacttatgctgatacttctgaattccttttgccttgatccatggaacgatcaggagcaatccgctctgttcgatatctgtatcccatccatctacatttgggtaagcatgatgacttgcgatatgtctttttttccagatataggaattggctcctataaaatcaaaaatgtggagaactaaggcattcagttttttacttttatagatgttgttatgggctgcttcgtggattaagtttaaataaattaaaaccagagaaatgcccattaaaacaaaactcagaatatagacccaatgtttttcagctttcaaaacagccagaaaatataagccaatataaaccaatgggagtattaccgctttgatctgaatatagatatccctgttttcaggaatggcttctactcttttgttcactttctttctaagctcattaaataatctgacatcttccgaatcttttaaataaattggcttttccatatatttaactttgtggtttacttaaagttaacatttataatccagccttcattcttgattttaattaaaaaaatctatcaaatcacacaaattccttcaatttcctcggtggataatctttcaccagctctgcaattgctttaatatgttcaggcgttgttccgcagcatcctccgataatattgatcaatcctttttccacatattccctgatctgtctcgccatatcttcgggtgtttcatcatattttccgaaagcatttggtaagccggcattcggatatgctgaaacatagaattctgaattatgggccagtgtttcaagataaggagtaagctgatctgctcccaatgcacagttaaaacctacgctgagtaaattcaggtgtgaaacagaaatcagaaaagcttctgccgtctgtccgctcaatgttcttcctgaagcatcggtaatggttcctgaaaccatgatgggaattttaattcctctttcatcctgtaattcatcaatggcaaacaaagctgcttttgcattcaaggtatcaaagatggtttctaccagaaggatatctgaacctccatccagtaacgcttcacattgttgtttgtatgctactcttaattcttcaaaagtaatagctctgtatccgggatcatttacatcaggacttaaacttgctgttctgttcgtaggcccgatagatcctgccacaaatctcggtttgtccggattttttgctgtatattcatcacaggcttttctggcaatctttgccgactcatagttcagttcatataccagatcttccatatgataatctgccatcgcaatggtagtccctgaaaacgtattggtctcaataatgtctgcccctgcttcaagatatttcttgtgaacttcttcaatggcctgaggctgtgtcagagaaagcaggtcattgtttccttttaccggatgttcccaatctttgaaacgctctccgcggtaatcttcttcttcaaacttatacctctgaagcatcgttcccatagcaccgtcaagaattaaaattctttcggatagagctttatataattgttctgaatttttcatttttaaatgtctgattaaattctgtttctattgaattaatccaacgcctgcttaaggtccgcaatgatatcctctacattttccaaccctacagagcaacgtactaatcctgctgtaatacctacttcattcctttcttcatctgataatttggaatgcgttgtagaagccgggtgcgtaacgatcgttcttgtatcacctaaattggcagacagtgaacacatttgtatcctatctaaaaagtttcttcctccttctattccaccttttatttcaaaggctacgatgtttccaccaagtttcatttgtcttttggctacttcatagcttggatgggatttaagaaatgggtattttactaactctacattcggatggttctctaagaactctgctaccttcaatgcattctcgcagtgtttttctacgcggattgccaatgtttctaaactttttgataatacccaggcattaaaaggagacaatgcaggtcctgtatttcttgcaaaaagatagatttctctgatcagttcttcttttcctacggctattcctcctagtactcttccctgtccgtcaatcagctttgttgctgagtgtacaacaatatctgcaccatatttgatgggctgctgaagataaggtgttgcaaaacagttatctacaataaatataagattatgctttttggcgatctgaccgaaaaactcaagatccaggatttcaattgccggattggtaggtgtttcaaggtataagatctttgtattaggcttgatatattgttcaacattcgctgcatcttctgctttgaaataagaggtttcaatattccatttcgggaaatatttggtaaacaaagtatgggtagacccgaaaaccgactggcagcttacgatatgatccccagcatttaacaaagctgcaaatgtagaatagatggctgccattcctgtcgcaaatgcatatcctgcttctgcaccttccattttagcaatcttatctgtaaattctgttacattaggattggaaaaacggctgtataaatttttaggtttttcttctgcaaagcttgctctcatatcttccgcatcctgaaatataaagctggaggttagatataatggcgtagaatgttcatcaaactgggttctttcagtctgggttcttattgctgatgtttcgaaattttccatatagttttaattaatttaccaatataacagtctaacaatataacaatgagattcttcgctttgctcagaatgacaattgtagtaactgttacactgctaaactggtagattgttacattaaatattatttagtttcacttactcttaaaatatctccaaatacccctctggcagttacctgtgctccggctccggctcccatgataacgatcggattttctccgtaactttctgtataaatttcaaagattgaatctgaacctttcagctgtcctaatgcagaagttgcaggtacagaaaccagttttacatccaactcacctttatctttctgcaaatcgccatgtaaatcgcctacatacctcagcacatgtccaggctcttggttttctttaattttctggtattcttcgtccagctcttcaagtctggaaaggaattctgattttgaaacctcaagtaagctttccggaacaagattttgaatactgatatcttcgaattcattgatcagatccaattctctggcgaggatcagtaattttcttgccacatcatttcctgacagatcttctctcggatccggttctgtatatcccttttccagagcttcattgatgatggttgaaaatttatcgtccctcaaagaaaaattgttgaaaacatagcttaatgttccggagaacactcctttaattctggtgatattctctcctgaaaggtgcaataatttaatagtatcaattaatggtaatccagcaccaacattggtttcatacagataacgtctgttatttttgttcaacgtatatcttagttttctgtactcttctatcggaagggtattgaaaattttattggaagaaacgagatcaaatccgttttctgccagggcatgatagtttttaacaaaatccttgcttgccgtgttatccacaacaatcagattttccagttgattttcgttggaaaagttgatcagttcttcaacgttagacggatgctctgcggttaatacctcatctccccaattggtatcaaacccctttttgttgaaggcaattttctttgagttggctaccgcaactactttaaggtctatttttttacgttttttaatttcttctgcagattccagaacctgctctatcaatgtttttcctacgtttccgtgaccaataatagccagatgaacggtctttggttttttgaaaatttcagattctatgatatttcttgttttttcatcctgtgaagaagtcactacgatattgactctgttctctcctgccacctgattcaaaagcaacggaaaaacattgtttcttgccagctcagcaaagactttattgaaatcttctgctacaaagccaatcacagaaacattattgatactatagatctgggaaactttccctgactttctttccgcttcaaattcatcgataagacaagcgactgctttctctgcatcattttcatgaaccagaatggaaattccgttttctaccgcctgttgagagattactcctacactgatacgcgctaaggtaagcgctttaaaaattcgtccgtcaataccgatttctcctaagaaatcttctccttcaaatttgacgattgatctgttcttcaaaaattttatttcgttagcatttttcatttttcctgtaaaatgttttttatgatattatttaattgttgatattccattaggaaggcatcatgcccgtgtatagattggatctcgtgataagaaacatccttatttttctcttttaagttttcaaaacacatccggatttcagaagccgggaaaaataagtctgaatctacagagatcatgcgcattcgtgcctgtatattctccagtgctgtttcatcagcatttatattcatcaggagatgattcatcagttggtaagcttttaaactaaacctttcgtttagagcattaccatgataaatcagccagtcttctgattccaggcgttgtttttcctggttatattggttttgaaatctgtcattgagtgactgcggtgttctgtaacacaacatggcatgaattctcgctttttgtaatggttcttctttatcatttaacaagaatttctgaaccagacattgcgcatgaagccaatcgtgtgttctgtaatcgcaggcaatgggaataaatatctctgcaagatccggctgctgggcaagcatttcccaggcaattcctcctcccagagagcctccgataatggcatatagttttttgatctgcaaagcttcaagccctttcaggaatatcgcagcgatatctgaaggggtaaagtcttcatagtcttcaattaaaaaattgtcataaccgtttccgggtatgttgaaacacagaactgtgtattgatcggtatcaacaatctgattttctcctaccagctgcttccaccagcctttatctccggatacattcgagtttccggtaagagcgtgattgattaaaatgacaggtgctgtaaacagatctttcccaaaaagctgatagcttaacgggatatggtattccttttgggaatttgtttgatacgtaagattaatatagtttagttctgttttcaattctattatatttaaatacaattgaaaatgccacaggaaatggctgaaaagaacttcagtaagttatctgtccaaaattattttggtagaacgtagcaccttctttacttgcgcaaagggttgctaaggtttcacagggtctaatccctcaacctttcttgataacattttcaatatttgaatgaacgaatggtgcaaaggtagttcttttcttttaaattcaaaaaaaaattattttaatatttaaaagagctcttaaataaaggcgtttcaaggtcatattaataattattcagatgaaaaaaattggaattacttttcaaaaaaactaacttcgtatggaaaaatgatgacatatgaccgccgaaaaagaaagattacaagataccaaatggaaaaactggggaccttatgtaagcaaccggcagtggggaaatgtacgcgaagattatagcccgaacgggaatgcctggaattttaccaatcataataatgcagaaagctatgcttaccgctggggcgaagaaggtattgccggaatttctgatgtaaagcagcttttatgttttgctttttcattctggaacaaaaaggataaaatggtaaaagaaaggttcttcggattgagcaatcctcagggaaatcatggagaagatatcaaagaaatcttttattatctggataatacacctactcatagctatatgaagatggtatataaatatccgatcaatgagtttccgtatgatgatattcttagtgagaatggaaaacgcagcaaaaaggaacctgaatatgagcttttcgataccgggatttttgataacgatgagtatttcgatattttcattgaatactgtaaggcagatcataatgatattctgaccagagtgacagtctgcaaccgaagccagcatgaagctcctatcgtggtggctccaacggcatggttcagaaacaactggaaatggggatataatacctacaaggcagagctgagtgcttctcaggatggaagtattaccattggccacgacagtatttcaattaaaaaactgtattccagaaatacaaatgcacaaagtgtattctgtgaaaacgaaacaaatactccaaaactttacggtactcctaaaacagagaatacttattttaaagacggaatcaatgattttataattcacggacgagatactgtaaatcccgaaaaaagaggaaccaaagcatcttttctcattgatgaagttatagcagcaggtgaatcaaaagtttttgaattcagattatgtcctgaagaaaacgatgaaccttttgaaagctttgatgaaattttcaatgcccgaaaggccgaagctgaagagttttatcaggaaattcagagtgataccgtgaatgaagatgaaagaaatgttcagcgacaggcatttgccggacttctctggaacaaacagttctatcattataatatcgggaaatggctgaaaggtgatccgaactttgaagcgccaagaaacttcagtgaatatgtaagaaatacggaatggaatcatcttcataataaagatattatttctatgcccgacaaatgggaatatccgtggtatgccacatgggatcttgcatttcactgcgttccattttccatcatcgatgcagagtttgcgaaaggacagttgttattacttactaaagaatggtatatgcaccctaacggacagcttcccgcttatgaatggaatatgagtgacgtgaatccacccgtgcatgcatggtcatgcttccgtgtttttaagatagatgaaaagaacaatggaaagcccgatttattattcttagagaaagttttccagaagctgctgcttaattttacatggtgggtgaaccgaaaggataaaaatggtaagaatatttttggcggaggtttccttggtctcgataatatcggagcttttgaccgtaacatggttttaaaggacggccagcatcttgaacaggcagacggaaccagctggatggccatgtatgcattgaatatgatgcgtattgcgatggaacttgcccagtattatcaagtgtatgaagatatggcgatcaagttttttgaacattatctttacatcgctgaagccatggaaaatctgggtgaaggaacgaaaggtctgtggaatgaggaagacggattcttttatgatgtattgcaacttggaaacggagacagcgtttctttgaggttaagaagtattgttggtttgattccaatgtttgccgttgagattgtagaccaccgtttactggaaaagatgccgaatttcagaagcagaatggaatggatcttaaaaaataagccggagcttaccaagcttgtttctcattgggatgaagaaggacatggaagaaagcatctgatgagcatcctccgcaagaacagactgaccaaagttctgaccagaatgcttgacgaaaaagaatttttaagtacttatggaatccgtgccatgtctaaggtatacgaagaaaatccgtttgtattttctgtgcatggaacggaaaacatggtctattatactccggcagaaagtgacagccgtatgttcggcggaaacagcaactggcgtggtcccatctggtttcctatcaactttctgattgttgaaagtctgcagcgattccattattattatggaaacagtctgaaagtagagttcccgacaggtagcggagataagagaaaccttgatgaagtagctcaaaacatcagcaaaagactttgttctatatttttaaaggatgaaaatggaaaaagagcgttcaatggagataatccaaaattcaattacgatgaacatttcagagattatattacattctttgaatatttccatggagataacggccggggcgttggagcttcccaccaaaccggttggactgctactgtagccaaactgataaagccaagactcaccttttagatgagtaataaataatcagtaatgagtaataaaaaggccggatgaatcatccggctttctatatttttaagtaagagattaaattttttctccgttcacatagacttcgtatccgatttctacattcggttccagagtttttgacactgaacaatatttttcaaaagaaagttctgcagcctttagtgcttttttaggatcaatttctccttccaaaagaaatttaacattaattgatttaaaaggttttgcatcttctatctgtactctttctccttctacctctgcctgaaaacttttgatctcctgacgctgcttctttaaaatggaaactacatcaattccgctacatcccgctactgccatcagtacactttccataggagaaactccttttgctcccggctgggaagtattatccaaaagaatagaatttccctgagcattggtacattcaaataaaaaatcgtcgtttattctgttaagtgtaattttcattatgtattgcttattgcttctgcaaagttataaaattcctctcgcttttatctccagatatttattgataacatcaatattcaaattttccggaagggtataaacggtataaattccgtatttacggagttcctggataatcagtttcttttcaaactcaaatttttcagcaataatttcatcatagatttgctgcatattttcaggatttttgttgatcagtgtctgcaattctgaatttttgaagaaaacaacgaccagcaaatggtttttagcaattccacggagatatttcaattggcggttcaatccatccaatgtctcaaaattggtaaaaagcagaatcaagcttctttgattgatagaatattttacatcctgatacaaacggttaaaatcactttcaaaaaaatctgttttaatattataaagagcttcggagattttcttcagttggccggacttattatcggcagcaattttattttcagctttcttggaaaaggtcatcattccggctctgtctccctttctcaaaataatatgagacaacgccattgttgcattaatggaataatccagcagacttaatccgttgaaaggcattttcatggttcttcctttatcaatcagcataaaaatacgctgtgacttctcatcctgaaactggttgaccataagacggtttgttttcgaagtggctttccagttgatcgtcctgatatcgtctccgggaacatattctttgatctgctcaaattccatggtatgtcccagctttctgactttcttgattccgcctaataaaaattcactctgaatagccatcagttcatattttctgagatggataaaagacggataagaaggcagcatagcatccttctggaaaataaatctttttgagatgaatcccaatggtgatgatgcatagacattcagacctccgaaatgatattcacccctttctttaggctctaatgaatattgaaaaaaggtatttgctccggaagcgatctgttttttgatcaggaaatctcttttctgaaactgaaacggaatttcatcaataatcttagtggatatggtaaagctataattatttttgatgtcaatttttacaaaattctcatctccgttggacagtttttcaggcaaaattctttgcacctgtaaggcgttcttttgattaaaaagcagcagaaaatctaccattgctgccagaaaacaaatcaacagtgtaatatgggcaacccacatcaacaccggaaagaaaaatgccagaacatacagtatccccactccaacgagcgtaaaaaagaaacgggtattgatgtataagtttttcattatttaaggattaggatttaggacaaagggatcaggtattactactcatccacttccctctactaacctatctaggtatttctattccttctaaaatctgacggataatttcatctgctgtaaggccttccatttctctttcaggagatacaattactctgtgtcgcagaactgcgtaacaagactctttgatatcttcaggagttacaaaatctcttcctctaatggctgcaaatgcttttgaagccgtaagaagcgccaatgaagctctcggagaagcaccaagatataaaaattggttttctctggtgttaatgataattttagcaatatattccatcaactgggcttccacaatgatttcttttaccagatgctgataattttttaattgttcagcggtgataacacggtgtatgccttctgttttatcttcttttttactttcgtgctgatttttaataatggcgatttcctgctcaagattagggtaacctacattaattttgaacagaaaacggtccagctgagcctccggaagacggtatgttccttcatgttcaatggggttttgtgttgctatcaccagaaaaggttcttccattgtatagcgtgtgccatccattgtgatctgtctttcttccattacctcaaataatgctgactgggtttttgccggcgatctgttaatttcatcaatcaggataaagttggaaaagacaggtccttttttaaattcaaattctgaatttttcacattaaatacagatgttcccaggatatcagaaggcatcaggtccggcgtaaactgaattctgctgaagccaacatcgatggtcttagccaataattttgctgtaattgtcttggctacccccggaacaccttcaatcagaacgtgtccgtttgaaagtaaagcagccaaaagatgttcaatcatcttctcctgtcctacaattacttttccgatctcagattttactttttctaagcttgcgcgaagctctatcatatcaattctcgactggaactgctcttcctgtttattaaggtctatcgagccttggttttctatattggggttatcaaagttttccataataagtttttatttaccaatctagcaatgtatcaatataacaattattgagaaactgctatcacttcatattattattattttgttgtattatctaagtatttcatcaagaagcttattaatccttgttagatcttccttcattacactggcatagggatcctgagcttttttaataagcattattgcctcattgatcatctccatggttttaccggttttcagttgtaattttttagcaaattcctcgtccagatgctgagtgtcaatcaacagatccattctcactttattcagaaaatactgagctttttttgccatcatatcatgaaaatcaccttcctgaagataaagatttccaatgctttttacaaaatccagggaagtatttcttaatggctccgttacaggtactatcctctgttttcttttggcattaaagaaaataaaaagcacaagacctcctaaaaacacccaccatgcatattttaaagccggatttgacaatacaaaccgcataaagaaacgtgatgttgaacttttatttgaaacgaaccaaagcgtttctctatccggaagataggagaatacatcctgtgcgtattttgcatttcccggtttcagcagataataattagtcagaaaaagtggttctgtgtgtgcatagatatttccttttccaaacttaactttaataaagttggcctgatccgtattctttttctccacagttttcccaagtacttctactttaggcttgatgaatgaaaatccccttcctgacggaaatttatccagcttaataaaatcattctgaaattttttgtcggtaagcttcagaacattttcttcttcaaaagagatttccgaatcataatatccaatactgtctgaaacttctttcggcattcgggttaccatcagaaaggcatctgaaccttcggatacctgggtaaggatttttttccacgattcgccgtcaaggttgttttcaataacaataatattgtgaacaccttttttatgctggctgtaatattcataaggagcctgctctacttttttcagattattcttaaaaagatatttggcttcattattaaagacaaacagtccgaacggtgacttttcattgagatcaaaattcttccgccagtctgttgtttcttttttgttaacttcaagcaatgccagaataatcatcacaatgatgaaaattgcagcatatgttttgaaagttttattcatggttactgttgttatggtttaaatgcctgatattgctttttaaatttctgatagctctcttcttcaatactgaattcgccataccagacataatcaaaaatataagacaggtttgaaaaatcgtttttcagatgaggagtttttaactctgcggaataatctttatttgtcttttcaggattccagctgatcagttttttgtcgctcagctttttaagaataaacaggaactgataacgtattgcagaacggtaatctcctgacagctcaaattgggcaatactttccgggaaattgatctcatggatattctcatgaagctcctgcacattgatatccagttttttattctttttaccgaaaataaaattcccgtcctttcccatgatgtatttaatgatgaaatacagcaggaagcctaccagaataattgcaaaaaggcggataagaatggtagtgaattctgcagacttagtcatagctgtttcaccaaaaatcccctggataatctggttgatttttctcatcagcttttgaaagaaagattctctcggttttgacaccgaataatcgaactcatttcctttatatcttgaaggaatattgtctttaaaagtcttcggataaacctcattctccgataccggatttttcatcaatacagagtctgcacgcagcatatttctgtaatgcccggttgtatataaagaatctaccagatcatcagaagtatcatcctgagcatgaaccagcccagaagaaaagaaaagcagtaagaaaaaaagaattctattcattgattccgatagtgtctatttccgcaagttctactttctggtgaagatctgttctgctgtcataatacatcaatcccgcattaacatacatcagattggaaagaaaaaaagaaagcagcattgaaattccatagaatacaaaaaacaagatgcctgcagttcctgtaaaaggattctgttcaaagtttccatccggtgtagtggtaagaagagatccgtaaaaaaacattatcggaatgaatgtaaaaattgacgtgatcatgtaaataataatgaacatgacaaatgcagctccccagtatttccagtagggagatttttcactgccattcggataggaaaactgcgatcttaaagcatagctcaagcttccccaaaaacctctgtccgaattaaagtaatcatacatcagaaatgtagtgaaattaaatattgtgggataaagaagcagtatcaaaaaaaatccgataataataaaaatcagaatataagaaaagcctaacacaaataaaattgccggtgtgacgataaagatcattccaaggcataatttagctattctcccggcattgttcttaaaatcactcagaatttcatctgtttttatcttttctgctccctgtgcaattctttttaaataaaaaaccggatacaggtaattcacgatcattaaaaccatgaaaagaaggaaagtcagtaatccgaccgtaatcagcattccggaattttctgaaaaatactgttcaaaataataggtttcaccacccagattagatccgaatatctgggaaaaaagctctttatacccgaaaatcacaacagtgaccattaagatcaaaagcaaaccattaatcaggatgtagtttttaaagtaattcttaccgtataatttgaaaaaattgaagctatcacttataaaagttccaaaatctctttttttataaaattgtatcattgatcagtttattagtttttttgtaaacaacagacggatatacaaaatagtagtatccaataattgccagtgagccaaaaataatgataaggttcaaaattaaaggcatcttcaatgcgtgtctggtgacatatccttctataattcctgcacagatagtgaaaggaaccgtactcaaaaatattttaaatgaatctttaaatccttttttaaaagaattaaaccttgaaaaggttcttggaaataaaatagaggctcccagaatcaatccacacatggcttccaccaccatggcaaaaatttcaaaaaccccgtgaagccaaattcccctggcactgtctttcaaagctccataatcatagaaaaagtattgaaaagctcccagcatgacactgttcgagagcagagcatataacgtccctactccacccgcaattccgtaaatatataactttgcacctacctgaatattattaaatataatcccgatggtacttccccatgtacttccattctgataaacccctacagcattattacttttaatattttcaatggtttcattcacatatccttcgcccagaatgatattgacaaagtctttatcataaactgcagaaagaacaccaattaaagtaaataatatgaaaaagagaaaggcatacataagatatctccggtaatggtatatcagcagcggaacttcagttttgaaaaagtaaaccagcctgttctcttctacccttttggttttataaatcttctgaaaaatctgtgcagacaaatgattcaggtaaactgttgtgttacttttgggataataggtctgggcaaaagaaagatcattgatcaggtttatatacaacgaagacaggtcatcaggattttttttaattttcccttgaataacctgttctattcccaaccatttttctttattttgtttaatgaaataaacttctctcataattgttaaggctaaaataataaaaaatatgtctcaaatcgcgataaatacctcacaaaatgtaaatattaattttaatattgcaggtgtaggagaaaggatgctcgccttcattattgatcttctgatcaggattgcctatgtaatgatcatcctgtatctgttcttcaatattttcgatctgggatatttattagatggccttgatgagtggtctgtaagagctgtatatcttattcttacatttcctatctacatttatcctcttgtcctggaaagccttatggaaggccagactcccggcaaaaagctcatgaaaatcaaagtagtgaagattgacggttaccaggcaagttttgcggattatatgattcgctggatattcagaattgttgatgtttcctttgctggagtggtaggacttatctctatgattgtttctaaaaacaatcagcgtttaggggacattgcttccggaacagctgttatttctctaaaaaacaacattaatatctctcataccattttagaaaatatccacgaagattacattccttccttcccgcaggttattgccctgagtgataatgatatgagaatcatcaaagataattacactaaagcattgaaagccgatgaccgccagatcatcagtaaactgtctgataaaatcaaaagtattctgaagctggaaatagatcctacaaaaatgacggaaaggcagttcatcggtataattatcaaagattataattattatacgggaaaagataattaggtaggtcaatggtcaattttgcttcgcaagtgaatggtcaatttgaaaagtattaagcgagatttatagcaacacttattgcttattgcttatgcaaaggtcggttcaatttttgtatattaaccataaagttcagaatcatgaaatttgaaaacaataaatccggaaacggcggagttcttactttaaataacgaaataaaagaagtcggcagacttacctacactattttccctgaagaccacaaactgattatctcttttgtattggtacatccggaatttgaaggcaggggaatgggaaaatttttagtggaagaagctatcagatttgccagagaaaacaattggaaagtatatccacactgttcgtatgcaagatctgtgatgatgagaatgagtgatgtggacgatatctttttaaagaattaaaacttcattgaccaggatatcttcaatatcatccggataatccactttaagatgatgatcagaagctacccattccataatttcattaagatttaaaactttggaattcgggattcccatttgatcaagggcacatgcgttacattcctgttcatattggttatgaataggaattacaaacaattttttgtccataaataatgcttctgcaggagtctcgaaacctgcattacacaaaattccgtcacagccttcaaaatacttcagatactgcatttcatcaattggaaatacctccacattttttactttaacctgtactgtgctgtattttgaaaagactttccattctacaggaatttttcttaatactttaatgatgttttcatccgcaaaactcggaagataaacaagataatatccctgtttataaggattaagatttcttatttttcttctgatcacaggctttttgatctgtggatgataattttcaaaatgaaaccctatttttctttcactgggaacataatattttaaaatcatttctcccagaaagtctcttttctttggttttggtgttttcggaaagctcatggaagcctgatggctgagttctatcatgggaagcttcttaagcttggaagcccatcctgtcaaaggttcataatcattgatgattaaatcatactgtgaaagctccaattctctgattgtttttgcagcttcaataaatttattctctgtaaacgttttccgataggataaaccgcctgttttattataaagtaaggaaatacctctgtactggaaatcaatatcaaaatcagcttttaactgcgattggtgtccactgatcaatgtatcaaccgatgcatgctttttgaggagaggaattatttcctgcgctctggccacatgtccgtttccggtaccctggaatgcatataaaatcttcatctaagagaaattcgttacgatttttaaaagtgcagaattatccatttcaggaatttcttccacttcatcatctttcagcaaatgtttatgctcgtcataataaaaaatcttccattctttatcataatattccaaagcagagagattttcaatccagtcacccgaattcagataagtacatgatccttttttagtaacaacctcccggatttgcggctggtgaatatgtccgcaaacaacatagtcataatgattatcaatagccaattcagaagctgtgagttcaaaatcgccgatgtattttactgcttttttcacattgttcttgatctttttagaaaatgaatacttctccttccccatcttctctaagaaccaatttacaacattattgataataattaatagatcgtagccttttccgccaagtttggcaatccattttgaatgctggactgatgcatcgaaaacatcgccgtgaaaaatccaggtttttttctgatcgatattcagacagattttgttacagactttaagctttcccagttcaaaatctgtgaacttacggaacatttcatcatgattgcctgtaatgtaatagacatctgtgtttttggtagcgaatgaaagtatctttctgattactttcaagtgaggtttagggaagtaagactttttaaactgccagatatcaataatatcaccgtttaaaactaaagttttaggctgtatagaattgagatatctcaacagttctttagccttacatccataagttcccaaatgaacatccgatataacaactaattcaacgtttcttttcatagttttatacaaagaaactaattgaaagttaactatatatgaatgctatattattttttataaagagttcatcagctcttctgtgatttccatgttgtggtaaacgttttgcacatcatcgtcctcttcaaaacgctcaagcattttcatattcgctttgaactgttctgcgtttacttcttttgtattgtttggaattctttgtaattctgcactctttgcttcaatcccaagctcatccagtttgtgagacagagaaccgaaatcttcaaaagctgttgtaatcattacttcttcttcatctttttccacatcttctgctcctccgtcaatcatttccatttcaaaatcatcccaatccattttgatctgtgcaagatcgattgtgaaaattccttttctatcaaaaataaatgccagctcaccatttttccccaggttaccatcaaacttattgaaaaccgctcttacgttcgcaacagttcttgttgtattgtttgtagtacattctacaaaaaaagcaacaccaccctgcccgtagccttcgtaagtgatttcttcatagttttctgcgtctgcaccacttgcttttttaattgctctttctacgttatccttaggcatattggcaccttttgcattctggatacatcttctcaatgccgggttagattccggatcaggtccgccagcctttacagccaatgcaatatcttttcctattttagagaatgttttggccattttatcccatctggccattttagaagcttttctatattcaaatgctcttcccattttaattttttaatttacagcaaaattacttaaaagtcaacaaaaaaaaaatacctccaaaaaattggaggtattcattatttagaaaaattaattattttttctttttagcagcagcttttttcttagctggagcttttttagtagcctttttagtagcttttttcgctggagctacaacatcagatttctgatatttgttccactcactgtcatcaccaatgtatctaacagttacttttctatcagattgtctttcagcgtcagatgcagattctgcaactttagcattttgctctccaataccgattgatttcaatacgttagtatctacacctctcgcatctaaagcagcaactacagaagcagctctttctttagataacttcaagttgtaagcatcacttccttttttgtcagtttcaccaactagtaggaatctacctccatctttcttaatgatttcagcagctgtatctaaagctcctttagattcaggcttgattgtagctttgttgaaatcgaagtatacgctcttaaggtttttctcaacatcagtagctgttacttcttttggtttaggacatccgttgtattctggaagacctggaacagtaggacaagcatcatctttatctaggataccgtcaccgtctgtatctggccaaggacaaccgttgttttcagcaggacctgctactgtaggacaagcatcatctttgtcgattacaccgtcaccgtcagtatctggccaagggcatccgttgttttcaactggaccagccacatctggacattgatcgtctttatctggaactccgtcaccgtcagtatcaggacatccttggaattctggtaaacctggagtatctggacaaagatcatctttatctaggataccatccttatctctatctctgtttccaaatctgaataagatggaagcagaagcttgccagaagttagcaacagtagatttgtcacctggagttgatacgtaatctccctgaataccaagaccgaagttcttagttacccagaagttagcaccagcacctgtagctacagtgaagtggttagctttaccgttttcgttaccatccttaccgtttgttacagtttcgattgggttaccgttagcatcaacagatgttctagggaaagtaagagctgtatagtcatgtcttaagtagttagcaccaactcttaaatatggatcaaaccaagattcttcgttccataaaagacctgcagcgtgagcctggaaaccaagacctgtcattaggaaaaattctttccccatgttgaatcttttgttttcaacatttccaacagaagtttgccagtcaattactaaacctttaccaatgtttctagcaactgttaacttagatagtggaggtgtaatagaaaagttgttcacattgaacatactttttgtcaaattgttagcagagaacgtattactgaagttacttcttgctgctacgtggttttcagcgtgagcaccaactccgatcaaccacggattgttggtagtctgcgcgaaaacagtagaggcaacagtaagcgccaatgctgaaattcctaattttagatttttcatagaattaaatgattaaataattgataatgcaaaataaatataatttttctttatatacaaagtttttcaaatgatttttaacttttctttaatattctgtccaggttccgtttattttctctatcttttatcgcctctcttttatcgaaaagctttttccctctacccagcgctatcagcacctttgctttacctcgatcagtgatatataattttaaaggtatgatggtgttcccggcatcctttaactttttttcaagtttttgtaattcttttttgtgcaagagcaatttccgttccctttttgttttatggttgtaaaaagttcctaatttatactcatcaatcatcatgttgatgatgtacaattccccatcaataaactgacagaacgattctgtgatagatgctttggatgaacgtaaagattttatttctgtacccgtcaaaaccattccggcttcgtattcttccagaatttcatattcaaaacgggctcttctgtttaatatattaactgttttctcaatcttcatcattttaaaatttcgttaatgaaatgtataaaaaataccgtacatttaaaaacttgactattatattattacaaaatacccaaattcttttcgtatttttgcgccaaatttacaaaactatatgttaacagtatctaacttatctttacaattcgggaaaagagttctttttgacgaggtaaatattatgtttaccaaaggaaactgctacgggatcatcggagcaaacggtgcgggaaagtctacattcctgaaaatactaacaggaaagcaggatcctacaacagggcatgtatctctggaaccagggaaaaggatgtcagttttggaacaggatcactttgcttatgaccagtttactgttcttgaagcggttttaagaggtaataagaaattatttgagataaaagaggaaatggatgcgttatacgcaaaagaagatttctctgacgaagacggtattaaagccggtgaactaggtgtaatctatgatgaaatgggtggatggactgcagaatctgatgcgcaaaccatgctttctaacgtaggaatcactgaagacatgcactggcagctaatgggtgagcttgaaaacaaagacaaagtaaaggttcttttggctcaggcacttttcggtaatcctgatgtattgattctggatgagcctaccaacgaccttgacattgataccatttcatggctggaagatttccttgctgattatgaaaacactgtaatcgttgtatctcacgaccgtcacttcctggacactgtttgtacacacattggtgaccttgattattccaaacttaacctttacacaggtaactattctttctggtaccaggcatctcagctggcaaccaaacagagagcccaggccaacaaaaaggctgaagagaagaagaaagaacttcaggacttcattgcaagattcagttctaacgtagcgaaggcgaaacaggctactgcaagaaagaaaatgatcgataaattaaacatcgatgacatcaagccaacatcaagaagataccctgcaatcattttcgaaatggagagagaagcaggagatcagatccttgacgtaaaaggtcttgagaaaacaaaagacggagaattattgttctctaacattgatttaaatcttaaaaaaggagataaagtagccgtactttctaaaaactctttggcaatcacagaattttttgaaattcttgccggaaatgttgaagcagataaaggaacggttgcatggggagttacaactactcaatctcatatgccgctagacaacacgaacttcttccaggaagacctgagtctggttgactggctgagacaatttacaaagaacgatgaggaacgtcatgaagaattcgtaagaggattcttaggcagaatgttattctccggtgatgaagctttgaaatcctgtaaagtactttcggggggtgaaaaaatgagatgtatgttcagcagaatgatgcttcagaaagcaaacgttcttctactggacgaacctaccaaccacttagaccttgagagtatcacgaccttaaacaactctttgtctaatttcaaaggaaacattctgttgtcatctcatgaccacgaaatgctttcaacagtctgtaacagaatcattgagctgactcctaacggaatcatcgacagagaaatgaattatgacgagtatcttgctgataaaaaggtaaaagaattaagagaaaaaatgtattcttaatttttaagaacatcagataaaaatcaaaggctgtcctgaaagacagccttttttatataaccctatttgttttataagcaccggatggtaccgccatcaaccctaattacagaaccactgatataatcggcaaaagggctgcaaagataggccacagctcctgcaatttcttcaggctccccaaatctgcccgtatcattaggaatgagctcctgtacagccttgtatctgatttcctccggatcggtaccccagttaaatttcggggctgcatttttaagccactcttcaaccattggattcataattgctcccggtgaaaccacatttgaggtaattcctgtatctttaagcgatctggcaagagaaactgacatattgtgacgggccgccaaagttgcattgtaatgaggctgctcttttatgggctgtatgcccagccctccaccaatatgtattactcttccccaacctaaatttttcatctgaggaacaatacgctgaatcatccgaacataggaaactacattagtattgtaaatatccagccagtcatcggcacttgcttctccccatgatttatgagaagttgctcctgcattattaacgagaatatcaatctgcccggactttaaagcttcagccgcaacctgatccgcgccttcatccgttgaaagatcacctacagcaacttctgcaatgcctcctttctctaatatggaatgcatcactttctctgcacgttctttatctctgccatgaataattacagaagctccttcatctgccagcatttttgctattgcttcgcccaaacctgagcttgagccggtaacaagagccctttttccttttaattgtaaatccattttgaactggttttaattgtttgatttttactgaaagctattttattttattcagtattttgataaagcaaaattacacagcacatcatgatctggttttgttggaaagctcaaatcgttttgttgaaaggtccattcctactggaaatattgaaaagaaatcaggaaagttgaaatcataatccaagttgatcgtattgcagggcctttttttaacatttacaaagtcaaaacttcgttgcgcttctgttcggaatgctattttttttccttatttttgtgaaatgagtcaaaaatggatttacaagcctgaacccgatgaggaagttgtggacagactaagttcgtcacttggttttggtacttttgaatctaaaatcctcgttctaaggggaattgacaattatcaaaaggccagagaattcttcaaaccgaaccttaacgatatccacaacccgtttttaatggcagatatgcaaaaagctgtagagcgtattgccaccgctattgaaaacggtgaaaaaatactggtatatggtgactatgatgtggacggaaccacagccgttgctttaatgtacctttacctcagcaagattgttgagaaaaaatatctggactactacattccggatagaaattccgaaggatatggaatttctactgaaggaattgatttcgccaaagaaaatggcttttcactaatcattgctcttgactgtggaatcaaggctcttgacatgatcaattatgcctctaatctcggtatcgattttattatctgtgatcaccaccttccgggcgaagagattcctaatgctgcggctgtgcttgatcctaaaagaagtgactgccgatatcctttcaaagaactttcaggatgcggggttggctttaagctttgccagggattgaatactatttataaattaccggaagctgagctatttgagcttacggatcttctggcgatctccattgcagcagatattgtttccatgacaggcgagaacagggttctggctaaaatgggattaaaaactctacggaagaccagaaatcttggcttaagattattgattcctgaagacaagctttctcattttgaaatttccaatatcgtttttgagatagctcctaaaattaatgctgccggaagaatttcccatggtaaagcagctgtggagcttatggtttctgacaatctgaagcatgccaaccagattgtaaatgacattatgaacctcaacgatgaaaggcgagaactggatatgaactccaccctttctgccctgaatcagattatagaatctcagcaggaaaccaaacatactacgatcgtttatcatcctgaatggaataaaggagtaattggtattgtagcctcaagacttattgaaacgtattataaaccgacacttgtatttaccgatggtaataatggtgaaatggtagcttccgcaagatctgtttcagattttgatgtacatgaagctctggatatgtgttctgaatatttccttaaattcgggggtcatcatgctgctgccggactttcaatggagaaagacaagtttgatgctttcaaggaaaaatttgaaagaattgtttctgaaaaaatccaggaacatcagaaagaaccttcgattaccattgatacggaaatcaaaattgatgagatcaacagagaatttatcaatttccacagaaaactggctccattcggacctcacaatatgaaacctatttttacattaaccaatcagaagctttccggatatgtgaaaaccatgggaaaagataacaatcatctgaagttttatattaagcaggaatctacgggacgaaatattgagtgtgtaggtttcaaacttggacagttcgtggaggattttaaaaataaaaattttgatctggcttttaccctggaagaaaaccattggaaaggcaatgttacccattatcttaatatcaaggatgtgaaattcagggattaattactattacctataatcttctacctgctacctgaacaaatgaaaaaaatcggtttatttttcggatcattcaatccaattcatatcggacatcttattctggctaattatatcctggaaaactctgatatggatgaactttggtttgtagtaagcccgcaaaatccgtttaaagacaaaaaatctttattgaatgaccataacagacttgatatggtacagctggcagtaaagaattatccgaatatgagagcttccaatgtggagttttctcttccgaagccaagctatactattgatactttaacctatcttcatgaaaaatatcctgattattctttcagtttgatcatgggagaagataatctgaagagtctttacaaatggaaaaatgctgatatcctgatcaaaaaccatcatatcattgtttatcctagagtatttgaaggtgagaaaaaagattcggaatatctacaacatgaaaatatttcgctgatcaaagctccggttatagagctttctgccaccgaaatccgtagcatgatcaaaaatggtaaaaatgtaagacctatgcttccgcctgaagtttttgaatatttggatggtagtaatttttatcaataagcaatgaagctatacttattcttattctctgtttttttgcaaggctttctatgcggtcagaaatcaacaactttaaaaagtgactctcttaaagaattacagaaaattgcttttgccgaaaggataagctataataaaaagcgctgcagtgaagattcaatcagggctgtaaaagcttcggaaattcaaaataaatattttatcaatattgctgctcccaatggtgataagtttttgcccggtgaagaactcagaataattttaaaaaagcataatatcatttggggcggagaatggatgggcagtgatatgggtggctattcaggtgaatgttattattctgtaatgactgaattgactgaaaaaaaattcggtaaagattttattgacggtctcgttaaagaatctgtagccatgtatgtaaaaaaacacccgaaaaaaatctttgataatgatgaacattgtgaatggacttataaagggacctacctcagttatacagatgataatgatcagttaaacaaagatttcttccatagttttatttatccggaaggttatgaaaattataatccttcttttcagaaataccgctcaagtactgtggttacactcattttagatcaaaatggaaaggttttgaaggatcaattcagccatcgtatttataatgatcacaatttgaagtatattccttattttgaaaaagaaatcaaaaagtttataaaatacactaaatttgagccagtaaaatacagaggatatcctgtaaaaagcgaaacatccttttttatcttctataaataattattcatgaactttattgaaaaatttttctcaaaatattctcaggaaaaaatcatcagatggtttaagcaaatttgtcttgcagaagccgtttcatgtctcttactgtattgcgttgcgatgatctggatccgatatgatgaaaatttatattctattatctttatcagtgttattggtagtttacatggattattttttacactttacctattactctgccttcctgccagaaaaatttataactgggatgatgaagattttgtttttgccttattatctgccttctttccttttgcaacggtttgggtagataaaaagcttgcccgattcgacagagaataaataaaataaaaaaggaccttttcggtccttttacttttacatgattagaaatctctctttacatgtcctgttgcagtgaaggtatgatttcctgaactatcggtgtacgtgccattaactgtaaaatcaatatagtctcctacagctccaaaagaggttatgtttacagtcatatttccattatttgttgtgatataacctcctgaaaattcaaacccataacctgtgttaaaactttcagcaactcccagcacattgatttgcttcatatggaaaaaaggtcctgcagaattcgttgagtttattatcaattgcttggccgatacaacaggcgacgtggtcgtcaaccctccccactttacatcaaacaatcccactatatttacggttggttgattatcaattttataactgatcaattcgttcaaagaattacaaaccatgatattccccaaattgactatagcagacggagccgtgaaagttacttcatgagtgctttgcaaattagcggcatcaaacccttcgtaggtaaactgaggatttgcagtacatgcataggtgttgaatgtaaagcctccggtactgtttactggtactgacatatattggaaatagtacatacccgccactggcttaagtattacatagccatcggtaacatcagtatttatacatgttttaagacttccctgaatagtataattgacagatgtagacgggtttatggcaatttcaggaattgttgttatgactccaaccggaagaggggccacattagaggtatataatacattattacaaatatcataaacttttaaaacgagaacctcacctgctggaacaattcccgagaccattcctgtattatctgtcattccgtaagtttcatatgcttgagaagttctctttaaagcgactctaatattaggtaaaacctgtcctgccgcgttttttactgttactttcaaggttgcctgtggaaactgtgcatcataattccaccaggaaaaatggcttactgttcctacataggtatttccgatctttgttgcagcaccttcttctttccacattccggtctcttcgttataagaccataatggtattgtagctggtgagctggaagtttgtacagcatccaccggaactgtaatttctgcagtatggccgtttgcaatctgaagattttgcccggaacttcctgttaattgtacatggagcattccaaaagtttccattattctggcattccctcctaaattggctgccaaaaaggatcccggcattaattcattaagatattggttggacggagccaggtgaaaaatcccgacactcacatttcctgaataagcatttccgttagcgtctttaaaactcccatcaaattttactttggttccattgggcagtgaaactgtagatgcagagcccgtcgtaattgtagaggtaactgttgcaggaatcatcatgatgttcaccctgtttattccatgagtaggaaccaaaaccctggatgcatttacataaccggcctttgtcacttttacatgggcaaaattttcttttaccgaaacatttttaaatgtgaagaaacctctaagatcggttgtaatggtacttgttccgatggtaactgttgctccggaaaccggatttccacttgtatcaagaattattccctggaaatttcgctgtgcagtatttccgaaattataattagatggaggatttattgtttcatctcctgtttctaataaagattcatttttacatgaaaataataatacaagtaataaaaataataggtaaaattttctcatatggtattagtttttaatttttactaaattaataataaaagacaatcgcaaacattttttattttatttcttcatctttttcaaaaaattcttcaatattttttgatttggtgtaacatttaacatctttcatttgtcttattatacagaaagttcaaacaatcaatattttaaactaaatttttattaactgataatcaattgattacaataattaaaaaatatttttaagtactttgtattgcataatactaaatttattatatatctttgtaatgttaaataacaaaccatacaagctattaattaaaaaataatatcatgaaaactcaaattcttattgcagctctatttttcggcggacttataactgcccagcagaaaaaagacagtttgaaagtaaatgccattgatgcagtgactctcaagaagcaggttttcaaaaaacaaggtgaccgtttggtatatgatgtagcttcttcatctattgctaaaggaaccaatacttttaatcttttaaagcagacgccgatgatttccagtattgatggaaaaacattaaagattctgggaaaaaatgacgcagtaatttatatcaacaataagaaaaccaatatggattctgaggcattgattgaaatgctgaagtctactccatctgaagatattcagaaaatcgaagtgattacagttcccggaagtgaatttcaggttgaatctaaagaaggtgtcatcaatattgtaatgaaaaaaagcaaaaacaacggttacaacggaacgttgaaaatgcagaacgagcaggcttattacaataatcccaatgccggagcttcttttaacttcagacaaggtaaatggtcggggaactccaatttcagaacgggaagctggacagacagacagagatatacgctttccaacggagattctactttcaaaaatgaatcattcggatttaatgatgatccgaacaaaaattttggtggaggcttcaatatcgattatgagatcaataaaaaacacagtcttggattctcctacaacatgagatacaataaaagcttcaattctgtactggacattaccaacttgcaaaacggagtattgaataacagaacagtcaattatgaagatgcacagaccagaaatcactcttttaatctgaattatgagatgaaaacagattctttagggagtaaacttacctcaaacatttcttatctatggttcaacagggataaagtgagctttaatgagagtttacctttaacaaatgatacgattaataaatattctgcattgcatcaggcggtaccacagatcatcaacaattatgcagccaatatcgattatctgaaaaagacagctaaaggagccacatggttaatgggaatcagttacaatcacaccaacacagataacgatacccggcaggataagctgaaaaaaggagagtttatcatagatcccaatcaaaccaaccacttcatttataaggaaaatatattgggaatttatctgaactatgaaagaaaacttactgaaaaaatatccggaaaaattggtgcccgctacgaaatgaccagaagcaccggagacattgtggataagacaggttttgaaagaaattacaacaatctgctgccttatctgaatttaaattacgctatcaattccgatcataatctgagctacactttttccagcagaatcagaagaccgagattctgggagctgaatccttcaagaacctactttactccaaccaattatacacagaacaatccatttatactggcatcaaagtattataatcaggagttaaattatatgtataaaaatgcattctatgccaatcttagtttcaatatggtggaagatgcagcggcttcagacctgattccattgcagggaactgtaacggctccccaaaaagatgctgaagggaacatcataaaggacatcaaaggtaatccaattaaggaaaccaccagatttttaaggtatatcagaaccaattatggtaaaaacagggagattgctttaactcttggaatgaacaaatcctggtttaaagacatatggaccaccaactattctgtcaatttaggatatattgcctacaagggtggagtatttgaagatcctactgccatgccggccccgggagaaactgaagttatagatccttatatcattgatgttaaaaactataatatgtctgtaaccatcaataatgttataagactgtcttcaaaaaaagactggttcctgggtgttaattacttctttgccagccagaccgctatggaagctggaatgataggtgcaagacagagttttgacttcagtctgaaaaaaattgcgggagactggactatcgtagcagaagtaagcgatctgtttaaccaaagcttttacagcattaaaggggtacagcctaatggaaaatttaacaatatcaccaacttcaactatccaaggttaatgagcataggcgttacttacaatttcggaaatcagaaactgaaaaaagcaagggaaatgaaatcagctaatgatgctgtaaaatcaagaacctaacctataaaaacttatttcactaaatccactcttaaataaaaacaacatgaaacgtataattttgtcaatggctcttgtattcggtacctgcgcatttgctcaggaaaagaaatctgatacggcaaaaacaaaaaatatagaaggggtaaccatcacaaaacaggtttttaaaaagcaaagcgaccgttttgtatatgatgtggcagcatcacctgttgccaaaggaaataccacttttgaccttctgaagcagactcctttattatcttccacagatgataaaacattgaaaatcgcagggaaaaataatgcgctgatctatatcaacggaagaaaaagcaatatggattctgagtctctggttcagttcctgaaaaatactccggcagaaaatatccagaaaattgaagtgatcacggttcccggaagtgaatatcaggttgaatcatcagatgggatcatcaatatcgttttaaagaaaaaaatgagcgacggtctcaacggaaacatgagaatgtctaataccaccaataagtacaacggaagtcaggcgagtttctcggccaactaccgaaaggacaagctgggagtaagtgccagtcttagcggtggcgaaaatattgaagcacaaacgtatactctgagaaatggtacagccaaaacatccaatgaatctacaggtgatattgatgatccgaacaaaaatatcgggggttatctgaatattgattatcagcttaatgataaaagcaacctcgcattatcatggaatacctgggcgaataaaagctataactcaacggtagatttattcaataccattaaaaaaacagatacggaatatacatggtccaaaaacagagaagattcaaggtcttacaacaattctgtcaatttgaattatgaattgaaaacagattcactaggcagtaaactgaatgtaaatgctgcttacctcaactatagaagattccagtttacagataatcaaacttttgcttcagatatcaacagaaatgtgggaggaaggaaaacacaggtgcttcaggatcttccgcaaattattaataatttctccggaatggtagattacaatcagaaatttaaaaatgatcttaccgtttcagttggaggaaactacaataaaaccaaaacagacaacgattctaaaaacattacttattcttttaatcccctaacatccccggattcaagacccaaccattttatttatgatgaaaacatctacggaatgtatcttaccgttgagaaaaagatctctgacaaactttcaggaaaaataggagcccgatacgagatcacaaacagtttgggaacttctgacaatgctcctacagaagcgcttaaaaggattgaaagaaactacaataacttacttccttacctgagcctgaattatgcgattaatgataaaaataatatttcatactctttttcaagcagaatgagaagaccgagtttctgggaacttaatcctgtaagaaacatcctgacggaagataattacactcagaatgacccgtttgtaaaagcttcctctacctacaatcaggaacttacgtacatgtacagaaattcgtattttttgattttaaaccattcttacattcaggacgtgattacgcaggttccgcttcagggatatccggtatcgccggatggtaaaattggagataatcctgcattgagatatatcagaaccaattttgggaataagcaggaaatgtctgccatggtaggtattcagaagtcgtttttcaaacaatactggacgaccaactttaatatcggagtacagcataacatcaacaatggaagtcttgataccgatcctactacgggagaccgctttaagaatgataaaggacctaacggaaattttattacctacaccaataaaacgaattctaccagtcttctgatccagaccaacaacaccatccgtcttgataaaaagaaaacatggttcttcggagttaattatttctttgtagacaagcagcagattgagcttggttccctgaaaaacttaatgagcttagatctcagccttaagaaaatgtggaacgactggacttttgcagtgaatgtaaatgatgtcctgaataccaacattgtgaaaattgaagacttccaggaaaacgggaattacaattatatccaccaaaaccgctataacagaagtctcatagtaagccttacctataatttcggaaaccagaaagtgaaaaaggtaagagacatcgaaggggcctcagatgccatcaaaagcagaacaagataagattatctttcttcatatttaattattcttacggtatccgctgattcttttcagcggattttttatatttaatcattatgaaaaaagatataaaaattattttgatatccctcagtctcctttttctatggacaggctgcaaagaaaaaaagataaaacttagccatgatatccattttgataaagaagaaaatattcattatggaaagagtgctgaacaggttatggatctctatattccatctacacgaacaaataaagaaaagaatgtttttattataattcatggtggggggtggagagcagggaataaatcgcaattaacctttttcacgctctctataatgcagaaatttcccgatcatattttcgttaatatgaactacagactagcttcagctactaactttggacttccaaaccaaaccgatgatattaaaaaagtaactgaattattaaaaaataagctaggctacaatccaagtgtgattttattaggcaacagcgccggagcccatttatcgatgctgtatgcctacaagtttgatgcagataaaaaagtaaaagctgtaattaatattgttggcccggcagacctctctgatccgggtttcaaaaattatcaggagtattcttttgtggaaagcagacttgtggatcctgaaacaattaaaaccggaatatcaaagatcgattttgccagccctgtgaaatggataaaaagtgattcccctcctactttgtcttactatggaagttcggatcgtgtaattccttctacacaggaaaaaagacttgattcagccttgatagccaatcatattatccatgaatcttatcaattcaatggaggacatctggattgggataaacatccaaatgatctgtttcttattgataaaattgaaaccttcattaaagaaattgacaaaaaataacacgttctgattcttcaaaacgtgttatttttattttaaaattgaattttattcagattttgcaacggctgttctttctgaaactccattggcattgaaagcttcaatctggaaatagtaagcatctgtcctgtctgcacctgtgaagaagtattcattcttcccgtacaccatgatgcttccgtacaatttatccggagactttccaaaataaattacatagccgtctgcatcaggattctgctgccatttcatccagatacttcttctttccccatatttctttggatcagctcttaaaggtacaaacccctcaacctttgaaggttgtttccctgctccttttccaaacactctgaaaccgcttaatgcaaattttccggtaggcattttcagattttccattttcaggaaacgggcttttgccggtttttccaactcaacatagtcgtgaggaacatctttagtgtttttgcttttatccacaatcacattccatttcttgccatcattagaaccgtagattttatactgatgcatttttccaagggttttccccatgaattcagcatcctgatccgcgtaattgatctgaatggcattgattgtagaaacttcacccagatccgtctggaaccattccccggaatttccggtcttagcactccaatacgttttgatgtcctcatctaccgcatagttaggctgatatccacctaaagtagatgaaacctgaacgggtttattataattcaatagcatccatccggcaaaaagacctttcgtaaaatcttttccctgtgcatactgcggaaggtaagtaggataatcgccataagcggtattacagtacatcacatcatctttatcgaaacctgccggccatattcccagccttctttcaaaattatttttagtagaaataaaaattgtggaaacatgccaccagttcttgtaattgtcttcaaacgttgctccgtgccctgcgcctctggcaaatcctcccggtttataagagaacggattatgctgctgatattcgaaaccttccaaaggatttttactcacatacactccatcagaatacccactgaattctgttgccggagcgccatactgcatataatatttcccgttatgcttcgtcatccatgctccttctacaaaaggctgaagaaaaacattatcattgtattccccaaacctttcccaaccatgatcttcaggttttagcttaataataggttttacgaaaccttcggactgaaggtttttcacttttacttctgttcccagcaacggccattcgttgctcgagccccagtacaagtacagtttatttttgtcttcatcataatggaatgcaggatcccatgctcctacttttaaagtatccactgctattttccagtcatctttggttgggttggtacttttccagatcggaaaatcctgttcccaggttgagccatacacgtataaagtatctttcatggcccaaactgccggagcattaagatcatgaatgtatttattgtctctgagaaatttccttttcacaaatttccagtccagcatatcatcactgtaccagtatccttcctggttggtagagaaaaggaagagtttatttttaaaattaacaatcaccggatctgctgttgcacggtgttttccctgttttgaaaaaacttcgaagggagtataaccataatcaatattgataggattacagaatgttttctgctgagcccctgcaatcattccaagaaagattgctaatgacagaaaatattgtctcattttcagattttaaacgttccgggcaaagttaattaacttttttcggttttctccaaataaagccatccagaagataatgagtaagctgcggaacaaccaataaaggaaccagaaactgaaagagattttctgagatcatcatattcagggaaaagtgttcattccaaaccaacgtttcccataaaaattcttccagaaaagcgaacaataaaatgacgccgacaaatagaaatatccctgaaaaagatttaaaaatctgcatccggttcagctgatgattttctttttgctgtatttcccggatataaatcaatgcgatataaggaatgccatgagaaactacattcagaaaagtaaacaaaagatcattgttgaaataaacaattccaaaataccaggaaagaaaagttccggtgatcaacgctgttttaggaatattaatccatttggatttaaaagcttcaaaagcagttttaaaaagccaaatgatcaggatggcaaagtagattgcagtaagtaaaggaatgtaatccggaagattctgaagccagtcaaactcattgttgacaaaccaggtaaaggcacgaggtgttttaaaccaatacaacatcggataaatcgttgcggagtaaacagcaatctcatctatttttttactccagttgcttggttcaaaacgggcatagattcgcataaagccgtactgctgcctaataaaatgaaaaacggcaatcaatgccagtactgaccagaatgtcaggctgcccaactggaacaggatcattcccaagatccagctcaaaacaggaattcccagatacagcagcttatttctctgtacctctccttttacaaaataggttttaaacagtgtggaataaacgtgggcaacatcaacaaaaacaatcaggaaaagccatgtgtaaaaggaataatgattttccagtatctgaatctgtttctgaaaaaggaagataatcagcagcaccagaaaaggtggtgataaaataaaccaccagtctgtttttgcgttatgtatccacggctgtttcatagtattatattacatcatttgttctgcagtccggagcccctgatagaaagcttcttcaaaaatagaaattcccgacagatcagaatgggcaaagaaaattttattttctataggttcttttgcttttctggcttcttctccaaaaatctggttaggaacaggagcgatcatcgcatgccctattttatgaaactgcatttccaaaatgaaatcttctatcaacggatgtgctttcttcagatcatccaaaactaaatctttcagttcagattccttcatgccgtagagttttttccttgcttttttacagtccgaagttgaaaaacttttatagtgagtaatcaccttttcaccgataatctggttgagattctgatgctggtcaaaaatataccccaatcctgaagaaccatagatcacattatcccaggccagctcttcatctcctccgaattcatttttcaccgtaatggtggttaaaagccagggcacgtaatgaaaggaagatgcttttttatgattaaaaattctctcattcacaaattgaggtgaggcaaaaagtactttatccgcaatgatcttcttcgttttcttttgggtattatcaaaacttaatacctcaactttatcattgatttttacatcaaaaaccagatttcccggcatatgttttccctcggtgtattttgaaagatgttttgccagtcttacatttccttccggccatgtgaatacctgatctttatatattgtactccagttattctttcttccggcaaaataatgtattcctgcccatgcagaaacgtagtctattcctaatccgaaatcgtccctgctggaataatccagaagccagagaagttcttccgaccggtagttattttctttcagccattctttaaaaataattttttcaagctttactacctcatcttctctgctggaatcatgtacaggaatagcaaaccaatattttccctccgcatccttcttgacacggaactcgtccatcagcttaaaaaagcgggtaagctcctgctgagtttgtgctgaaattcctctttggggaacaatatcgttctgccaggaatttttataaaataatctttcctgctgaggaaaagtcatttggtattcatcaagaataggttctccgttttcttccgctcccaggcagattttacattctttcaggaattctatgatttctgtattctctttgttcggtaacggtaaataatgggcgcctaaaggaaattttgaaaatgagttttctccgttggaagaattgccgccaagatgattttccatttccagaagaagataatcattttcatgatgctgactgaaaaatctacacgcagaaagaccagagattccacccccgacaataagatatttagtgtggataacttctgaaaactgtggaaaatcttttgcccaaagcttatgccctagtacatgattcgttccagtgatcttcagcagcaaagttttaactttctttccgcaatactgcaaaaagggaagcataagactacctaaaaatatagttgtgagaaaatcttttctactgtactttcccccactcttcatcgaaatatcggactaatatctggttatccagacggttaacttctacgtctttcaccttcatatctttattgaaataagacatctgtgaaaagttgtaatcatagtatctcaaaccgggaagctttctgtagattctgttgttgacgggttcaaatgaagccatagaaaatccccattccccaaaagacggaacgtaagtgtgatatgctgctgtaaaaggaaaaatctgatggattgttttttcaatacaccagaaagatttcggagcaaaatacggagaggtggtctgaactacaatcttggtatcaagagttgtcaatctctccagttctttataaaactgtaaggaataaagttttccgaggctgtaattggacggatccggaaagtctatgataatgacatcaaacttctttttgttctcttttacccagatgtaagcatctttattgatcacttccactttaggattggagaaagaactttgattcagtctgcgcatggtttcattggttttgaaaaactgggtcatctctccgtcaagatctacaagtgttacttttttaacatctttatattttaatacttctcttgctgcaaaaccatcaccgcctccaagaatcaggacattatctatattttttgccatcgacattgcaggatgtaccaaagcctcatgataacggtattcgtctgtggatgaaaactgcaggttgttatttaaatataaacggaattcatgagtgtttctagttaaaacaattctctgataaggagagcttttggtatacactacattttcaccatataatttttcttctgaataggataaaatagtatctgagaaaatgaaaagtcctaaaagaaatgcaaatgctgcaagagattttactttgagcgatagcggttttgataattcctttgtaagataatagcacaggaatatcgcaatggaaatattaatcaatccgaaaaacaaaggggttttgacaattcccagcttcggaatcaaaaccaatggaaacagaatagatgccagtaatgccccaatataatcgaatgcaaagacatttgaaactaaatctttaaactgcaccctgtcttttaaaatattcatcagaagcgggatttccaccccaaccagacatcctgtgaagaatacaaacagataaagaacactttcaaaatgggcgagcgtattaaacagaataaacagcacaacagagctgattccccccacgattcctacaagaatttcgatctcaatgaatttatcaataagatttcctttgatgaatttcgcaaggtaggaacccactcccattgagaacaggtatactccgataatgaaagaaaactgctttacagagtctcctaaaagatagcttgccagcgctccggccaccagctcataaatcagtccacatgtagcaatgacgaatactgaaaacaataaaagcagctcaagaggaatcctcttcttatccatgaattgccgcacttataatcattgaaattccgataataaatgcaccgaagacaatagcaattgctatatttttattccgggcgatctcatgccatgttttttcaggagtcagtttttcaataatgaaataacatgcaagcaaaatagcgattcctaaaaatgaataaagaaccgagtttagtatgggtaagaaattgatgttgtccatagttttatattttatttgtgataatatctgtagaatcctactctggaatgacttcttgtggttccgtcgcggtatgtttctgtcttggcacagtcgcagacctgattgccctggtatgtaaggtatacaaaccaggtcaggcagaatcctccgatcaggcagagtatccagttttttcttaggtaattggttatattagttatcatcatttgcaggataaggtgagtttgaactatttttccatttatttacattaaagtaatgttttcctatccacattgccacaaacacggcaatcattatgaataaaataatcccgaagttccagaatgaaacgggaagccatgtagctttgagttgtacataggtattgcttgaaatggggtctgtggtaagtttaagtgcttcagaattaatcagggagtccagcttttgagttccgaacgatgctttggcaagtctgatcacttccgaggtatctttttccagcgtctgcccgtctgtaaaagttttggtctgcaccttgaatatgtcagtaacctcaattgttcctgatttatcccgtgatatcatgacctttgaatcaggcgatgtaaggcttgaaaatgacggcaagcctccttctttttcagctgaaataatgaaatgatattttccggagcctaccccacacaggttaaaatcttcagactggcttccttccgtccagctttccccgccttcgtacccatgatactgttcaatatctttggaggtatagataatttcgttggtattttcgttcacaaggcttagctgaacattcgcccaggaattatcaacacctgaaaaagcattcacttttaatggggccgaacctccggaaagggtaaagcttttgctgaccaattctttatcttttacatctgcaaaattgatggtctctgcaaaaacggtttcgttggttcttgaagtgtagacatacatctggagcaaacaaatcattaatgcagccacacaaaagatgttcacggcttgtctgatatcgaaatagtagggctgaacaatccctattcctgtataattgggcagattagctattttaaaagctttcttaacttcatattttgaaatgtgaactccatagaaatactggcttttcttagcggtcttctcctgagagatcatgcgggttccgttgacatattctttgtaggtcgcaatggtgaaatccagatgttcatcaaaaaatccggctgcagcatcaatagtgcatggagtattttcgtaccatcggtaggttcgcccgagataggttggtaattttgaatctttacctttaaaatcatcaggatgtatagagatcaggaatacccaatgtccatcgctctcactcaggaaagcatcatttcctttgctgtcttttaaagaatattctcgccagaaaatactgtttccgtattttttaacagtaatcgcaacgactgtatattccgtaccgtcaatttttcctttttgtccgacatccaatacaacattttccgttgggactttcagatgtttaatttttttgttccaggctacatcaatgagatgggagcaggtcatacaaacgtattcttcaacaggaaaggtaagatctaatatattttcggattcgcatgctgggcagacatagtgcatttttatctgtaaattttgtgtttttgaatggtattagctttaaaatactgaaccacctcatctgcaatctgctctactttctccgtattgtcctgagtataattacaaagaaatacatcaaaggtaagctgtttaaattccggccacgtgtggatacaaaggtgagattctttaaggatcactgcagaagtaaagctgttattctcaaaaatatgattggttactcctacaatttccacctctctggttttcagaatttcttctgtaaacatcagaaaacctttgctgtctaataacaaatcttctgactctgtttccaaagtcagaagaatatgtaaacctttacttgataatgggttcaattaatttttttggtaaatatattatttttttggaagaaaaacctcggcaagcatacatcttgcgcttcctccaccatttacttcaatggtattcaggtctgaatagataatttcgcagtatttttcaatagctgctacctgttctggagtgagagactggtaagcggtctggctcatcaccaaaaatttctcaccctctttattctgaacctgaagcatatttcccgcaaactgctgcatctgttcttctgagatctcaatgatttctttccccgagcccttgatagtttccactactttttctctttcaagctcatcgtcaatacaatcaaggcagattacgacaaattgatccgccacacacatcattacgttggtgtgatagatcggaagtctttctgttcctacggtctggaatgaatggaatacaacaggagtgaatccatattttgcacagaattctctgaacagtttttcatccagcctcaaagaaacagaaccatatgcaattttattatcgtgatcgaaaatcatacttcctgttccttccaggaaatggccctgggtttcaggaaaagaccagtcatcaatttcagtaacttcaaacccctgatctttgatactctcaataatatcttctcttctttccactcttctgttggaagcgaacatcggatataaaaccacttttccgtctttatggaaacttacccagttattggggaaaatagaatccggagtatgcggatccggagtatcttttatagtgatcacattgattccttttcctctcagctttccgacaaaggtattgaactctgccaaagcttttgactggatatcagaacctgtctgttctacctggaaataattgttttttgctgtttctgcgttgtaaccgaatgcaatcggctctatcattaatacggtatctgttgtttgcatttttttgatttaaaaattaaaagattgaaagattaaaaactcccactctcaaacactaaaactctcccactcaattattctctcacaagcggcattgtagagcatctcaacaatccacccattttggagatttctctgtaagggatttcttctactgtcattccccactcgtttctcaggtgattattcattctcgtaaatgctttatctgaaaccactacatcaggagaaatagagaaaatattagggaacatttcaaacatttcttcatcattgatatggaaacagttttcttctccgaaaatatcaatgattaggcggtaatcgctttcatccacaaatccgtttttataaataatacatttgtcttctcctaccggattaaatgtacaatccagatgcagaataccttcaaacggaactttatcatttttcttcagctccagatcgatgattcttttcttcggaaaatattcttttaagatttcaatggcatattcattggttcttgccgttttatagtttcggtaatcttcgctgaagcacgtcccaatgaaaaggaaatcatcccatacgattacatctcctccttcaatatgtgcagtttcgggaaggttgatgatctttctccatgctactttttcaaaaacacttttgtatgcctcctgctcatctgccctgtctgcgatcacattggaaatgatcattttgtcatcaattacaaaagctacatctctggaaaaaacctggttgtagtctttgatgatgcttggacgaagtacttcaacatcatacttttttaaaaccgcttcaaaagcgttcatttctttaataacatcctcttctttaggataaatgttgtgttcgattgagtaatatgactttgcgtcataactttcctctagtgtgggaaccggccccaatgaattaggctggcctagaactactgacttcagcctacccgtttcgtttttaatgtttagtctcataaagatttatgcaatactacaaatataagtaaaggtctctacctgtaaaacttttggattattttatgcattaaatttgtttggcaaaatcaccgctcttcaacaaaatttccctgtattttagccaactgtagtgaatagttccaaaaacctctgcaacttgctattttccatctgcataagaaaagaaaaacagataatcatattatttaatttcctatattagtgatataattttcgcgaaattataaacaataaaaacttaactattaacaccaaaaatcaaagtcatgaacaagaacaatccggtgctgaaaaatgcacaaaaattaggtagagatcaacaaaaatctgtaatgggaggcgctccaatctcaacagccagaagatgctgtgaatgggatgatgcaggaaactgttatatctggacatgtgacagatgtgtatgtccttaataaaaaagaagacctgctttttcaagcaggttttcttatcttgttctgttttcttcgtctgtcttctgggtttctttcacctgatattttgaacttcctatgttataactaagcgaaaataccagcctgctgctgtcccaccaatgggtaaaacggttatccataatctgcttatgcctgaattccaatcgctgatcataagaatcgaaaagattgttaaaaccgatttttgtgttcagtttattatcaaaccatgccttttgcactgatacatctacagtataccgtggtttaatactataaaggctgtttcctgttttagattcataagcaccaaatacatttacagtaaatcccttgggaagcgaaaatacctggttgattctcaattcgtaattataaatgttcaatgcaaaaacctcattcagataaggtctgaattcataattgtaatagcccgcaatctgactggtgatattccaccattttgtaactctcaccggaaagcttgtttccagcacagcaaagttccggtaaggaagattcgttcctaaatattccaatatatttgtctgcggattgtaaagaggataccgtgtcataacatccttttctttcccgatggtaaagcttgtcacccagtttttataccgataggttgctttaatctgactggtaaaggaaggcaatagatatggattccctatccagtaatttaacggactgaaataaaatctgaacggattaagctgcgaaaatgctggtctcgttatttttctgctataggaaagagaaagctcactggatttattaaaagtatagctggcgcttaaagacggcagccacttcagatagtttctggaaaccacagagtctactgtaattgctttggaaatactgtttgtgttttcaaatcttaatcctgcattgatctgaagatttcccattttttgtctgtatgccagataacctgcccaaatcttttctttgtatgaaaatatattgctcctcgaatgatcaaaaacgaaatgattgccaacagataatgtatcatacctgatattgttttgagtttctgaattgctgtattttactcctgcttcaatatcgatctcttttattttctgagatgcatctatctgtgcggtataaatgctgattttgttcaccagatcagatttccaatatgagagaagattttctgtaaccctatctttattgatgaaatcatcattctgtttatttttgactgaaagataattccctaaaaaaacaagcttaaatcccttattctgaaaagaataatcggttgtcatcccatagttatcctgagaataatctgtagggttttcactggctgtattcaataccaattgggttccggtcttatcagttgtataaagtgatccggtgcgtattctgtcattattccggaaaatacctctcagattaatgccaagccggtttttatcattcagattaaaatctgcacctgcctgaagattgtaaacttttccagcatcttcctgataggtttgagtacgcataatattggtattggccaatcgctgcaaggcgtgataacgataggttgaaattccatcattataacccgcctgcagattgtatgtcactctccctgtatgataagatatattgagtgcattttcccgatagttgaatttattaacataaatattcccattatagcttgctttcaagccaaggttgacattccttttcagtttgatatcaataattcctttaaattctgcatcatatttagaggatggattggtattcacttccaccgattctaccatttccggagataaagaccgcaaataggcctgtaactcctgattgctcataataacaggcttcccgtcaataaaaacagcgggagtgatcctgcccccaataaaaattccatcttcctgatctactgtgacgccgggtgtttttcttaaaacatcaaggaggtgcgtggaggttttaaagtctttatttccggcaacagacagtacaagattgccttcattcagtttcatttttcgtggagctgactgaataataacttccgaaatattcgttgttgaagattttgcctcagccagagaatccgggatttttcctttgacggtttcctgtgcttttccaaaaattgacaggaacagcagaagcagcaagagccataatttgaagatcatagattttaaattttatgacatcaaaagtatcggcctggagcagaaaagcggttttgaaattaaaattccgcagtactgaattataaatttgaactctgaaatcttgattcagcaagggtttgagactgtttatacaaaagaggcgttgtatttttaattttcttgaacgtagaaaagaaagtcgatttggaattgaatcctacttcatatcctatctcttcaatttttaaataagagccattttctatcttttcacaggcttcatgaatacgatattcattgatataagtggaaaagcttttaccaagattatcatttagcagttgggaaagctgatgggcagagatattcattttagatgccacatcacttaatttcagattgggatttttataaagctcttcggtattcatcagccgctctaatctggacgaaaagctgtctgcctgttcttcagagatctttttattggagtatctttcagtttcctttaccggaagctgctgatattttttattgaataaaatcaaaaagttggcatacagtacaaatgaaaatacaagacttcctcctgcacagtagatttgcacccagcctgttgagatcagctgataggtcagaaagataatgatattactgatcagaaccggaagaacaaactggtttggatttttaaggttctgcctggaaaagttgtagtactgatacactgtaaggaatacaaatacggaccagacggtataaataaaggttccgaaataatgctcccacgtaacagggaaaaggagatataataaaccgacagcccccaaaatgatcgtcagtattccaaaccatttccggcagttcttccagtcaaagtgttcctgttgaaaggaagatttcacataatagtatagcgccggcccggtataaaataaggcagacaatcccaaatgcggaataattcttggcagatccggataaaagtaaatgcatacagcaatgcccactctggtgctcagcatcagcaaaagaagtccgaggaaaaaatccgggaggtatttcagtttcttaacaaacagcagataaatacccagcagaagtccgttgaatgctcctactgcgctgaagaaaaataacatctgttgtccgaaagtcataataatttatttatttttttgtaacgatcaccattcggctttgatcatatcaataatttcataaaagtaaaattaataaattattgaattcaatttcagcaacatatacattttttctaagaaatattgcagaccgatatctcttttccatctgcatattctttgccccattcacataagtttttcagaatcggaataagatcttgtcctttgttggtcagtatatattctattcctgcaggaatggtatcaggaatttcttttttaatgataagtttatgagtttccagttctttaagttgtctccctaaaacctgttcagaaatattagacagttccttcttcaaaagatgaaaccggttatttccctccgatatcgaataaataatctgtgacttccaacgcccactgatgatacttactgcggaattcagttcacagataccgaacagaaactgttcgtttgccacattggttgaagtttcttttctcataatgatcactcacaattttgttcgttattgcaattcacacacagcctgcagaaatttacattaaaattacaaaattatgagtacaaaaaacatcctgtcgattattggtcttgtaataagcctgcagctgttccaggcacaggaaagatgggttctgaaatccgggtttatgtcaaaaccggatacggtattgatttttaaaccccgaacctacatgaagacagaaaaatatccattagtctatttattacacgggtatagtgaaaactaccgtcaatggtcccggacaacagatcttcagaagttttctgatcaatataaaatgattattgtatgcccggacggatttacaacatgttatgtaaacagtccttatgataaaggggcaagagctgaagatttcttttttaagcagctggttcccaaggttcataaaaacttcaatattgataaaaagaacattttcatcagcggattgagcatgggaggatatggtgctatccgatattttctacttcatcaggattattttaatactgcaggaagtacaagcggcgctttttctctggatcctgacattatgaggaatgcaagcttgcaattctttaaaacagaaaggattactgatgacctgaacaaaatacttggttctccggacgaatggaagcagtataatatttcaaaactgttaaaaacctacaataaagggaatccttttttaatagattgcggttcggaagatatactttatccttccaccattgaaatcaaaggtattgccgatagtctgaaaattcccattacatttatttcccaacccgggaatcataatacagaatattggaaaaactccattgaacatcattttatttttttcagacaacattttaaataaaaaaatcccaaagcatgctttgggatttttttatgatgtaagcaaatattatctgcttgcaatatcgatgtagtttctttgctgagcaccttggtaaacctgtcttggtcttccgatcgggtctcctttcaatctcatttctttccattgagaaatccatcccggaagtcttcctaatgcaaacattaccgtgaacatttctgtaggaattcctaatgctctgtagatgatacctgaatagaagtctacgtttggatatagttttctttctacgaagtattcgtcttccagtgctactctttctaactgcattgcaatgtcaagagctttatcctggattcctaatgctttaaggatatcgtcagcagcttttttgatgattttcgctcttgggtcgaagtttttgtacactctgtgtccgaatcccattagacggaagttatcattcttatctttagctttagcaacatatttagatacgtcaccaccatctttctcgataagctcaagcatttcgattacagcctggttagcaccaccgtgaagtgggccccaaagtgcagataccccagcagagatagaagcgaaaagacctgtgtgagcagaccctaccattcttactgtagaagtagaacagttttgctcgtggtctgcgtgaaggattaataatttatctaaagcatttactactaccggatcgatttcgaaatcagcgtttggtaatctgaatgccattttgtagaagttctctacgtagtttaagttgttatccccgtggtttaatggtaaaccttgagtttttctgtaagtccatgcacaaaggtgagagaacttagcaatcataagctcagcagcatgatccatttcctctttagagtttacattaacggctttcgggttgaaggctgtcaaagcagaagttaaagaagataaaactcccatagggtgagcagagcgagggaaaacatcgatgatttttttcatctcgtctgcaataaagttatattttttaatgttgttttcgaaagaagtatactgatcctgagtaggcaattctccatgtaataaaaggtacattacttcagtgaagttagatttttcagcaatctgctcgattggataacctctgtagaataattctcctttatctccgtctaagtaagtgatgtcgctaatagtagctcctgtatttttgtaacctaaatccagagtgatcaaacctgtctggtctcttaattttgaaatatcaatccctctgtctccgatagtactatccacaattggatattcatatgaattacctgcgtaattcaatattactttgttgtctgacattatttatttttttttaaatatactactttccataaaatacggcaaacaaaaattatcgcttgccgttatttataaattcgattatcttttgattttaaatgcgcctaaaccagggaaaattgcagtctcaccaagagcttcttcaattcttaataactggttgtattttgccattctgtctgatcttgaagcggaaccggttttgatctgtccgcagttcatagctactgctaaatcagcaatggtagaatcttcagtttctcctgatctgtgagacattactgaagtgaatttgttattctgagccatctgtacagccgccattgtttcagaaagagaaccgatctggtttacttttacaaggattgagttggcaataccttctgttactcctcttgataatctgtctacgttggttacgaataaatcgtcacctaccagctgtactctgtcaccgattttgtccgttaacattttccatccttcccagtcatcttcctgcataccgtcttcgatagaaatgatcggatatttagcagccagctcggcaaggtaagaaacctgctcttctcttgacctgtgagctcctttatcgccttcaaattttctgtaatcgtaagttccgtctttgtagaattctgaagcagcacagtctaacgccagcataatgtcatcaccaggcttataacctgctttttcaatcgcctgaagcaatgtatccaaagcatcttcagttccgttgaaagtaggagcaaaacctccttcgtctcctactgctgtagaaagacctcttcctttaagaattgacttcaggttgtggaaaatttcagttccttttctcaatgcatgagagaaagaatctgcttttaccggcatgatcatgaattcctggaatgcgataggagcatctgaatgagatccaccgttgattacgttcatcattggaacaggaagtgtgttggcatttacaccaccaacatatttataaagaggcattcccaattctgcagctgcagctcttgctaccgccaaagaaacaccaagaatagcattagcaccaagatttcctttgttagccgttccgtcaagattaatcataatctgatcgatataattttgttcgaaaaccggctgtccaaccaaattctctgcaattacttcttttacattttcaacagctttcaggactcctttcccctgatattctgaaccgccatcacgtaattctaccgcttcgtgttctcctgtagatgctcctgaaggaactgctgcacggcccattgccccgctttctgtaaatacatctacttcaatggtaggatttcctctggaatctaaaatctgtcttgcttctatgtaagaaattgcactcattttttaatttttttagtttagacaaatttaatcaaaatttaactttcaggcgtatttcacgggatttttttgagataattccaagttaaattttagttaatttatattatgataattgtgcaatttctttattacaattcaatgggttaaaacggaagagtgctgaagcccggacattgtaaaatgccggagcttgatgattgatttcaggcctgattggttttcagtataatgtaaaaaatctttatttcctgggtgaaggagacagcagtccggctaaagcacctattgctcctgaggaaatcgttgcaaaaatagtgaccagctggctatcgggagttttcccattaccccagaaagatataagaatcaaaccaattataatcgaataatggcaaaaccaagcatgatcactatgattctgtaaatccagcaatcggtatctttcggacttcttatttccacttctttaatagcttctatgggattggtcctgaacttttcctgaagatcagtatcattttttaaagctgcttccaaatctccaatactgtcattaataagagttttcatggcttttaattttatataccaaatttcttatgaataagtttaacagtcaattacacaaaagggttatttacagctatgcggaacaccaggcaggttccatgattttcgtgtatcatgctaaattcaccggacaattcattcattcttcttttcatatttctaagtccgtttccttctttctgaccttcagaaataccagttccgttatcggatattttcattgagaagctatttttttcctgtaagaaagaaagattcaaagtatctgcatggctgtgtttataaacattattgacggcttcttttaagcagagaaaaagattacgcctcatttctgtggaaatgggtgttttcactatgatatcttcgctttctgaatacaccattacttttgttttctttaaaaaatttgtggtataaagaatagcatagtcgataaagcttcccagggtatcatttccggcattcaggctccagagcatttcacgcatggagatattcatttcttctgaagtcttcaggagctcttcgatatcgctttgcagatcatcattttctgctttctgcttcagaaattctgcctgaagcttcagtgcggagattcctgccccaaggtcatcatgcatatcatgggagattcgttcccgttcctgttcaagaattttttgtttttccagttctttctgaaggagctggttttgatgttcagcttctttgagctgttgctgttgaataaaaaaaagctgtcttttattatacagaacaactattaatacaataaatatgacaaaagttattaacaaaataacagcaataatataagccaatcgtattgtgtccggtagttgcttcatatggtgtttttgttttcaaatttccctaaagcaatatagaacattccatacataatgatattgacacaatactgcattacttttagaatttgcagaagcccgggatcattatcccgaaggaaaaacattgggatcgatctgaaaataaagaaaatgctccagaaaagcaatccacaggaaacccagaaatgcggatcatccagaatttttatttcttcaaagtttttcagtctgatatacagccaaaccaacacattaatgatgaaataaaaacatgctaatattcctaatgtattttcatagttttcgccataaaattttacaaacagaataatataggccagtatacccatcagaatgtaccggaaaaatactctaactttccgggggaagattttagcatagtagatgttaaagaaaataatcaaaaagatgctgtagtaattaaacaaataagcaaagtcaaattctttattcaatattttataatgtccatacaactccagacaaagggacagaaataaaaataccgcaaaatagttttggctggaaaggcctttttttccagctaaaactatagactttacagtagccgccaaaagtacagcgatgtatattatctggattaccattttacggatataatgaacccatatcgtaatatccctggtctgtattaaaaaccagcgtcatttgtttttcgtgagtttcaaagtgttttttatattgatcttcccgaaatcgatctccaagattattttcaaaaatcactttcttcacatcactgatctcgcatagattgatgataaatgtatcactacgatcttttgacagggtatctatcaaatcaacgatatgataactgatataaaatgtattatttcgtcctaaataattattcaatacccgatgtccgttattaagataaaaatcattaagctctcttaaactttcattggagattttcagatctttgagtgtaagatcctgattggcattgatgataaggtaattattctcatctatagtatttttctcctgtgtttgtaaagaggctaccatatacatcattctgttttcagaataaggtgtaagtcttaaccttacatcctgaggatctatctgcacgaaagtaaatgttagataggtcgccctaatttctttcatgatctcacaaatatcttgcaggagagaatgctgtacagcataaatacctccgagattgaaattcacattctgattttgcataaatggcaaaacaccctttctagcactatcaataaagctttctgccagaatgcggctaattggcagcatttccagcccatccactaactgctcaagcttattaccaataggaccttctctgtacgctagatgatcatcaaggacctgacttgttggatttgaattttccataatttcttagttttttgattgattaaatttattgacagcctccactttgttatttacatgaagttttctgtaaatatttccgacatgctttttcacagtatcgatgctgatgaattttttgtctgcgatttctttgtacagaaggccctgtgaaagaagctcaagaatttccttttcacgttccgtcagttcatcaaagccttcgacttccggaagtttgttttcgaaatgtttcagtactcttctcgcgatagaaaaactcatcggagcaccaccgttataaacatcccgtatcgaagaaagaatcttatccatgctttctccttttacaagataccccatagcaccggctttcaaagaattgaagattttttcgtcatcatcaaaactggtacacataataaattgtgtatcgggcatttcttttcgcagcttttctatgatctcgattccaagcatatcctgtaactggatatccatcattacaacgtcgggagaaataccgggcagattcatcattgtgtcatttccatcgaagaactgagcgataaccttcatatccttctgataattgatgaccttcttcaacgcattgttgtagtttttctcgtcttctactatggctatggaaatgctcatgtctttgtttgtttgaagcaaatttcaacagaaaacaatttgaaatcaattacacctttgggtaatattaagggttgagtttgtggttatggttcagttttttagctgttattaaatttaatcaatttttcattttaaaaacaatatttacctgactattttatagcaaattaaaataaaaccaaaaaaattgagataaatattacaatatcgattgttatttcgcaagctgatctagaatgggatggtcaataccacttatcttattatggaatttgatctgttcaaaaatctgaatcttgtttctgccttttttcaaccatacaccgggaatataaagtgtttgctgggggccttctgtactccagtatcgtcctgcatttcttccgttgataaaaacaattccttttccaaaatttctcatatcaagaaaagtatctcccgtttcattaagggtaaattctgcttcctgaatcacaggtgaatggtcttgaatatctttatttttaaaatgatgtttcggaaaggcatcaaaaggcagaggaagcatttcccagtttccggaaacttcagttccattgattttcacagggctgataattcctttcaggttatgaacgatctctgctccataattgatccttcccatattttcaaccagaatttccaggcggtctccggatttgatttcaatatccagatcatattttttatttaccctgttcagttctcctttccattttccgttgatataaacattcgcataatcacgcaatccttttatctccagtaatcccttctggtctgtatcaaacttttttctgtagagtatatagccgtttccgatattcagatcttcgaacgtaagcggcatatcacttttaacaggtttcatacggtcagtaaggtcaaaaaggctgcttacttttgaaaattcaatttcaggaattgtgatcacttttatcggctttggaacatccggaagtttattcttatgtattttctgaaaaatttctctcaacgcattatattttggggtagcccacccggcttcactgatgggagcatcataatcataactcgtaagatccggttgaatatcatgatccttatcgtaattggcaccgcttgtaaatccgaaattggttccgccatggatcatataataattgaaagacactccattttctatatataaattggtttgctttacgacttcatctgtagaaactttaacaaaaggctctgcccaatgatcaagccatcccgggtagtattctgcaaccatgtagggacctttacctccattatattcattgatacttttctttaaaacatcaatatcactctctccatttgctgttggcaaagcaccttcaacagaacctcctttaaaaagtgaacttccatctgaagtaaataacggcaccgaaattccacttttcaacagcatttctttaatcttatggctgtatttcctgtgctcttcgagcgggatatctttcctctgagccacataagaaccaaattcattttctgcctgtaccataatcaccgggccgccattcgtgatctgcatgggtgtaatctgttctgccagttgactgatatatttccagcattcttctaagaaggctttattatctcttcttatttcaagctctttatttttctgcagccaccatggatatcctccaaattcccattctgcacaaacataaggtccggggcggataatgacatacaatccggtttcctgtgctgtttttataaacttctgcaagtccttttcaccagaaaaattccactttcccggagcttcttcatgataattccagaaaacgtaagtagtaaccgtgtttaaacccattgctttcatcatctccaaacgatgcttccagtgtgctgacggaactctcggatagtgcatttctccagaatatatggtaaacggttttccatttaagaggaaatgtccgtctctgatttcaaatttccctttttgggaaaacacagtattcaaagagaaaaataaaagaattatgctaaaataacggttgaaatttctcatattgtaaggcatgatttttgtaaaatttaaaatataaaaatcaattgaatatcaaataatataatcatgaaaaaaagtcttttagcactgggtgctgtattggcactgacaatagtcagctgcaaaaaaagtgaaagcggaaacaagagcgttattaaaacagacagctcagaaactgtaattacggataataacggaaagatagattcggtaacacaaagttcttctactgtagacatcaacggacagaaaacagagaaaacagattttgtttacaaggctacagatggaacattggtaaaagtagttttcaaaaatgatccgaaagaaagtacagtagccattaccagcaataaaaagacgtttatccttcctaaatcggaaactaaaggagacgaaacaatctataagaaagatgatatgactgcaagagtgaagggggatagccttcatctggagcaaggaaataatattatagaactgaaaagaacgaagatataatataaataaatgcccgctcaggattctgagcgggctttcatttattttttaatcactttttcaaagtatgttttattattggtggtaattttcacaaaataagttcctttcgtaagatcagaaatatctatggaagttcctttggggtgatcaatatttttaaagactttacccagcatatctgcaacaacaatattctttatttgttctttactatcaaaaaacaaaacggaagaagtaggattgggataaatcctcattgtattcttggtttctattctttcatcattggttgacaaggttccatttaccaaatccaatgcataaaatccatacggtgctgttcctattatatagtccttataaatagcgaactttcccatattcgctccaattaaatataataattttgtattcagtattttttgccaggatactccataatctgttgttttccaaacatcacctttataggctccataaccaataccatcatcaaaaatttcaaaatctttaaaagatgatgtcatgttattatttataaaccatgtgtttccaagatcaacagaacagtactgtcctatatatattcttgacgaatttccaaaaacaatatcccggggttgatcaaacactccaggaaagttaatgacagcccaagttataccaccatcaattgttttcatcattttttcactagtaagaagaaatcctacattattatctacaaatttcattactctaacatgccgccctacttcaaaaggagttgaccatcctgtagatgcattgtaagtagtaacgtatcctttataagaatttgcattgtcgcctcttgttgccattgcgaaatctccattaggtttcattgcaagtgcaccagttaaaggatacggaatattttgggcagtccatgttaaaccgctatcttgtgttctccaaaattcataggaactgttacgtattccaattcctttaccattagaaagtatacttaaagaaccagtaggtacattaggaggcatatacttccaggtcattcctttatctactgaaacataacctcctactgttgccaaatgtttagatgcataggcattattatatattaagcccccgcgtaaaatccatttgacatttgtaggaatccaattaataagatctgtacttttaaaaatagaatggtttatttcgtcacttgtttcattatctgtacccaaaagaaattttcctccgcttactgccaaagaagtaaagatatagtatgaagaagggtatataagacttgaatcccatacttctcctgtagctgttctatataatttgtttggaatgccaagtccaactgcaacgaattcattattatatatcttaatatccctcagtccattgatgctaacatcaatccatgtattaccaccatctagtgtatatctcgtagttcctccagtaagagttgcaatgccattgagtggatttttaaaaataattttatcaaatttttcagtggtttcacttaccttagtccatgttgctgctccgtcggtggatttaaaaataaaactcttacctaatgtagcatcggttacgcagtatccagtattagcatcggtaaaaaagacactggtaattttgtctgcataaacagtaggtatcatatacacattccatgtcaccccgccatcagtagatttcattattctgctatttgtagtactaataaagattgtgttatcattcagaacaaataaagattggggaaagtatgagctaggtaatggatgggaaatacccggagtagagaatttagagtctgtaattatcagattatatcctattactgcatatcctttgttattatgaattgtaaaatctgctactgaactcatttcattgatttgtcgccatgttttaccatcgttttcagtaatcaataagtcatcatattcatttctcttttttaccaaatagcttccatctggtaaaatttccattttcatcactcgttcaccttttaaaaatggggtagtaagttgccaatcagtgttcaatgactgactggaaaataaagtacagcatagtattgctgtaaaaagtagtattttcttcatagattagtttttaaaataaaaggagcttgtagtaaactacaagctcctttagcatattttgaagtataaaacttattattcttcagttttttcttcagtagtatcagctttagcttcttctactttctcttctactgcagaagcttcagcaactactgcttcagcttttttagcagttgtagatcttctgcttcttcttgtagcttttttctcttcagcattagggttgtaaagctcgttgaaatctactaattcgataagagcagtatcagcagcatcacctggtctgaatcctgtcttgatgattcttgtataaccaccgtttctttcagcgattttaggagctacagttctgaataattcagcaaccgcatatttattttgaaggtaagagaatactactcttctgttgtgtgtagtatcttcttttgcttttgttaatagaggctcaacatatactcttaaagctttagctttagctacagtagtgttgattcttttatgctcaattagagaacaagccatattagaaagtaaagcacttctgtgagaagctgttcttcctaagtgattgaattttttaccgtgtctcattattaattatttatcagcgtctaacttatattttgcaacgtcgaaaccgaagttaagaccttttgaatgcactaattcttctagttctgtcaaagattttttaccaaaatttctgaatttcatcaaatcagacttactgtaagaaaccaattctccaagagtttctacttcagctgctttcagacagttaagggctcttacagaaagatccatatctgctaatttagacttaagaagttgtcttgtgtgaagagtttcttcatcgtactggatagatgcttttacagcttcagtttcaagagtgattctctcatcagagaataacatgaagtgataaattaatatcttagaagcttcagttaaagcattctgagggctgatagacccgtcagtttctatatctaatacaagtttttcgtagtctgttttttgctctacacgataattttcaatgctgtattgtactttcttgattggcgtgaaaatagagtcaatagcaatagtacctacaggtgcattgtttgacttattttgttctgaaggaacatatcctctacctttttcaatattgaaagtaatttcgaaagttacatcagtgtttaggttgcagatcaccaaatccgggttaagaacctcaaatccgttgatagactttcctaaatcaccagcagtaataaccgtttgacctgaaactttagcaacaacctgctcgttagcctggccttctgctgcagcttttaatcttacctgcttaaggttaagaataatttcggtaacgtcttcgattactcctggaatagttgaaaattcgtgctctacaccttctattttgatagatgaaatagcgtatccttccagagaagaaagcaacactcttctcaaagcattaccgattgtaagcccgaaacctggttctaaaggtctgaattcaaattgacctttaaattcatcagagttaagtaaaattactttatcgggttttatgaattgtaaaattgccatattattgggttgagcaaaaatttgattaaaaaattatttagagtaaagttcgacgataaggttttccttaatgtcctccggaatctggattctttcaggagcagaaacgaaagttccttcttttttctcatcgttgaattgtaaccactcatagtttgacttagaagccaatgcattggtaacaacttcaagagacttagacttttctcttacggcgattacatcaccagcttttaccaagtaagaagggatattaagaatctctccgttcacagtgatatgtctgtgagaaaccaattgtctagcagcagatcttgttttagcaaaaccgaatctgtatactacgttatccaatcttgattcacaaagttgtaatagaacttcccctgttacacctttacttctgtgtgctttgtcaaataagttagcaaactgtctttctaaaataccgtaagtatatttagctttttgtttttcagctaactgaactgcatattctgattttttagcacctcttcttttgttaggaccgtgttgtcctggcggttggttttttcttttttcgaagtttttatcatctccgtagattgcagcaccaaactttctagcaatcttagttttaggtccaatatatcttgccataatgggtaaattctaaaaattaaactcttcttctttttggtggtctacatccattgtgtggcataggagtcacatcaatgatttcgctaacttcaattcctgaattgtggatagatctgatcgcagattctctacctgcacctggacctttcacaaacacctttactcttcttaaaccagcttcgtgagctacagcagagcaattttcagctgccatctgagcagcaaatggagtattctttttagaacctctgaatcccattttaccggcagaagcccaagagataacctctccgtttttatttgttaaagaaatgatgatgttattgaaagaagcctgaatatgagcttcaccaatagcttcaacttttacttttcttttcttaactactttagtttgttttgccataattcctaacgattatttactagcttttttcttgttagcaacagtttttctcttccctttacgtgttctagagttgtttttcgttctctggcctcttaaaggtaatccaagtctgtgacgtattcctcgttggcatcctatgtccatcaatctcttgatgttcaattgcacttcagatctcaattctccttctacttttacgttttcagagatatatgttctgattgcagccaattcatcgtcattccattcgttgactttcttgtcttcgctgataccggcagctttaaggatttcagaagaagtacttcttcctactccatagatgtaagttaaaccgataacacctcttttgttttttggtaaatcaatacctgcaattctcgccataatttaatgttaaccttgtctttgtttaaattttgggttcttcttgttgattacgaacagtacaccttttctgcgtacgattttgcaatcagcgcttctttttttaattgatgctcttactttcattttgatagtatttattttttacaaatgccaaatggaatgggtattccatttggctaattgttttaatatctaaatgtgatcctcccttttgtcaaatcatagggagacatttctagttttaccttatctccaggtaaaagtttaatataatgcattctcattttgccggagatatgagcaataaggatatgcccgttttccagctctacacggaacatggcgttagaaagtgcttccacgatcacgccatcttgttcaatatgtttttgttttgccataaattaatatccagtcgttcttgataatttagactgcattaagccatcataatgatggttcagcagataagtattaatctgttgaactgtatctaaaattacacccaccataattaatagggacgttcccccgaaaaatagggcaaacgcatctgtctgaacaaagcttccatgcacaattgccggaaggactgcaaagatagataaaaaaattgcacctggcaaggtaatttttgataaaatatcatctaaataatcagcggtctctttaccgggtcttactttcggtactaaacctccatttctcttcaagtcatcagccatctggtttaccggaattgtaatcgcagtatagaaaaatgagaagataataattaatagcgcaaacaatacgttgtactgccagctaaaaacattcttgaaacctgcaagaaaagtattagactcatcgaattttgttaataatcctggtacgaacatcaatgcctgggcaaagataatcggcattacaccagcagcatttactttcaatggaatccattgtcttgctccctgcataagatttctgtttacacctcctcttgcttgagctctgcttacatactgaatcggaatttttctaacagctactgataagattactgctaaaagaactaccaacatccagaataatacttcaataaggatcatgatagatcccattcctcctttaccgttctgcacggccatctcctgtacgaatgcttcaggtaatcttgaaaggattcccaccataataaggatagaaataccgtttccgatacctttgtcagtgattttttcacctaaccacattgcgaatactgaaccggcaaccaggataacaatacttggcaaccagaacatgatagaatttggctctacataatatgcagactggaactgagcatacggtaagaataattgagtaatagaagttaagtaagaaggtgcctgtaccagacaaactccaatcgttaaccatcttgtaatttggttcaatgtatttctacctgactctccatctttctgaagcttctgaagataaggaatagccatccccatcaactgaacaataatagaagcagaaatataaggcatgattcctaacgccattacggaagcgtggctgaaagctccccccgtaaacgacgaaagcaagccaaggagacctgctccttgcttgttaccgccttgatttttataatgctctaagagatctcccacctctgcaaggttaattgccggaagtgagatataagatgcgaatctatacacaaggattatacctaaagtaaagagaattttatctctaagttctttaagactccaaatatttttaagtgtttgtataaattctttcattagtaagtattataaggtaattgcttttccacctgccttagcaataagctcttcagcagatttagtgaatttgtcagcagagattgaaaccgcagatttcaattctcctctacccataattttcactaattcgtttttagaaactaaaccattttctactaaaacttctttcgtgatatctcctgtgatggatttgttctcgattaaagtttggattgtatcaaggtttactcctctaaactcttttctgtttacgtttttgaatccgaatttaggtaatcttctttgtaaaggcatttgtccaccttcgaaaccgattttctgagaataaccagctctagacttctgacctttgtgtccttttgttgaagtacctccttttccactaccttgacctctaccaattctctttgagttgaaagtagatcctgcagcaggttttatgttatttaaattcattttaatttctcttttataaaattatttttgaacttcaagtaagtgatttactgcagcgatcattcctaagatagaaggagtagcttcgtgttctacaacttggtgaagtttttttaatcctaatgcttcaagcgttctcttttgggtttttgttctaccaatagcgcttcttacttgctttactttaattgttgccattgttttaattattaaccgttaaacactttacttagagaaattcctctcattctagcgatctcttcaggtcttctgatgtctaataacgctttgaaagtagctttcaccacgttgtgagggttagaagatcctttagattttgaaaggatatcgtgaataccagcagattccaataccgctcttaccgcacctccggcgataagtcctgtaccgtgagaagcaggtcttaggaagatatctgcaccaccgtatctagcagtagtttggtgaggaatagtgtggttcattacaggaactttcacaaggtttttcttagcgtcttcaactgctttagcaattgcagaagcaacctctttagattttcctaaaccgaaaccgataacaccttcttcgtttcctactacaacgatagcagaaaatccgaaagctctacccccttttgttacttttgttactctgttaacagctacgagacgatcttttaattctaatcctcccggttttactctttctatattatctagtcctaacatattttccgaaatttaatgattagaatttaagtccaccttctcttgcaccatcagccagagcttttactctaccgtggtatacgaatccgtttctgtcaaatacaatactttcgattcctgcagcgatagctttagcagcgatagctttaccaacagcagcagaaacttcagtcttagtacctttagcgtctacacctttctctctagaagaagcagatactaaagttttaccatttttatcgtcgattaactgagcgtaaatttccttattacttttatatacagataatcttggcaattcagaagatccagagattttccctcttactcttcttttgattcttattcttttttctaatttacttaatgccataatacttataatttattaagcagatttaccagctttacgtctaacattttcaccaacgaatcttacaccttttcctttgtatggctcaggctttctgaaagaacggatctttgcagtaaccattcctagaagttgcttgtcatgagacgttaaagtaataattgggtttttacctttttcagtcaatgtatcaacttttacttcatttggaagttctaatacgataccgtgagagaatcctaaagctaattcaagtttttgacctgagtgagaagctctgtatcctacccctactagttctagtttcttttcgaaaccttctgatacaccaacgatcatgttagcgatcaacgctctgtataaaccgtgaagcgctttgtgttgtttagaatcagatggtctgtttacgttaagttcaccatctttttgttctaaagtaattcctgctgtaagctcctgagaaagttctcctttagccccttttacagttactacaccattgttttcagtgattgtaactcctgctggaattgttataattgctttaccaattcttgacattttcctgtgattaaaaattaataaacatagcagattacttcaccgcctactttctcttctctagctttcttgtcagtcattactccttttgaagtagagatgatagaaatacccaaaccgtttagtactcttggaagctcagctgaacctttgtactgtctcaaacctggtctagaagctctttggatagacttgatagccggtttgttagtttgcttatcgtactttaaagcgattttgatcactccctgaacagcgttatcttcaaacttgtagtttaagatatacccctgatcaaataagatcttagtaatctcctttttgattttcgatgcaggaatttccaccactttgtggcctgcgctttgtgcgttccttactcttgttaggaaatctgaaattggatctgttaccatttttcttttataaattattggttaaagaacaatcagttttgcaaagacttgaagagtaaaatatcagacttcagaaatcttcagtctgatatttttatctttagtatctgaacaacttaattgtcccgatttttaattagtaattattaccaactagcttttcttacacccgggataagaccgttgttagccatttctctgaaagttactctggaaataccaaacgttctcatgtatcctcttggtctacctgttagtttacatctgttgtgtaatcttacaggagaagcatttttaggcaatttttgaagtccttcgtaatcaccagcttctttaagagcttgtcttttagcagcgtatttagcaactagtgcttctcttttgcgctcacgcgctttcattgattctttagccatttcttagttctttttaaatggtaaaccgaagtgagttaataatgctttagcttctttatctgttttcgcagtagttacgaaagtgatgtccatcccctggatttttttcactttgtcaattacgatttcagggaagataatctgctcagtaatacctaagttgtagttacctctaccatcgaaaccatcagctttgattccagagaaatctctgatacgaggcaaagcagaagaagtaagtctgtctaagaattcatacatctgatttcctcttagggtaacttttgcacctactggcattccttttctcaatttgaaagcagcttcgtctttcttagagattgtaccaacagccttttgaccagtgatattcgtaagctcttctacagcataatcaatgattttcttgtctgcagtagcatcacctaaaccttgtgatacaacgattttctctaatttaggtacttgcattactgacttatacccgaattcttccatcattgcaggaacaattgtttctttatatgcttttttgggtcttgctatatattccatgtgttatttaaaattataaagtttcacccgtttttttgttgattcttactttcttatctccttcgattttgtaacctactttgatagcttttccgtctttaccaactaaagctacgtttgagatatgaatagaagcttctctttcaacgattcctccttgaggatttgaagctgaaggcttaacgtgctttttgatgatgttaagtcctgcaacaactactctagggtctcttccttctttcttaatcacttcaataacttcaccagtcttacctttgatatctttcttaccagtagtaatgattacgttatctcctctttttatttttaactttgacatttctttaaaaaattttaaaaattaaagtacttcaggagctaatgaaatgattttcatatattctttgtctctcaactcacgagcaactggtccgaaaacacgagttcctctcatttctcctgctgcgtttagtaatacacaagcattgtcgtcgaacttgatgtatgaaccatcttttcttcttactgcttttttagttcttactactacagctttagatacctgaccttttttagcgtttcctgatggtgtagaatccttgatagtaacaacgattttatcaccaactgaagcatatcttcttctggttcctcccagaactctgataactagtacttctttcgcacctgtgttatcagcaacttttaatcttgattctgtttgtaacattattacttagctttttcaatgattcttactaatctccatctcttgttcttgctcaaaggtctagtttcctggattaaaactgtatctccctcgttgcattcgttgttctcgtcgtgtgcagtatattttttcgtttttaatacgaatttaccgtacatcgggtgcttcattctcatcgtttcactaacaacaatggtcttttccattttattgctggaaacaactccgattctttcttttcttaaatttctttccattgtaaaatgaaattattgtttgttagttaactcagtgtttagtcttgcgattgtttttctcaaatctttgatttgaatcgggttttcaattgggctgattgcatgagccaatttcaatttagaatattgagcttttgcttcagttaattgagcttgaatatcacccgcgcttaaatttttaatatcagcttttttcattgtattcaaagattatagaggtttaacaaaatcgttagcaacgatgaatttagtaactactggtaatttttgtgcggcaagtctaagagcttctttcgctacttcgtaaggaacacctccaacttcgaacataattttacctggttttactacagctacccaatattcaacagcacctttacctttacccatacgtacttccgctggtttcttagtaatcggcttatctgggaagattttgatccatagctgaccttctctcttcatatatcttgttgcagcgatacgcgcagcttcaatttgtctggcagtgatccaagcaccttccgttgctttaatcccgaaagttccgtaagcaagttgactacctctctgggcattccccttcatcttcatcttatgaactctacggaatttggttctttttggttgtaacataatttctaaattttagattttagattttagattttagatttttttttattttaaaaaagtaacggtaatttaaaactcaaaactctaatctaaaattttaattattattgttattgttgttgttttttctaggtcttctgttgtctctgtctcctcctctgtttcctctttcagactgacctccttttttctgttgtcccactagtggagaaagttctcttttaccgtaaacttcacctttcatgatccaaacttttacccctagtctaccgtaagtagtgtgagcttctgcccagtggtaatcgatatcagctctgaaagttgacaatggaattcttccttctttgaaagattctgatcttgccatttcagctccgtttaatctaccagagatttgaactttgataccttcagcacccattctcatagtacttgccattgccattttaacagctcttctgtaagaaattctgttttcaatttgcttagaaatactatcagcaaccaatacagcatctaattcaggtcttttgatttcgaaaatgttgatttgaatatccttaccagtcaattttttcaactcttctttcaatttatcaacttcctgacctcctttaccgatgataagtcccggtctagcagtagtaatagttactgtaactaattttaaagttctttcaatataaatttttgaaataccacctttagataatctagcttcaaggtatcttctgattttgtagtcttcagcgattctgtctccataatcgtttccaccaaaccagttagaatcccatcctctgatgatacctaatctgttaccaattggatttgtcttctgtcccataccttgattaattttctttgttacctaagattaatgtaacgtggttagatctttttctgattctataccctctaccttgtggagctggtcttagtctcttcaattgtcttgcactatccacaaatatttctttaacgataaggtttgcttcctcaatgtcagcaccttcgtttttcacttgccagttagccatagcagaaagaagtaatttttctaacttgttagaagcatctttcttagaatattttaggatataaagtgctttgtctacctgctctcctctaatgatatcagcaactaatctcatttttcttggagaagacgggcaattatttaatgaagcttttacaacgtctttgttagcttcttttcttgcgattgaactatcttgttttcttgatcccatgattatctgcttcctttgtttttgttaccaccatgacctctgaaagatcttgttggagaaaattcgcctaacttgtgaccaaccatgttttctgtaacatatacagggataaaagatttcccgttgtgtacagcaatagtttgtcctacgaagtccggagagatcatagatgctctagaccaagttttgataactgtcttcttaccagactctatatttgcctgaaccttcttatctaaagtatgatgaatgaacggtccttttttaagtgatcttgccataattattttcttttagatacgatgtaacggttagacactttgtttttctttctagttttgtaacctttagccggtttaccgtttctagatcttgggtgacctcctgaagaacgtccttcaccaccacccattgggtgatctactgggttcattacaaccgctcttgttcttggtcttctacctaaccatctgcttctaccagctttacctgatacagttaattggtgatctgagttggaaacagaaccaatcattgccatacattcagtaaggatcattcttgattctcctgaaggtaacttgatgattgcatatttaccatctcttgaagttaattgagctgaagaaccagcacttcttgctaaaatcgccccttgtccaggtttcatttcaacacaagaaattacagtacccaatggaatgtttttcaatttcattgcgttacctacgtttggttcaacgctttctcctgatactactttctgatctactttgataccgtttggagcgatgatatatctcttctctccgtctgcgtattctaataaagcgataaatgcagttctgtttggatcgtattctacagattttacagtagcttcaacgtttgctttgtttcttttgaagtcaataattctgtatttctttttgtgtccacctccggtgtaacgcatggtcattttacctgtattgttacgtccacctgactttttaataccaactactagagatttctctggcttgttagtagtaatttcctcaaaattgtttacaattctgaatctctgtcccggggtgataggttttaattttctaacagacattactattatttataattaataattaatttacagcaaaaatatcgataacctcaccttcagcaagtttgattaccgcttttttcaatttgtttgtctttcctacttgaagaccttttttagtgtattttgaagaaaccttcggagcataaatcattgtgttaacgtctgctacttttacaccgtaagctgcttcaacagcttttttgatctcgattttattcgccttaggattcactaagaaagaataagaacctcttaaatctgtaaggtaattagccttttctgaaataactggtttaataataactgacatgatttatttctttaaattttcctggaatttttcaactgcaccttcgaagaaaatgatctcaccagcgtttactaaatcgtaagaactgatttcgttgaagttcattactttagctttaggtaagtttcttgaagataaatatacattcttgttagcttcaggaagaacgaataaagattttttaccgttaagttccaatgcgtttaatacattgatgaaatctttagtcttaggagcagcaaagctcatatcttctaaaactttaatgctgttgtctctcattttctgagataatacagattttttagctaatctcttaagagctttgttcaatttgaatctgtagtctcttggttttggtccgaatactctacctccacctctgaataccggagatttgatatcaccgtatctagcagatcctgatcctttttgcttcttaagctttttagtagaagcagtaatttcgcttctttcttttgctttatgagtaccttgtctttgagcagcaagatactgtttaacttctaagtaaaccgcgtgctgatttggctcaattccgaatactgtttcgtctagagttacttttcttccggtctcttttcctgatgtatttaatactactagttccattttctgataattacataagaatttttagctcccggaacagcaccttttactactaaaagattttgttcttgatcaacttttaacacttgaaggttttgaacagttacctgtttacctcccattcttccagccattctcatccctttgaatactcttgaagggtctgaaccagcaccgatagaacctggagctctaagtctgttgtgctgaccatgagttgcctgcattacacctccaaatccgtgtcttttaacaacaccctggaagcctttaccttttgaagttcctgttacgtcaacatattcaccttctgcgaatagatcaacttttacttcttctcctacttttacttcatcaacgaattctctgtagaattcaactaatttagctttaggagcagaaccagcctttttaaaatgaccagctaacgctttaccaacgttcttctcactcttgtcatcgaaacctaactgaacagctttataaccgtctttttctaaggttctgacctgtaaaaccgagcatggaccagcttggataactgtacaaggaatgttttttccttcttcgttaaacaaagatgtcataccgatttttttaccaataatacctgacattgtttatattataataaaatttatcctttatttatcaccatttttcgggagtctgaggtaatttctacttttgatataggcataccacgcccctaaaatgagtgtgcaaatttatgaataattttgtaactgacaaatatttcgactaaaatattttgatttttaatcatttagcgatttcagaaaaaaatctatccgaaattttgaaaatgctctttgaagtttaaaagaaagtcattaatatatttttttccaacatccgatttccttactaccaaataatgttttctttttaaaccgttattgccgatttttttaaaacttaattcatcggacagcctgaatgaatttaacgcccatttcggcatacaggtaatccccatattggcttgtaccatttccaaagtaacttccgttaaaggaactgcagaagttttgacaggcattattccgttaggatttagaaattgttcataaacagaaaccgtttttaagggaaaagaatgaataatcaaatgagcatccagaaaatcttcagcaacaagatattcggtattgttcaaaatattttcctcatgaataacagcaaaaatttcatcctcaaaaatctcaatactaaccaagtctttattaccggaaggttttgaagtgaccacagcaatatcgatttcattggatataactttttcaacaggtctatgggtcgcctccaacaccagatccacttcaatttcaggatataatactttcattttctgaataaacaaaggcagcccctgatagaatgaataacattccgtactgattttgatagtacccgccgctccggctctgatctgttgaatggtattcaaaccgttcccgatactttctattaccgtacatgcagttttataaagaatacttccctcttccgtcagctcccatttgttcctagttctgtaaaacaccttaaaaccaagctggatttccagatccttaagctgatggctcaacgccgactgtgtcaaaaaaagcttttcggaagaacctgcaatactcccttcctccgcaattgttttaataagctttaaaaacttgatttccattatgcaaagttaacaatataacgcaagacaatgtttgaaaatatttcatttaaaactgcagagcattcaatttcaatcttaggaaaagaatataccctaacatagttttgcaccataaacaatttaaaaattatgcaagaacaaattgaattctaccagaaaaaattaatgtatgaaatagatccttcagatctgtatgatgcatttcaaaacagtacagattatatagcagtagataccagaagaccaaatggctacagcaaagagcacattccatccgcaattaatcttccccatcgggaaatgacagaggagagcacgcagcaccttgacaagtcaaaaatatatgtctgctattgtgacgggattggctgtaatgcttccacaaaaggaactttaaaaatgactcaattaggttttaaagtcattgaattaattggaggaatcgaatggtggaaatttgacggctacgccacagcaggaaacgagcctaccaatggttccacttttgtatgcgcctgctaacccaagaataagagacacatgaaaatacgatttgccgaagaaaaagacctgagtttcattattgaattatgtaaagcccatgcgcagcacgaaagaagctcttttaaagaagaaaataaaaaggaacagctatctaaacacattctcaatccggattctgagataaaatgcctgattgcagaatctgatactgaaataataggatatgcaacatttttcaaacagttctccacctgggatgccggctattatatgtatgttgactgtctgtttttaaaagaaaatgcaaggggaaacggaacaggaaaacaaataatggaattaataaaaagttactcaaaagaacaaggctgcccgataatccagtggcagactccaggttttaatataagagccatcaaattctacactttgcttggagcggaaagaaaaaacaaagaaaggtttttctggaaagtataacccaaatgattcttaattaaaacagagacattctggcttcaggatgtctcttttttaactatttgatcaagataaatgtagtttattttacaataactgtaactcccctttcttctaatgcggacttatcttccttacttataccatcatctgtaatcagataatctacttcatccagtgaggcgatcttcccgaaacctttcttattcaattttgaggaatccgccaaaaccacggtcttatctgcacattcgatcataacctgattaagatgcgcctctgcagcattggaagtactgattccaaattcaagatcaatcccgtctacacccagaaaaagtttattgcaggaaaactgtttgagaattccttccgaaatagaccctacaatggaagtcgagcttttcctcacttcccctcccaactggatcacattaatattaggattattgcaaagctcaattgctacccgcaaagaggatgtcaacactgtaagcggaccgaagttcatcaacatccttgcaagataatgcatcgtagttcctgatgccaatataatacagtcattctcctggatcaatggaagtgcagcccttgcaatagcctgcttcgcctctacattaatattttctttctcccctacattcttttcataagcataccttacctgcttacttgctcccccatgattcctgaaaagaagccccagactttcgagatagttcagatcctttcggatcgtaaccgaagatacattgagcttttcacacaagtcctgtacaagcacatgccctttatcatccagctctttaagtatttcatcctgccttggtaatagcttttccattttattcgtttcctcaaaattaccgattttttccgacatcttaaaatttcatttattttctttttgctttcatttttaatttatatatttgaaaacgaaacataaacgaaacatttatgaaacgaaacgaagaactcagtaaattaaccaatgtaaaagaatgggactttattgtcataggaggaggagccagtggtttaggttcagcattagatgcggtaagcaggggattcaaaactttattgcttgaatctcacgatttcgcaaaagcaacttccagcagaagtaccaaattggtacacggtggagtaagatatcttgcccagggagatgtcggattggtaaaagaagcattaaaggaaagaggacttctggcaaaaaatgcagcacatatcgtaaaaaatcagtcttttattattcccaactacacatggtggggagggatctattataaaataggattgtctgtttatgattttcttgccggaaagctgagtttgggtaaaacaaaatacatcagcaaatcaaaaacagtcgaaaagcttcctactattgaacaaaaccacttaatgagcggtgttgtttaccaggacggacagtttgacgatgcaagacttgcgatcaaccttacccaaactattattgaaaaaggcggaagtgcagtcaactatgtaaaagtaatcaatcttttaaaagatgcttccgataaaataatcggtgttgttgcagaagaccagttttccaaacagcaatatcagattcatggtaaagtagttatcaatgcaaccggcgtattcacgaatgatatcctgaatatgaacaaccctaagcatggtaaacttgttgtaccaagccaggggatccatctcgtactggacaaatccttcctgaaaagtgatgatgcgatcatgattccgaaaacttcagacggcagggttttatttgttgtgccatggcatgaccgggctttggtaggaactacagatactcttcttgaaaatgaaagctttgaacctcgagcactggaagaggaaataagcttcgttttaaatacagccagacaatatctggctaaaaaaccaacacgtgaagatgttaaatctgttttcgcaggccttcgtcctcttgccgctcccaaagacggaagcaaaagcacaaaagaagtttcccgaagccacaaagtgattacttcagaaacaggattggtttccattattggaggaaagtggaccacctaccgtaaaatggcggaagacaccgtagatgaagctatgaaagttcacaggttgggaaacagcccatcaaaaacagagcatatgtccatccacggaaatgtaaaacctgaacaggtagacagaaccaaccacctgtatgtgtatggatctgacattccagccataaaagcattgcaggaaagcaaccctcgttatgcacaaaagatccacccggaccaccctttcactgtagctgaaattgtatgggcagtgagagcagaaatggcagaaacgattgaagatatcttggcaagaagagtccgtttattgttcctggatgcgagggcagcaatagacagtgctcataatgtagcaagaattattgctgaagaaaaaggatattctgaagaatgggctcagcagcaggaaaatgaattcattgaactggcaaaaggatatttactgactccttattcacctaaagttatcaacctaaattagcactatatacatgaatgaaaagcttatcctcgctctagaccaggggacaacttcctccagagcgattctcttcaaccatagtggagaaatcaaatatgtatctcagaaagatttcagacagatattccctactccgggatgggtagaacacgatccgaatgaaatctggtcttcacagatctccgtagcagcagaagtgatagcgaaagcagggatctccggactggaagttgccgctatcggaattaccaatcaacgtgaaaccaccattgtatgggataaagaaaccggtgaaccgatctacaatgccattgtatggcaggaccgcagaacttcaaaatactgcgatgaactgaaagaacagggacacactgaaaccatcaaagaaaaaacaggacttgttttggatgcctacttttcagccaccaagctaaaatggattcttgatcatgtagaaggagcaagacaaaaagctgaggaaggaaaattgtgcttcggaactgttgatacctggcttgtttggaaactgacccgtggaaaaatgttcatcacagacgtttccaatgccagcagaacaatgcttctgaatattcatactttagaatgggataatgatttattagaattgtttgacattcctagaaacattcttcctgaagtaaagcaaagcagtgagatatacggagagaccgctactaccctgttctctaccaaaattccgatcgcaggtattgccggagaccagcaggcagccttattcgggcagatgtgtaccactccgggaatggtaaagaatacttacggaacaggatgcttcctgctaatgaacacaggaacggaagctgtttcttctaaaaacaaccttcttaccactgtagcgtggaaaattaacggagaagttaattatgcgcttgaaggaagtgtattcgtaggaggtgccgctattcaatggctgagagatggtcttaagcttattcattcttctgagcaggtaaacgaactggctgcttctgtagaagataatggcggtgtttatttcgttcctgcattaaccggtcttggtgctccttactgggatcagtatgcacgcggaacgattgtagggatcacccgcgggactaccgatgcccatatcgccagagctaccctggaagggattgcatttcaggtatacgagattgtaaaagcaatggaagctgattccggaagagccagccttgaattaagagtagacggcggtgcctccgcaagtgatcttctgatgcagatccagtctgatcttttcggatttaaaattacaagacccaaaacattggaaactacagctcttggagcagcctaccttgcaggacttgcagtaggatattggaaaagtattgacgaaatccaggaacaatggatagtagacaaagacttccaccctcaactggacagagagaaggtaaataaaatgacccacttctggaagaaagctgtaaaaagcgctcaaagctggattgaagattaactcacttattaaaaaaaacttatatgaccccatttattgcagaagttatcggtacgatgcttcttatattgttaggcaacggtgttgtagccaatgttgtcttaaaagatacgaaaggaaataattccggatggattgttattactaccgcgtgggcattggccgtttttgtgggagtaaccgttgcagggccaataagtggggcccacctgaatccggcagtaaccattggccttgctgttgcaggaaaattctcatgggaccttgttccttcctatatcgcagcgcaaatgatcggaggaatgctgggcgcatttttagtatggctgtttcataaagatcattttgctattacggaggacgaaggtgcgaaactggcatgcttcagtaccggtccggcgataagaaaaacatcttctaatcttatcagtgagatcatcgggacatttgtactggtattctgcgtattttactttgcagatccaagtatttccctgcaggcagatccaaccgccaaagtaggcctgggttccatcggagcgatccctgttacctttgtcgtttgggcaatcggtttatctctgggaggaactacaggatatgccattaacccggcaagagatcttgctccaagaatcatgcattccattttacctgtaaagggaagcagtgattggggatatgcgtggattcctatagtaggtccgattacaggagctattatcgcagcagtattatatggacttttaaaataagacaaatgatgagaaaaatcttaaagggaatcttcgttcttgctttaggcacaggaagattattttcacaggaaaatggtgaaaccaaggaaaccaaagaaggaagacttgattttactgccaacattcagaacaatcacttatggagagggcttatcattacggataaacctgtagtgatggggaatctctcttacgccctggatgcagagaaaaaatggaaggtaggaatctggggagcttctgcattagccgatgataaggacaacacccattataaagagatcaattattatgttcaatattctgacgggcgtttttatatcgggttatgggatctttataattccagaaatattaatactgcagtagcggcagatgacattttcagttattcacagagaagaactgcccatattattgatttaagaaccaattatactttcgggccttcattccctatcaatattgaagcggatatcatgttgtacggaggggccaatgccggagaagtaattctggaacctgacggaagctacaagaaaaacagatactctacttacgttcaggcaagctatcctgttattaaggggcagaaagtcaatctggatgcatttgtaggagccggatttgctcttaatgataaaacctttttgtacggcaacggcaaaaacagttttgacattgtcaatgtaggagtaaaagcaggaaaagttgttaagattacagatcattacagtcttccggtatcaatgatggcgatgtggaatccttctaatagatttgcaagaattcagcttgcagcaactgttttttaaactgatttaaatgcaataatagaaagccacttcttttaggagtggtttgtttttataaaaaacatgcatcaaatcaaaattcacaactcattttatcaaagaaatttcttttacaattttttaattttaaacaacagtgtttttacggtgaatactttgcttaaaaaattttacttttgaaaaaaatagatatgaaaaagtttttcagtttaatggttctgtgcatcagtatctttacatgggcacaacaaacggatgttccttttatcggatacaggaattttgatattttgaaaggatatagcggcaccggtactcctcattattatctggatgtaaaaagtaatggtgatgtacattttggctatgttcagatcaatcaggccaacggggaagaaacaacggaagaaatcaatgcaggaaaatatgcacctaataaggtaatgaaagtagtctttaaaaaatatgaggaaaccttttttgtgaaattcaacaaagaaaaaatctaccttaccgacgaaaaaggaaatgtaaagaatcttgatggctgctgttcatccagtgaaagtatcactaaagagacctgcacctgtgaaagtgaatttttcaagtagtaaataatatattaaaaagccatccatttgggtggttttatggttgttggagaaaactaccctataattgtaaaaacatactattataattttccatcaacaaaaactttatacatttgtagcagcccaccttcacattataggttcgtccttcaatcaccgggattttacggtttattttctgctaaaatatctttaattttgaagggtgatttacaccaatgaaacatttaaaaattttatttctatttcttctctttcttatggtatcctgcagcaggaaagagaatcatccttatacattttattactggaaaaccaaactgaagcttgaccatgcagaaaagaaagcattggaaaaagcaacagttccttatttatataccagattctttgatgtagataaagtcaatgggaaatttcagccggtggcagtgattaccaaagacgtgagttttcagacaggaaaacaggttgttcctacggtttttattaccaatcagactttactgggcatttctgtagaagaaatcagatttctggctgaaagtattcatcttttagttcagaagaaagctgaagaatataaactgaaaaccaataatgaaattcagatcgactgcgactggaccgccggaacaagaaatgattatttcaaatttctgagggaactcaaaagaatctccggaaaagaaataacctgtacgcttcgccttcatcaggttaaagataaaaaacaaaccggcattcctcccgtagaaaaagtatatctaatgtgctactctacttcatcaccccttgaaaagtctgataaaaattctatcctggatgtgaatatcctgaaaagttatctttcaaaaatggaagactatccaatcaggaaaattgaagtggcgcttcctatttactcctggggaattatcaccaaccatttaggcaagcacaaactgattaatgctttatcaaaacgagatttggagaatcctgattttaagaggatatccgatcatgaagctgaagttctgaaagacggtttctactttggaagttatttaaacaaaggctttaaaataaaggttgaggaaatatctgaaggacagcttaacgacgctattgactttttacagaaaaaaataccacattttaatattatttattatcaattagatagtaaatttgtgtcagaccgtaaattttaatctccggcaaatggagatcagccagcctgaaccttatcatacaatattataaactaaaaaaacactacaaaccctatgaaaaagtatattctttcacttgcggttgtatcacttttctatacccaatctgatgcctgtgcatggtcggatcctgattatgattacttcaacctttttacacaaacgatcattaaagacaaagcttatcttccctttctgcacaactattcaagcaggttttatggaggttacaatccggcattgattcctgatgacaacgttgaaacatggaaaaagtttttcaacaatcagcttagctatactgagactcagaatctggtctataaagtgagtatgaacgacctgaatgccttaaagaacggaaatccgaccaatcctcttttacaaaagcttggaaccggattttaccagaagtataaggaaggtattgattatttgattgaagccaaatatcttgagccttatatgagcatcaattacatcgaaagtgaaaattcattttactacgacagagatgccaacaggaaaaatgcaacagctctggattaccctaaaactattgctgcactaacatctttatataatgcagcaaggaatcctgaaatcaaacagcgttacggatatcagctggtacgtctgaatcattataccagaaattacgattctgctgtacaggctttcaaaacttatgttgcgcctgtgaaattaagaggaacggtatatttcatggctcttgatcagcttgccggagcacaaagaggactggaaatgaacagcgatgccaactggaatttctttcaggtattcatgaacagcaaagaccgcaaggaatctgcatttgtctctatgaagctttcagatactgcctctttcagcaatatcatgaaaagagccggaacgaatgaagaaaagaatatggcgtatttccttttagggtatgaagatttcaacaacccgattcctacgatggaaaagatgtatgagatcaatcctgattctgaaattctgaaggtaatggctgcaagaagcatcaatgaactggaaaggagctaccttccagtgtattattacaattctgatgcggctaaaagtccgtatgtacaaagaggaaaagcagataacaatgtctcttcaaaggatgacaaagctacctccacaactgaagtaaaggaagaaaagctttcattctggcaaaaaattgtgagattctttaaaaacctgttcgggggatctaaaaaagaatccgctgatggaagtaaaacagatcagagcgatgatgaattactggatgacccaaacagaattccgttctatactacttccggttatggttatgatgataagatgaaggactatcttgacgatcttcagaagttcactgacaaaaccaaagaaaagtctaaggatgagttctggcagattgcagatgcttaccttaaattccttaaaaaagattacaaaggaagtacggaaatccttaccgatatcaaaacctccaatccggaatatctggaagaaatcaaaagaatgaaggttctgaatgatatcgtttcccagccaagaattgacgcagcatatgaagaccgcctgatgaaagattatgcggagtattttgtagagaaaaaggtagaaaaggatactgccacaactgataattttgattattacggtgaagtaccgtctactgctgatttccttaaagatgtgctcgccaaccgttatttccttcagggcgaagatggaaaatcattcctgatgaacaacaaactttcggatctgcaatataaccctaactcaagccttgtgaagagtgtggaagccttttacagaaaacctaataaaacccagtttgaacagcagatcattgctaaaaatatggacagtgtaggtgatattgatgcctttttcaatacaatttacggagacagagccatgagacttgcggattttgaaaaggcgaagtcttattatgaaaaagcaaaaaactttgccggtattccaagacagaattatgaatggacagaaaaagaaggacagactgttacagctaaacagtatgctcctgctgaatacaacggatttaaaaatatttcaaatcttgtattcgggcataatgtatgggaaagttttggaagtcctgaaaacgaaagtatggaagcagaaaattataccgacttccctttcatcaaaacaagcatgaataagcttgagcttgccgatgcattgattcagcttaagaagattggatccggtacggatgaaaaggcagcaaaagcgaatcagcttatcggaaacctgttgtacaatacttctatcttaggatattaccgtcagttatttgtgatggatattgacaacagcaacggaggtaaatatgacttctggaatacggacagaaagaatccttatcagtattattataaaaacttcctcgatacttcatatattgaacctgataattttgatctttcaattaattattatcaaaaagcccttaagctttcaaataacaaggaagaaaaagcaagaattctgttccagatggcaagtgcggagcaaggtaaatattaccagtatgaagctaaggcaccaaaagattttgattattctgatccgaaatggtctgagaaagaagatgcccgccaaaaggaaatggaccaacttaaaaatcaaaaatacagaacctatttcgctcagctgaaagcgcagtattccgatactgaaacaacgaagaatttaatgggaagctgtagttattttaattatttcatgagataactattgtaaagtatagaagtaaaaaaggaatcaattcgattcctttttttgttcctgcttctgaatccattcttcatgttttcttttgaagaattcatacttgtaatcctgatttctctgggcagcatcaatagaatgggaagtatggatatcataatctttttttgccagttgggcaagtctttcataatagcaatgaagctggtccagctctgcttctgtaagatcttcaatatctacaattctgttactggctttttcatgggcagcaataatctcattcagcttaatctgtattgcctttgaatctttattctgagccttctgaataaggaataccatcagaaatgtaataatggtggttccggtgttgatgaccagctgccatgtttcggagtagttaaaaaaaggaccggtaaccgcccataccacaacgataatgaaagctcccataaaagcatgtggacttcctgtaaattttacagcccagtttgaaaatttttcaaaaaaatgatttcccgtatgtcccataatcttggtttttaacataataaatgtataaaattaagaggaataagaagtaacaaataccaacaaaaaagcattaagacaacttactgtcttaatgctttcaattaaaattgatatgaatgattgaaactatgttatttaattttttctgagaaacgattttccaggttttgcttttcttctgcaattatactctttccaatttgagcaggtgaaaaagcttttggataaaatgtattattccagtgatccttccatggagaaatgttaccccatgagtatatacttttaggattattgtaatttttttcgatattttctctggcagttttcagttcttcttcggacaaatgttcttcggaacatgacgctacaccagctcctgcaatcaatattaagagtattgttctaataattttcatactgttttttgagttagaatttatagtttacctgtactgcaaagtttctcggctggatctgatcgatatacccacctctgaaataagaattgtatcctaccgaatcaaagatgttattaaagaagcctcttagtcctaatccatttttgaaagaataccctatttgagcatctactgtcgtatattgcggcatgaaaaaaggtttttcccctggctgggttccatttacatgtccattctctgtattggtatatttttgtttataatcatcgacaggtctttctccaacaaaataaattccggcacctatatcaaggcctgtaagaatccctgtaccaaacttataattcagccaggcattggcagaatgcttaggtgtattaataggagctgaaccgtttacaaatgaagggctatctttatactgtgcatccacataagcccatccggtcattacctgtaggtttggaagaatttttccgatcaattcaacttcaacaccctttctttttaagttaccggcaagtgcatattttccggtcggatttccaccatccagaagttcgtatgataaattatctgtgttaatatcaaaaagagtgacattaaatcttaatctttcattcagccagtcagatttaattccagcctcccattgttttgtagtagatgctcctacagttcctccgctgaacaatacattatttgaacttctgagtgatgtagtacttgtataggaaccaaatatgttcatattttcaatgggagagatcatgattcccaaagaggggttccaggcgtaatctttttctttgtctgagccaattaatctgctgtagcgaactcctaaatgagctttaatatatttattaaatgtaataacatcctgtgccatcagacccatggtaggtgccactgtattaatagaactggctgttgataagtctatattaactccggcaggaaggatattgttgatttcgttcaacacattgatctggtcaacatctttagccttataggaagtagtcgtaacatttgattctttccagtcaaaacctacctgaaaagtatgcttcatgaatccagtcattatatcagctccaataaaatcaaattgaaacaccttattcaaatcctctctatcagaccttgtcaatgttctgtttcgcaactcggttggattatctctctttaaaggagtcagtgctgcccctacaatttcagtctgataagatgaactcatgtaggcagctcttaatttcaatttatcagtcagttgtcttgttacagttgttgagaaattgaatgtttcggtctttgccttatctgtagaaaatccaaggaattttcttcccggcattctgtatattgcctcagtatcccctttagcaagatttacagttcctctatccggcgtggtattgttatgcatataatccatttccacaacaatctcagttttatcatccggacggatggcaatggatgggtttacataaatacgttctgtattaataaatcttctgaagctattattattttgataagctgcatttaatctgacagcaatttttccctgtgggtctaatactctttgaaagtcaactgttggtctatagaaatcccaacttccatatctgaaaccaacatttgtctgattaataaatttaggaactttagtaaccacattaatcactcctcctgcagatcctaaaccatctccaattccctgagtaactgcagcagatcctttaattatctgaatactttctatcccctgcatatcagtaagcattcctgcggtacgaaaatcagaatccatctgaaccccgttctttaaaaccggaactcctctatatcctctgatagacatactttctctggtcccgccataactaccgaattgagttaccccaggcacattctttgctacatctgtaaccgttaatcctcctaagtcttctattactttatgggaaatcacagaaatactctgaatctgatctctggttttcaatggcagccttgtgatggcttccaaaccttgcggctgcttttttctttcaccaaataattccacttcgtcaatttcattcgactttttaatagaatcattaattttctgtgcatttacaaaaaccccacccaatacaagcagagaaaaggatactactttattcatctgttaattttttacaaaattattatttttattaattctaaataaacaaatggatgtgacttatgtcaccctaaagagtactgtaattatcagatcgttaatcagcaatgaggagcctttaaaaccttgaaacagttattatcaatcgttagaagtattattcttcagactttatatggttaaaaaaagtacaatacaaaaaaagcagatttgccagccacaaatctgctctattctgtcagataatatcataaaaaaatccgcccctaaaaaagggacggactgtataatcattgcaaagtatgcatttatcacactttaatttcaacgtctacacctgaaggaagttctaatttcattagagcatcaacagtcttagaagaagaagagtagatatccattagtctcttgtgagctgaaagttggaactgctctcttgctttcttgtttacgtgcggagatctcaacactgtgaagattctcttatttgttggtaatggaataggaccgtttacaacagcaccagtagcctttaccgtttttacgattttctctgcagatttatctaccaagttgtaatcgtaagacttaagttttattctgattctttgtgacattttaatctaatttaatattaacctttagctttagcgattacttcttcagcaacgttttgcggagcagcttcatatctttcaaactccatagaagatgtagctctaccagaagataatgttcttagtgaagttacataaccaaacatttcagaaagtggaacgaaagctttgatcaccttagcattgtttctgtcatccataccgtttacagtacctcttcttctgttaaggtcacctacgatatcccccatgtattcttcaggagttactacctcaagtttcatgattggctccatgataacagctttagcagctctaccggattctttgaatcctaatttagcagctaattcgaatgataactggtcagagtcaactgcgtggaaagatccatctttcaatgtaactttcattgattcaacctcgaatccagctaatggaccattcttcattgcttctctgaatcctttttcaactgaaggaacgaattccttagggatgttaccacccttaatttcgttgatgaattcaagacctactttaccttcgtcagccggaccaatttcgaatacgatatctgcgaacttacctctacctccagactgctttttgtaaacttctctgtggttagctttttgagtaagagcttctttgtattctacctgcggctgcccttggttaacttctactttaaactctcttctcatacggtcaacgatgatgtcaaggtgaagctcacccataccagagatgatagtttgtcctgaagcctcgtcagttttaacctggaaagtcggatcttcttcagctaatttagccaaagcgttacccattttatcctggtcagctttagttttaggctcaacagcgataccgattaccggatctgggaagatcatagattcaagaacgattgggttcttttcatcagataatgtatctcctgttttgatatctttaaatcctacagctgcaccgatatctccagcttcaatatattctactggattttgcttgttagcgtgcatctgatagattctggaaattctttctttgtttccagatcttgtgttaagaacataagaacctgcatcaagtcttcctgaataagctctgaagaatgctaatctacctacgaacgggtcagtagcaatcttaaatgctaatgcagagaaaggctcttctacagatggttttctttcgatgtcagcatcagttcttgggtctgttcctttgatattatccttatctagtggagaaggaagatatttacaaacagcatcaagcatgaactgtactcctttgttcttgaatgaagaaccacaagtcataggaatgatagaaagatcgatagtagcttttctaagagcttcgttgatttcttcttcagaaattgaatccggatcttcgaagaatttctccatcaaagtctcatcgtaatcagcaacagcttctactaatttctctctatattcaagaacttcatctttcatgtcttcaggaattggaactacttcataagtagcaccttgtccagcttcatcccagatgatcgctctgtttttaattaagtctacaacccctttgaaatcttcttcagcaccgattggtaaaacgattggaactgcattagatcctaacatttcttttacttgttttacaacgttcaagaagtcagcaccttgtctgtccattttgtttacgaatcccattctagcaactttgtagttatctgcaagtctccagtttgtttcagactgaggctctactccatctactgcagagaaaaggaataccaatccatccaatactctcaaagatctgttaacttctactgtaaagtcaacgtgtcccggtgtatcgatgatgttgaagtggtaaggttttgtttcaggtaatttcttaccttgatctgttgggaaattccagttacaagtagttgcagcagaagtaatagtaatacctctttctgcttcctgttccatccagtccattgtagaagcaccatcgtgaacttctccaattttgtggtttacacctgtatagaataaaatcctttctgtagtggtagtcttacctgcatcaatgtgagcagcaataccaatatttcttgtaaatttaagatctcttcccatttcagattagaatttgaagtgtgagaaagccttgttagcttccgccattttgtgagtatcagttttctttttgaaagctgcaccttcttctcttgaagcagctacaacttcgttagctaatttcaaagccatagacttatcatttctagctttagaatatttgattaaccatttcattgccatagaaatttttctgtcagctctgattggcataggaatctggaagttagctccacctactcttctagaacgtacttctacgtgaggcattacatttgtaagtgcatctttccagatttcaagtgcagttttctcgttatctccttttttagtttctacgatatctaatgcatcatagaaaattttgaatgcgattgacttcttaccgtcaagcattaagttgtttacgaatctcgttaccaattgatcattaaatttcggatctggtaacaacggtctttttttcgcttttgtctttctcattgcttttgtaccttatttaatgattactttttctttccttttgcaggcgcagcagctgcttgtcctggtttaggtctcttagctccgtacttagatcttctctgtgttcttccatttacaccagctgtgtctaatgcacctcttacgatgtggtaacgtactcccggtaggtctttcacccttccgcctctaaccaatactatcgagtgctcttgaagattgtgtccttcgcccgggatataggcattaacttctttaccgttagaaagtcttacccttgctacttttctaagtgcagagttaggtttcttaggtgtagttgtatatactctcgtacatacaccacgtctttgtggacaagaatcaagggcagccgatttgctcttcttggcaagcgtggctcttccttttcttactaattgttgaatagtaggcatttaattgctttttattttagggtgcaaaaataggaataattttttaatctgcaaacacttatataaaaattaaaatcaaatacttacatcaaaaacagaagacgtttcagtataacaatcggtgaagcataatatataggcgaaaaatccaaagaagtacatctgttttgacacttaaaaaatgaatattaaataattatgaaatttatcccgggaaaggtttttcataattttttagttctcaaacagatttcaggagtaaattcgatacatccaaactcttttaaaaaactttcttatagttatcatctattaataatcaacggtgttcggcacgatatttcgtaaatttgaaagacaaatgataaacgcattgaattaccacacacttttcgcttttaactgaagttggtgatgaatttaacttaaaaaataaatatatacatatgaaaaatgctagtattatcggtcttaaagaagccgactgcaaaaagatctcagaaaaattaaatgtactgttagccaactactctgtattttatcagaatacaagaggttcacactggaacatcaaaggagagcagttctttacccttcatcctaaattcgaagaattatacaacagtcttgtattaaaaattgacgaaattgcagaaagaattctgacattaggagcaacaccggctcataactattcagattatttaaaggtagcaaccatcaaagaaagcaaagaagtaacagatgccaccaaaagtgttgagcagattttaagttcatttaaagtagttattgatctgcagagagaacttttggatatcaccgatgaagcaggagatgaaggtactaactcgcaaatgagcgattatattacagaacaggagaaagaagtttggatgtacaattcttatcttggaaaataactccggcaaaagcatggaaataattcaaaaaaatcgccttacatttaggcgattttattttttatttttatatttgcgttaaaattacacatattatgaacgacgtcagattaaactctatccttgataatgacttctataaaataaccatgcagaatgccgtggtaaaactattcccgagttctattgtaaaatatgaatttatcaacaggggaaaacaccactttccggaaggatttgacgttgctttaagggaggccgtaaataaaatggctgaacttaaacttacgaaagatgaaaaaaagttcatggcaagaacctgtccttatatagatctaccctaccttgattttttagaaggctaccactacgacccttctgaagtgaaaattcatcaggagggaggcgatctttctgttattgttgaaggactttggtatagaaccatcctttgggaggttccgctgcttgctttgatcagtgaactgcattatgaaatgaaccacatggaaagagattctaatgaagtggtcatgagcaaaacgattgaaaaagcggactcactgggaagacttggggtaacttttgctgagttcggaaccagaagaagacattcttataaggtacagaatcttgtaatggaagctttgactcagaaaaaggattctacttttatcggaagctcgaatgtccactttgccatgaagtatggggttaagcctattggaacccatgctcacgaatggttcatgttccatgccgcagaatatggattcaaaatggctaatgaactggctctcgaacattgggtagatgtttacagaggagatcttggagtggctttgtctgatacttataccacagatgttttcttccagcagttcgacaaaaaatttgcaaagctttttgatggtgtacgtcatgacagtggtgatgcgctggaatttgcagataagactattgcccactatcaaaaaaatggcatcaatcctatgtttaaatatatcattttctctgacgccttaaatcttgaaaaggtagaagaaattaccaactattgcagaggaaaaattggtatttcattcggaatcggaaccaaccttaccaatgatgtgggactgaaaccaatgaatatcgtcatgaaacttattggcgttcaggctcccaataaagaatggattccaacagtaaaactttctgatgaacatggtaaatataccggagatccaaagatgatcgaattagctaaagaatttttaagaattaaaaattagtaatctcatcagaataatcagataagacctcgtagccatcgaggtttttttgtttcatatcaccgtttgaaattcagcttacagaaatctgtaaggatttattatatttatcaaaataaaaacaagatgaaatcaagaatactactacttgcaggtctccttctgtcagcattttcttttgctcaggacacgaaagcagaaaagcctaaatataatcaggaactggccacttctttaggagctgacaaatatgggatgaaaccttatacgattgtcatgctgacaacaggcactacccatattgaagataaagccaaaatgagtgaacttatgaaaggacacatgaacaatatcggtaagctggccaatgaaggcaaaattgttgttgccggaccttttcttgaaaaaaataaagagaactaccgaggtatgtttatcttcaacaccaaatctaaggaagaagctgaacagtgggtaaaaacagatccggcagttcaggccggcattttcagctatgaaattttcccatggtatggctctgcagcgttaccattgtatcttaaacatcatgatgaaatctcgaaagaaaatccttaataaataagaaatccctcagttgagggatttttttcttaatcgaaacagataaatggttttcttggtggatagcagcaataagggttgctgcagaatgtgtaccctgccggacatcccccatctacaggcgcttcacaggctaatgctgcacctcctaaaacagtctttaactcttttctgtttaagctttttaaatttttcatgattaatttagtttaatttgatttcctactcttgaagattttcggattcctctttattatttctctttaattggaaataaatatacaatttattttttaattcattacatttcaaacaattatatataaataaattaaaaattttaattaatacactttgttttgatgaattaatttaactattttagcttattaacaattagcattattaaactaattaccaacaagttaaccatcaatcaacatcataattaaaaattaatctcatgaaaaaaaagaattttacaaaactctcgagaacagaactgaaagatgtattcggagggacactgtacccggcacaatgccccggaggatgtcatggtgaagcgatgatcagatgtcctgacggtaccaccacaatgactaattttatatgcattgggggaacctgtcaaccggcagccatgtgcaagccattgattcttgaaccatttcctgatccgattatcatcaccccataatctgatgaataaaaaagtgagctttccggctcacttttttagtatatttaattaaataaaaaccatcatgaaaaccattgaggaagttctgaaaaagctggatgaaatcattatctggtgtaaagagaaccaaagtccggcaggatattttgcatgtacttatagaataatgaccgcacaggtcctgaaaggaattcagcaaaaaaaatttgaagacaatccgaggatgacaacacttgatattgcttttgctcaaagatatcttcaggcatgggacagttacagcaaaggcgagaaatgcaccaactcctggtatattgcgtttgaagctgctaaaaataaaaatctgctgatcttacagcacatatttctgggaatgaatgcgcacatcaatctggacctgggtgtttccgctgcttctattatgccttaccggaaaataaatcctttgaaaaaagattttgaaaatattaataatgttatcgcctccatcaatcagaacgtacaggattctttaaacaaaatctgttatcctgtagatcttgttgacaaactttccagtggaaaggataatgctgttctcgattttgccatttccaaagcaagagaaacttcctgggcaacggccgtcattgcatccaatacatccattttcttaagagaatctgtgattggtattgtagattatgcagcagcaaaagtcgctactcaaattctgaacccgaagattctcactccttcccttttaaaagaattaaaaaaatgtgaaagcagtgatgtcgtgaagaatattgaaattttagaatctacaaaaaactcataaaaaaggccgggatcttcctcacggatcccggcctcataatgaacaaaataaaagaaactataatgcttccttatgctttttgcgataggcataatggaaaataataggcagtattgtaaatgaaagcagcatacagatgattaatcctcctacaatcatgatggccaaaggcttctgaatttccgagcccatcccattcgacatcgctgcagggagaagtcccatagaacccatcaaagcaatcatcaccacagggcggattctactcttcactccttctgcaatggattctttgagagaaagtctgttttggagattttctttcatcactccaatcaggacaataccatcgatcgttgccactccgaaaaggataataaacccgattcctgctgaaattccgaagatggttcccgtaaaccaaagggataaaaatcctccgataaacgcaaatgccaatgtaatggaagaaatcaaggtatctttaatatttccgaagttgaaatacaacagcatcagaataagaactaaagaaatcggtactaccatagccagctgttttgctgctctttctttgctttcaaattctccggcccaggtcattttatgatttttcggaagcttcacttctttctctactttttcttttgcttctttgatggtacttccgagatcacgcccttcaatattaaatccaactccgatatatctgctgtttccttcccggtaaataaatgacggtccggtatgataatcaatggtggcaatttccttcagtggaacctttttgttatcctgagtcgggataagaatattccccattttttcaggggtgtcccggtattgtttttcaaacctgagcatgacatcaaacattctttcctcttcataaaatttcgtagcagcctgccctccgattgtcatttcgattacggcctgagcatctgctgtagagactccatatttggccattttagaatcatgaagctgtattcttaattccggaagcccgatatttttgaaaacatttacatctgatattcccggaacggttctgatggaattggctactttattggcatagttttcaagctcgaaaagatcatttccaaaaatcttaataaccagcggagcttttacccctgctacatattcttccacattatcctgtatcggctgactgaatccaaaattaatacccggatatttctcaagagaaactctcatttcttcaaggagttcttctttggatatttttttcttccactcattttcaggtttcagctggatattaaattcgatattaaagaaacctgtgggatctgtcccatcattcgggcgaccagtctgggtcataacaaatttcacttcatcatacttcatgagaatctctttcatctccttcgtcaatcgtacagactcatcgagattaacactgtttggaagggtagctcttacgtagattgcaccttcgtttaatttaggtaaaaactcagatccgtaattggagaatctccatccacatactgcaagcaaagcaacgaagccaataatgaatccttttttatggtggtcactgaattcataaattctgtaaatattcactctgaaaaatctggaaataaaattttctttctcttcaatatttttagtcaggagcagtttacacattgcaggaacgtaggtcaaacttaagatcaaagatcctaacaatgcatatcccaacgtaaatgccaatggagagaacatttttccttcaactttctggaaagagaaaatcggcatcagggcaacgataaggatcagcagggcaaagaaaatataacttgcgacacttccagcgcttttcttgatgattcccagctttgaaattttgttgaatctccgcagtcctatctttttcgctttgtgctcgagggcgacaaagacgtgttctacaatgacaagcgttccttccaggagtaatccgaaatccagagctcccattgaaataaggttggctggcaatccctgaattttcagcataatgatagcaaacagaaaagctaacggaattactgatgctacaatgaaagttgttctccagttgtaaaggaaaataaatacaatgatggaaaccagaataactccctcaataaggtttttggaaacggtatgaaccgttgtattcacaagctctgtacggtcaatgatcggaacaatctgtacatcaccgggaagttctcccccgttcagttgttcaattctgtctttcagccttgcaatcacttcactcgggttttctccacgaagcatgattacaattccttctacaacatcattttctttgttataccctacctgtcctaatctcggctttgcagaaacttttacttcggcaacatgtttcaccagaataggcgtagaaccttttacttcaatctgaatattctcaatatcttcttttttctccaaaagaccgatcccccgcactacataagcctgatcaccttttgccactacatctcctcctacattaatattactcttcgaaaccgcttcatacacatccaggggggaaaggtcataattgtgtaattctgtaggattaatttttatttcatatattttttcttcaccaccaaaacttacaacatctgcaacaccaggaacggctagcaattctctttctactacccaatcctgaatagaggtaacttctttgataggaagtctacttttaatgatataccggtaaatttcaccggttgcaccggaaggaggctcaatactgtagtctgctccggcaggaagctctacattccctagtttattggaagcatattgctgtgcatagaaatcattgacatgatcatcaaaaatcacagtgactacagataatccaaacaaggaaatagaacgtaccgaagttttgttcgggatggcattcatttcctttgaaatgggtaaggtgacaaatttttctatttcttccgcacttcttcccggccattgggtaatcactcttacccttgtattggtaacatccggaaatgcttcaatgggagtatgcatataggaatagattcctccggccagcaatagaaaagttcccaaaagaacgatcaatgagttttttaaagagaaggaaactatattctgtacaaattttcgcattacttcttggaattgtttaattgatttttcaggttttcatagatcagcagtccattggaagcgatgacattttcacctgattttaaatttccttctacataaatataccggctgttggaagcaatctcggtaacaggtcttatttccagctcacaatcttttttgtaaaccactacataactttggttgttatcaaagatcagggcctttgcaggaatagccagcgcgtttttgttttgtgaattaattggcagtacaacatctgcagacattcccggtctcagcttcattccattattgtccataatgattttcgctttgagtactctttcgttttcattgaaaacctgggaaatattatcaatcttcccggagaaactgtcatcaggataggcaagcgtttttaccactacaggttgatttacataaacatgcctcatgttggtagcatagacattcgccattacccataccttatccaggtttgaaatggtaaaaagctgatctccacccgcggtaaccggcattcctttggaaatattctttgaaataacatatccgtctgccggggctttgatctgaatggtattccctcccgctgaatacagctgcatatttttctttgtcttggaaatattggattggagtatagccacttcggaacgtgcttcctgtaaatctttctgagaagcaatatcatctttatacatcgcttctacagaagacagctttctttttgccactgccagctgagcctgcaaagtctgggtatcatcctgcatttcattcacagctgtactttttacactggccagcgtctgtccctttttcacgtaatcaccaagggaaaaataagtatccatcaccactccgtccacgaggcttacaaaaggaactgtcttatcagaattactttccacttctccggtaagggttatactttcttctatgggaagcatttctgccttagccagtttaatatctttttttagctctttgctgatgcaatatcctttttcggcttccttattttctgctttaccggcacaacctgtaaaaataatgagggaagaaaggtaagccgcagcaatgtacttggtcaaatttttgttcatatcttataaatcttgtcctacaacatactgcaggttttcgtagtattgattaagttcttttttggtatccaggatgatcattttgttcccgatgtaggtgtccagaaaatccatatattccagcatgctgatattcctcagtctgaagtttttttcatggctcaccagcaaaccgtccagtgtagactcataattttcatcgatttcttctgatacctgctgtgtcctgatatagtttctgaaaacagagacaatttcattctcagatttcagcatggctttacgggtttcaagtttgtttttctcaatttccaatttagcttcctgaatatttcctttattacgatcgaagatcggcagatccatagaaacccctagtcctataaaatctttcatgatattccctccgcggtcgtattcgatagaaacagcaacatcgggagttttcatagcattttgaatttccaggtttttggcggcatgcctctctttattttttgcgatcataatatccgggcggttttctttagccttttctatccattgatttacttccagctctgaaatttgtttttcaggcatagcgaatgaatcagaaataatcagataagattgtgatggcagcatcagcaaagcttttaactccatctgttgatcttcaatttcctgttttaatgaaatgagtttctttttgaattcaatttcctgcgcttttaagcgtacatattcagctttactgatgtttccaaggtttagctgattattgtatgattgagttagtttctcaatggaagcaatctggccctgatagattttctgctgttcctgattgtaaagaatttcagtgattgtatttctgagtgttttcttaagctcacgcagaacctcctgcagttcatacttttcaccttccacttctattttctgaagttcaatattttttcgtcttttacctgctgtctgaatcacctgctctatttcagcggcaacctgcgtgttttgcccccagtttccaatcagttttggctgctcttcaatatcataggttctccacagattgatttcactgatacttaatttgggattgggccagtatttagcctgaactgctcttgcttcggcttgtgaaatctcaagcttctgagcaataagatcaaggttttttgccagaaaaatagtttcagcttcccttctgcttattttcagggtatctgaaatctgtgcagaaaagaaactgaaacaatgaatataaaatagggtaaaaaatagcttcttcaagggtctcttatttaagaccacaaagctatttgtctaagattagagggaattttaaagaaaattaaaattcggttagttcaacattagagtttgattagaacttttttaaaacacgaaaagcacaaataatttcacaaataacacgattacgagtgaaccggaaatttaagaaggacagttgttccgacattgacagtagaatcaattttcatgacaatatgatgatggtcaaaaatactttttgacagcgataagccaattccacttcctttaatggtatctacatttttccctctgtaaaatgtttcagatattttcatcagatcatcagccggaattcctcttccttcgtctcttacttcaatatacagctgagcatttttttctgacagagtaatgattacaggtttatcataagaatacttgatggcattttctacaatattatataaagccagatacagcagcgtttcgtttccgggaaattcaagcaaggcgggttgcgttacctgaagctgaattttaatggaggaatgattttctttggctttaggttctaatttctcatagattttccagaccagttcatctactctcattgattgatgtgaagattcaagtttggtcattcctgacatcagtaaaaggttattgagaatattttcgatctcatatacattttccagagactcttttgctactttcttatattcttccggtgtacggtccttttgggcaaaaacttcaagattcccggagatagctgctaacggagttttaaattcatgagaaacatagttgataaaattctgctgtaagagtacattttcagaaattctgcccagcagtttattgtaggatttaataagatcttcaacttcatcattggtattggtagaagtaattgctgtagaaatattattataatccactttattgatgcgttccacaacattggaaataggtttataaaccactttagaaagataccggctcagaaaataaatcgcaagcaaaccaatgaccagcactgaaagcataataatggaaagccttaatatctgggattgaaatgaatcgttggaagactttacaaaaacaacaaaatcaccctggttatccggataaaaaataccatagtaaaattggttatcagacatgaactgtattcctttattattccggactgcctgtaaatgggaaggttttatattcttatcattaaggttatgcccaaaggtaacctcgttattctgattatacaccgctaccctgttattctgaatcagatgattatattcctttttgatctgggcatggcggtctttcggaagttcatctttttcgagataataaatagcagaaataagagccgtattgcgaagtttttcaaaataaaaaattttggtactgtcataataggcaaagaatatcaccgcagatgtgatgatagaaacaatgccgaatgaaaggcttgaaatgagggtaaacctgtttctgagtgtcatgatcagtctttaatcaaatagccggttcctttcaccgtatggataatcttctgttctgtctcgtcaatcttattacggatgtaggaaatataaacatccactacatttgttgtattatcaaaatcaattccccacacattatgtaaaatctgggttctgctgagcaccttatttttattctccatcaggaaagtaaaaagtttgtattcagtgggagaaaattctatttctttatcattctgcgtcaccttatgaagatctgtgtcaatagtgatattgccgcatgataaatattgatcttccttcttatagcttaatttatttcttctggttaaagctttaattcttgatatcagctcttcaaaatgaaaaggctttgataaataatcatctgctcccatatccagcatcttaatcttatcgtcaggactgttcagggcactcaagaccaaaataggagtataatttcctttaaatcttataatttgtgtaagctgcattccatccagcccgggaagcatgatatccattaaaataatatcaaaatcataggtatgaagaagttcacgtgctttttctcctgaatcggcaagggttatattgtaaccggcctcagaaaggccttttatcagaaaattgctgattctttgatcatcttctaccaacaaaatattcataagtctctgaaatttcccataaatataggtattctaattcagaaaggaagccgggagaccggaagagagaagtaatggagctctggtaaatcgtctcagacatttcatcaatatttaaaatagtagaacaaacaactattattttgcccatacagcttccagccttttttcataattttggaagatggagatgatatatttaattattggatttgttgccggcggcttactgggagccattatactgtattttgcactgaaatcatcaacagtatcaaggagttcttatgatacactgaacgccttatctattaaaattcagtccgagcttgaaaactccaacctgaaaattcaggaacttacgcagaacatcagtaaagaaaaagaaaccaatatgctgcagcaggatttaatggatgatctgaaaaatgagttttctaaaatctctgctgaatattcttctttaaatatccagtttcaggaattaaaacaaatcaatcagagacaaatctcacagattgaaacccatatccttgaaaaacagacgctttttgctaaaaactctgaacttctggcaaaaaatgaaggccttcaaaagtctcttgatactcagaaagaagaaatcatcaaaattcaggaggagtctaaactccagtttgaaaacctggccaataaaattttagaagagaaaactgaaaagtttactactttaaatcaaaataacttaaaaaatatccttgagccttttcaggagaaaattgctgatttaaagaacaaagtcaatgaagcttatgaaaaggaaaacaaagaacgtttctctctggcagaaaaagtaaaagagcttgcagaactgaaccagcagatttctgaagatgccaaaaaactcacccgcgctctgaaaggagaaagtaaaacacagggaaactggggagaaatgatccttgaaagtattcttgaaaaatcagggctggtaaaaggaagggaatatttcctggaacatgaattacgtgacgaagataataatgctttattctcagaattctccggaaaaaaaatgcgtccggatgctgttgtaaaatatcctgatgaaagaaacgtgattattgactctaaagtctcgctaaccgctttcacagaattggtagatgaaaccgacgccgatgtttacaccataaaactgagccaacaccttggatccataaagaaccacattaaccagctaagtcagaaagcatatgatgactatggaaaatcactggatttcgtgatgatgttcattcctagtgagccggcttatatcgcagcaatgcaggcagatcagaatctttggaattatgcttatgaaagaagaatcctgcttcttaatccaagcaatctgatcacttccctgaagctgattgccgatctttggaaacgggaatatcaaaaccgaaattctatggaaattgccgaacgtggagccaagctctatgacaaattcgtaggctttgtagaaaatctggaaaaagtaggtagaaatctggatcaggccaaaaacgtttataacgatgcgtacaaacagctctacaccggaaatgacaaccttgtgatccagacccaaaaactgaaatcattaggaattaaaaataaaaaagatctgccgcagagtctcattgacaatagtaatcttattgaaccttcagaaagctaaatcccggtttgtatgttttcttttgcatcatatccttaccccaaatccgaatctttcaaagaaattttcgtttcttcgctgggagcaggagtttctgtgtatttgtttctgattatttttcagccttttggtacggaaaactttcaacacccttacaaattcttactactttttccctattgcgtaatctttggaacagtatttttaatggccaatcttataactttccgttttacccactggaatattggtgcagagtttttaaaaataattttcatcttatttttcggttcaattctatcctacttttacaattcattattcttaagccacgtagaacttgacctgggcaattacttttatatgttcctatattcccttgctgttggaattccaatttcaatcatctatattttatcccggtatatctatttaaacaatattcacgaaaagaaagcacacactatttctcaacatcttcccgttccagctcctgaacaacaaaatctgttaaaaatatcagctcagaatacagagcttatgatcaatgaaaaagattttctttgtgctcagtccatggaaaactactgtacgttttactttttggagaataacagcttaaaaaaaacattgatcagaataagcttttctaatgttttacagcaaatcgaaactgattctgtcaaaaaatgccaccgttcttatattgtcaatcttagaagagtaaaaaatctcaaaggaaatgcgcagggttataaattaattcttccgaaaattgactttgaaattccggtttccagaagttttattccttcaattattcctcaattacaacagccgaatccatagtttttgtcattcgtcactattctttgtcattcatcacattaaaatgaaagcatagatttaaagccacatttttgctcaaaatttaacagacatgagtaaaaacatccgcttctttttcatctttattctaggttttacaatctattatttcttcgattttttcttttttaaaaacattcagacgttttcaaaaaattggtttcatagcaaagccattgcccatataacggcttattcagtaactttaattccactgatggttacattaaaaattttgttacccaaaagaaatattttagacctgctttcattaaacagacctgttatcaaaggattttcttttgcggttatcggaacgcttccgatgtttatcggatacatgattcattttaaagcagtcagtaaaataaatttggaaaccttgtttatcaataccttttcatcagcattttttgaagaaatcatttttagagcttttcttattggagcattatatcgctttacccgacttggttttttatcatctgccttattcggttcactgctatttgcgcaagtgcatttataccaaagtcaaaatatgacagagcttattgagatatttactattacgttcttaggatcaatattcttcgcatgggcctattttgagtcggaattcaacttatggacctctatattccttcatttctttatgaatctgtactgggaaatctttaatgtatcagaaaatgtttcaggaaatttctatggaaatctgtataaactgatatcaattgtagtcctgattgcagctatcatctggtttaaaagaaaaaataaaatcccgtttgaggccacctggaaaagtctttttatcaaaaccagagaaattcaatcataaattttgcataattttgcaacatgttgatagaaagtttccagaacgataaaataaaaaatgtcactaagctccttactgacaacagatttcgtaaaaaatcaaaagtttttgtagtagaaggccagcaggaaaatgaaagagctattcagtatgattttgaacccctggagttctttatctgtgaaagtattttcaaaggagccgttcccgatggaaaaattcattacgtaagcgagaaagtatatgaaaaaatagcttacagaggaagttcagaaggaattatcggggtttaccacgcaaaggaaactcctctttcatcttttactccccaaaaagattctaccgttattattgttgaaggtgtagaaaaaccaggaaatcttggcgcaattttaagaagctgcgaagcatttggaattgatgcactgattgttgctgacggaaaaacggacttctataaccctaatgtcatcagatcaagtgtgggatgccttttcggaatggaagtgtatcaggctgaaaatacggagacattggaatttttgcaagaaaacagcttcaatatctacacaacgcttatggatgaaagtgctgaagatctttataagcgagatttcagacaacgttctgctgtgttattcggtacggaacattccggattaagtgacttctggatcggaaaaggaaaaaataccctgatccctatggccggaagtattgattctttgaatctgagcaatgccgtagcgattacctgttatgaatctttaaagcaaaagaaaggataaataatatttgattagtccttgtgacttttttattaatgagattgcttcgccttcggctcgcaatgactaagcataaaaaaaccgctccactgggtgaaacggttcttttattattaagcgtatgctagaattatttcttagcagcgtcttttgcagcatctttagcagcgtcagcagcacctttagcagcatcagcagcacctttagcagcttctccagctcctttagcagcatctttagcaacttcagcaccagcagcagttgtagcagcagcagcatctttagtagcttctacagcagtagttgcagcagaatcaacaactttagcagcagaatcagaaactacagcagcagaatcagctacgttagcagcagcagaatcagcagtaccttcagtagaagtagcttcagtttttttacaagcaactagagagattgcagcgatagcagctacgaataatgactttttcataataaattaaatttaattttgttaatattgttttataaaattttcttctgttctgttatttgaacaagacaaaggtagagcagttagaaagtttgtctatgaaaaataattgtaatacctttgtaaaatcgttttacaaaaaaacatagctgataatcaacaatttaattattttttgaaaaattgacagatttagatctattacactttgagcaacttaaaaaggaagttcagagtcaatacttaaaagaatataccccttcccacgatgatatttccaagtggaagggtatagatattatatattttcaggaagacctgcgaaaaaaagcaaaaggtaacatcagtgaaaagtcattttacacttattttaaaacttcaccggttaccaaattgccaagaatagatatgctcaatttactgagtatttatgcgggttacgactcctggtatgaattcaaaaaacaacatctttttgccggcgaattattgcaggaaaatgaaaatcctgacgaagaagaaatcgaagaactagagaaaacggtttctgaagctcctgaacttccaaaaactgaaattcagcctaaaaaaatcgaaatcagcaccccggaaaatgctgatttacaaaaatcaaatactgaaaatcaaatagttaagcaaaataacattacaacaaatgaagttgaaatttcatctgttccgccaaagaaaaacttctttaaaaagaatgcctgggcacttgttacctcagttttgattaccattaccggtattttaggttttaaagatgtacttttttcgaaaacatataaatattgtttcattgataaagacaggggagtttctgtgatcaatactttagaaataatggtagtgaaagaaaatgaatctccactgatgtataaaataaagccgggcgagtgtttttactattctacgaaggataaaaatttaaaaatgcggatcagtgctcctttctacgagcctctggaagtaaacagaaaccttgaaaatgctcccgaagaagaaaaaatagaattaaagccagatgattataagatggctgtctattatttctctataaaagacatcaagggaggaaatcctgatgaacaagttgctcttatcaagcagaaaagaagtcaacttgaaaacctgatcagcagcaatgcggtaatctatcaggtgtacgataacgatacttatggaatagaaagactggataaacagaaatatatcactcttgtaaccactccaacgacctcactgaaaaacctgaatgtaatagaaatgaaaaaggataacaaaggtaagattgtatccatcaaatttaaaattgctaccacagatgaaaagaataaataattttttaattttcaccgtgcttctgactttatttattgcctgcaataataagacttcagaggtaagcgacctcgataaactacgaaacagcaacaatgaaaaaagttatcctgccgtacagatggacagtatgcaggccattaactccatcaccaaacagaaagttcaggagcttctcgacctgtcgactctttacctgagtggaaacagaaatacagaaatagacacgctgatctattcccagatggaaagctacttccacaagcctgattcccttacttttaaaaggctgctgaaagagctggacagtatgaaagtgaaaacagcaaaggtgagcaacctgaatgtttataaagaattttataaaaaggacacattggattatgctaaattcaatgtagaatacttcgataataaaaacaagtctctgggaagttttgaaaagaatgcacaatacatcttattgtctacttcaaaactgaagaaagaatttaaattctactttttagatttttattccaaaccgcttaagaaagacagcacttctgtaggagtaaccaaatagtcaaggggaatatcattttcccagacattacccacatattcatcgggatcaaaataattgattccgattttttttgtctcaggagaaatactttgaaacagaccatcataaaatccttttccatatcctacccgatttccatttccgtcacaatacagtaagggtgtaatgacataatgaaagtaattttcaccggaatcttcattggaaacaggttctgtaatgccccaactattggtttcataaacagtatcttcgaagatttctatattaatcagtttatcagcaacaatcttaggaacataaaccctgatattttgctctaaaaaatactttatgaagatttgggtatcaacttcctttctacccggaatcgggatgaaaatgtgtactttctccctctctttcggcttgaaatacttgataaagttttcaaaaatcttctgcgataacaagaaagcctcatcatcagacaaggcttttcttttttgggtatatttttttctaagctcagctttcagcataattatcaagttgttttaactgaaataattgttacaagacaggctttggattatgcgttctccaaaattctatacagtttatcagacagacgaactctgaacggaagttcgaaagtaacctgatctcccggttttgcagtctcacaagggcctccgttggcgtagatctgagtaacagtaatttcctgctctcccgttgtaggacctgaaatcaatattctatctcctactgacaggtctttgttttcaattaagaactgtgcaatttttgattttgaatagtaatgttccgcttttccgatcagctcttttttaacagcaattttctgacggatattttttgtttcagcttttgccagaggcttgtccggtaagtcacctgattttttaaacttcaaagcatccgattttccttttctgaatactttattgccaacctgcagtccttttctcagttttacctgctcatcccaaggcaaatgtatgatatccagacattctgtagaacagcagttttccatggcggctttacattcgtcacattggataaataacaaatggcaagcgtcattagcacaattcgtatggttatcacaaggtttaccacactggtggcactgtgcaataatatcatctgtaattctttctcccaaacggtggtcaaatacaaagtttttaccaatgaacttacttttgataccttcttcttttatctggcgcgtgtattcaatgattccaccttccagctgataaacatttttgaagccctgatgtttgaagtaagcactggctttttcacaacggattcctccggtgcaatacatcaacagatttttatcttctttaaaatcctgcagctgttcattaataatcggtagactttccctgaagttttccacatccggcgtaatggctccttcaaagtgccccacttcactctcgtaatggtttctgaagtctactacaatcgtattaggatcttccagcatattattgaactcctgagctttcagatgaatacctttattggtaacatcaaaagtttcgtcattgagaccgtcagcaacgattttgtttctgacttttatggttaattttaaaaaagaataattgtcctgatctaccgctacattcaagcggattcctttcatgaagtcataaacttccagcgtatcacgaaaagcctcaaactgatctgcaggaacgctcatctgagcattaattccttcagtagcaacataaatacggccaagtgcatccagtgcgttccaggctataaataattcgtcgcgaaattttttgggatcttcaattttggcatacgcatagaaagacaaagtaaggcggtctttaccggcttcatcaataagtttagctctttcttctgcgcttaaggtgttatacagttgcatgctataaacgttttaagtgagaataaaatttttgcaaagataatcatttagaattaaattgattgatgataagaatcacagctatatccaataagtgatgagcaatgaatattaaataataccttatattgagaaagtctgacatattttccttaatttttttttaagttttgttaactgtgacattaacaattatgatttaagacacaaaatgatataatagccgttaaattttagttaaaattgaaacatagcatactaattgcttacttatttaacattaaatttgtttactcaaaaacataaaaaagaaattaattaataaacaagaaagatatacaatgaagagtactttaaaaaaactattaccatttgcagtagttggggtaatttccggagctactaccgttggagctttacaatatttcggacctggttccaacaatggagatcaatcttatttcacaacagccgcaccaaacacgtcgttcgcaggaatgaatacggcagctgtaggtgatgactttgtaaaagcagctaaaacaaccgttccggctgtagttaccattaaaaattatcaaagcagaacttcaagcagagcttcagagcaggatttgtttgactttttcttcggagatcctttcgggggaagaggccagcagagacagaagcagcagcaggctcctgataatatgccatcaggaatgggttcaggggtaatcatctcgccggatggttatatcatttcaaataaccacgtggtggccggagctaataagctggaagtcgtattaagcaacaaaaaatcatatattgctaccttggtaggtacagaccctaacacggatatctctttactaaagattgaagaaaaaggtctgccttatctgaattttgccaactctgacaatattgatgtagggcaatgggtgcttgcagtaggaaacccgcttgggttaaattctacagtaacagccggtattgtttctgcgaaaggaagaggtatcggaatcttaggaagccagggaaaagcggctaaccctatcgaaagtttcattcagacggatgcagctatcaacccgggtaactccggaggtgctttggtgaatactaatggagagcttatcgggattaactcggcaattcagtctactacaggatattaccagggatacggatttgcggttccttccaatctggcaagaaaaatcgttgaggatatcaagaaattcggaattgtacagcgaggattcttaggagttcagtctctggatctttcaaatgatcaattggtaagttcgtacaatcagcaatataaaacgaacctaaaagtagggtccggaatctatattacaggatttggtgaaaacagcggtgctgaagatgcaggtttgaaaaaaggagacattattacgaaagtagacagctatgacattactgatttcgcagatctttctatgtctatcggaagcaaacgtccgggtgataaagtacaggtaacttatctgagaaatggtaaagaaggaacaacgaatgtaacgcttagagaccaaaaaggcggaacttccacaagaacaaaagcagatcttagcgtaactgaaaaaatcggagctgagttccagagcattgatgacagaacaaaagcatattacggtctgaatagcggcgttgttgccaaaaacgtcttagaaggaggcgaaatggccaaagcaggaattgtagacggttacatcattacagaaattaatggtaagcctataaactctcagaaagacgtagaaagtttattgaataagttctccggaaccgcacaaataaaatatatggacgactacggaagaaattatcagagagggtttaaaatgccttaattagaaactaaattagtttttcatatcaacaaaaaacgctgcagaaatctgcagcgtttttttatttacttatttattacttattcattttttcagcaattcttttcttcttattgcgctcatagatcacttctacaattttacctccgatccaggaaaaaggaaagaatgtaaggaaaatcgagatcttataaaatgtaggatgataaggaaaaataattacatccagcattgcgataaagagcataataaaaccgatcagaatagcataggctactttagcatatttaacgatgattgcagtcgcaactcctcctatcgtagttcccagtccggaaataaacaaaaggaagccgaagaatgccttatcgtctttcatgctgaaaagaaacctttgccagtgctcaaacggagcaaaagcctcaaaagttacccattgcggaaaagcccttataccaagagtgattataagccctgcaataccaagacctatcagaaccgcaattgtatttcttataaagttcattaatcctgatgtgcaatcatagaaatttcgatatccacgtttttaggcaagcatgaaacctgtactgtttcacgggcaggatagctttcagagtcaaggtaagaagcatagatatcattcattacagcgaaatcatccatattctttaagaagattgtagcttttacaacgtttttgaaagtcatgccggcttcagtaaggatcgcttcaaggtttttcattacctggtgcgtttctttttcaattccttcaaccaattttccagttgcagggtccacaggaatctgtccggagatatacaaaactccgtttgccatattagcttgtgaataaggcccgatagcagcaggtgcattaactgtgttgattacttgtttcatatgcggatatttaatttttttctaaattcatagactgtcactgccttttaaattctttggtattcgaatctgccggcagtggctgcatcagaaattcttttggttgcaaatataaaatttatattcacaaatgccaatctgatattagaaaggcgcattaggctgggtaaagcttctgtctttgtacttcagtgcatcacttaagatattggctttgatgccgataaagaagtcgtatactttatactgtccgaacggaacccagttgaaattgattgtaaaacttcgctgatctcttgaaaaaccaattcttgtatatgccaattctttggtcaccatatcataatgggtacttccgttaatattccagtaaggcgtcagcttgatgctgccatctaatcctaaggatgcaattttattaccaaatctgctcagtcctttagaatatgcgtaattggcgctgatatttaaagtccatgcctgatcaaaatgtgcataatgatcatcatcaaaataataattttcatttcggacctctcccttagaagaatattttttggcataatctgttttttctccaaaaatctcactgcttaaaggataagataactgaacgttgaatccctgcacactgaaatgcccgaactgctctgttcttattcctgtgtcctgtcctggtaagaaatcaatcttataaggttcaagtgcaagactggtattaaccgttaatttattattgaaaaaagaagactgtccgttgattgaaaatacagaccaggggtggtctttagcagcgaagttatagcttcccgcaaggtttaaggattcaaaaattttgattttcttcactcctgtagaatcgctcttagactttattttcatctcgatattgttaccgatattgaaacctaaagctccctgcattccgcttgacggacttccgataatccctttttcaaagatagaataaggcgtcaatgctcctgtagcattataatagttcctatagtatccgaaattaggacttgagaaatccggagaatatgtgaagcttacacttggagtcatcatgtgtcttacagcttccaccgctgaaccttttttaaatttcagcattccgtacaatgtagtctgaagactggctgaagtagagaatgtagagtatccgctaaaatttttctgaatctcatcaacagttacattttttacaggatcataatacctgttcagtgtttttgtagtcagagcattgtcaatattggcacttaagctgaatgtaaagtatttagccaccgttgtattggttgccaatgcgatattatttttaagtccggtctgcattttatcccacatttcttttttaaacagctcattttcctgagtatttacgaaattggtaaggttaaatccggtatttaccgtgatattttcaaggagtccctgtctgatccctgttcttgatttaaacagatagaactgattgattgctacgttcatctgcggaagacgaagatctgccaatcccgttgcaaagttctgagaataagaagctgttcctgtaatagtcatcggaagcttcaggaatcttttggtaagggttaccgtagagttctgctgggtattcagtacattctggttgaaaatgtaattgttgttaagcgggttattatagaatttggtacttacaatatccacagaagcactgaatgtaaggaaaggattggctttagaatcctgagagtgagtccagttgattctgtatgtactgtttttggtataatcatccagacctttaattcctcttaccatggtaccgatatctgccgtaaagtttcctgagtaacggtatttcttctggtaattcacctgaggacgcaggttccagcttcctttggtataaatgtctgctaaaactttaaggtcaaagtgttccccgataggctgataataccctatcccgttcaggaagaaacctacatcttccctttccccgaaactcgggatcagaatacctgcagctcttttatcagagaatggtaaaatggcaaacggaaggtaaaggggtgtaggaacctgctcaataaacatctggataggccctgttacgatctgggattttgttttggttttaatcagcttaatattgtaagctctcataaagtaatccgctgccgtatcttttttcttgataaaataatcatccgttgtataatccgcttttctcatcgcgaatacagaatcattgtatttttttgttttctgtgctataattactccttcactttcttctgttcttgcattgaaagcgatagcttgtttcgtttttgtattatagctgaactcgttggtttcgtatttttttccggcctgtgttgtaatgacaggttcaataatctttcccaatgagtcctgttttcctctggcgtagatcaggtttttgttatcatcaatagagatataatctgcatcaatctgcatatcctggtattttacctgcgcatttttattcaggaatgtcatttttttcggaacatctctcctctgatcgtctgcttttgtacgaagaacatcatttaaagcttccttttttacaactatggtatcctttttggaaatagtatcattaaccgcatttttaggcaatttttcaggagttttctgtgctaaaaaattgttaaaaattaggataattaaaatttgtaatatatttttgaagacggttttggccaattttatactatataattaaggcccaaaattaatataatttttataactgtaagatgcacaaacaaaattttaaaataattttatcatttctccttatccttgccagtaactttattttctctcagaagaagtttacgatcgttttagatgccggacacggaggaagtgatcacggggccaacaggacctattccgatatcggaagaattgccgaaaaagacattacacttgctatcaccttaaaagtgggtgccatgttagaaaagaacaaagatttcaaagtaatttatacccgaaaaatagacgaatatccatctctttccgacagaacaaacctggccaacaggagcaaagcagatcttttcatatctattcactgtaactcttcccagagacctacagcttacggtacagaaacttatgttcagggacctaaccagaataacgaaaacctggaggtagccaaaagggaaaatgatgtgatcttcctggatgaaaaggataagcagatctttggttcttataatcctgattccccggaatctctgattgctttgaaacttcagcagagtaaatatctggaatcaagtcttcttttgggaggattggtggaagataactttgtgaataaggacaaaagatcttcaagaggagtattccagaaaaaccttcacgttctgcgtatgaatgcgatgccatctgtgttgatagaaacgggatttatcaatcatcctgaggaaagtcattatattgcttctgacaaaggacagactgagattgcagaaagtatatacaatgctgttattgactataaaaaagcaattgacagaaaatccggtggctctattgctgtcagaaaacctgagcctgaaaaaccggcagaagttcccctgaaaaatgacttcagaatccttctgatgagctctcctatgaaatacaatgaaaatgaccctgctcttaaaggcctaaattatatccttacccttaaagaaaacggacaatataagtattactatgctgtgaccaatctggcgtctgtaaaagatattaatcttaagaccgccaaggatgcaggattcagaaatgcttttgctgttggatttatgcccaatcagagaatcaatatgggttattatacaatagaagtatatgccggagataagctgaatggcaattcttatattcttcagaatctgaaagacgtggaaagagaaaaagacaatggagtattctattatacctatggaaaagtgtacacattagaagatgcagtgaagcttcagaaggagcttgaggctaaaggcatcaaaaatactgtgatacaaaaagtctacaaataaatcccgaaataattttgaagttaaaaagttaattattacttttgcaacctcaaaattcggcctattcgtctagtggtcaggactcaagattttcattcttgcaacaggggttcgattcccctataggctacaacaaaaacaatccctgatcagtaagttcagggattgtttattccaaaagttaacagaatcttcacgaattttaaaagaactctcatacacgctttgtacaaggcgaatttcgaaaatcttttttgttcgctaaaattattctttccttttgttatctttttgtttcttgaaattggattggaaatattttcttcgctctcaggtatgaaagttctttgaatttgcttctttgtttgaaaaagagattggattgggaaaacaaaaaacaggttcaaaataagcttgttcttttcagcctctttttgtgaaattattcttcaatatccaaatacccatgaggagttatgatatataacaattcccctgtttttgcatgaattaaaattcccatacttctttcttcaattccccaaatctctccataggaaattgcataatgatctatcttttcccctttgtattttccataagaaattggataagtcatttcttcttttgacgtaagtgcaattttatcaatgccatcaatacttgagtaattaatatttttatctaaataacttttaattttattataagcttcttcttttgtaatcataattatttaatttttaaaatttcacttgctttaatttcttttctgacctctggtattttattgatgtcaaaatcaactgatacgggatcttttccaaatcttgcccttacaccaagactagggttgggattattaatatagtcaaaagcatgaactatttcactttttgttagatagtccttattcttcattagcatatcgaaaacccattgttctttttcaagttctcccaaagttccacgtcctcccaaagataaatatttttcgagtcctaatacttgagagtgtctataatgcataaattcgtgaaaaaactcataaattgttgcctcttctctcaagacaattttcatttttgtaccatcagtaataaaaattgcagcagccctctcaggcatcattgcaggaacgccttctctaacaaagaatccttctattggtaatgaaccctctagtggatgtaattctaattctacttttaattttttaagttcctttattaaatactcaatatccactttcctaagtttttgcccaagtcttctacctcttccagatacagccacttcatcccattgagctaaaagttcctcttgcgatggagtttctccaattaattcatagaattttttgcgaaaatattttaagagatttcctgtttttacagcttcaataagctctaaaaattccttttcaagccatttatagacgtcttgtgcagtatttgaaattttctttcctaaatttttagaaaagttcatagcttttgctcctgcctgttctgctttggctgtcaacctactaatttttgcagatgcttcagcaactaatgaactaccacctgtaaagtaggcaataacagcatctaaaatcaactcaaatgctactccaccaataaagtaagcccaaaaatattcattaaggttggaaaatttctttcttaaaaaagatattaaagaagaaacttctttccatattttatcatcagtgaagagctttctaacaccatccagaaactcttttgcattctcattaaataaatctacaaaatcttctataaactctagattctcttggtgctttgtcagttctaaaggacttagcctttctaactcagaaataggtaaattgtccactaccattgctaaaagcataataatcagttgaactaaagatataagaccattgagtattccacacagaaaagcattgatttttgcaatttcttggtttagcttttcactgattatacttcctatacccgaaacaatatccagaatttccttaaatagcacttttagctgattgtaaatattctttatgctgtcaggcatgttatcctctataaagttttttgcaagaaatgtaacagcaaacaaaatatcatcagcaatcgtaggggttgctgcaacgatattgaaaacagcagcagtggagatttcatcaaacgaggcaacaaactccgaaagcttttttaatcctgcttctgcaatattctgagcattatcagacatatttttgtactcattacaaggaaatagaacaggaataataggtttgtattttacttcttgtttcgggaaaccatttgcccctattttattttgaaagttgttatacatgggttctacataaaacttgatataatcatagttttcctctgtaaatttccatttctcggtagcttctatgcctcctcttaaccaatctgccaattggttgtttaatgaagagacttttttaaaggcttcgttgattttacttttttcaagtatttccaaataaatagcacctttcaataaggtatcatcaattccataatctttagcaatcagctttatgagaccattaaaatctgacacacttccgtctactgtattaccatcgtagttaatagttttccccgtgctattgtaatcctttattaatctttgtcttgcatactcccccatttttacccgacaggctgttccaaaaaaattactagtgcttttggaagtcatctcatagtaaatagtaaaatagtttgattcaatggagtctttttcatacctgtcaaaaacttctgttccactttcgcaaaaaacagcctgatggtgaactacactatacttttctgatttgggatagctttcttttaactctggaggaacaacaaatgtttcataaaatacactgttttctcctaaggggctgtcaatgtctctgctcaagacataatctaatctttgtatcatatcatttgaatttattatgagccaaatgtagatacagacagcgacagaacttggcgttttattttgagtttaatttataatattattcttttgaattcaaattcctattaatctttgtgatgcattgaattatttaaaaggtattctatatatgttatatgtaacaaaagcattatatttgcaaaaattttagccatagttggtcacacaatatggtcacactgatgaaaaataatattgataaatcattgtttgtagtttgctacaggctatcaaattttatatcatgccggatttaaaaatacaagaagcgaaattgctttttaagaaaatccactctaacccaaaaagttatgatttacaaatcaatgaagacgggattacaggcaaagatgataaaatcagtttcagactttacaggactggagaaagggttgcttttgaagtaacaattgacggacttactttcaccaatactactggagaatggaacaatgcactgatcatgctgggaaatacgatcaaaaaattagaaaaagaacaagaaaatttaaaaatagaacaggcaataaataaactcagaaagtacctatcagaagaaaattaatttttttaaaaataaatttggtagtttaaaaaaaagtttatagttttgcactcacatttaaacgatatggcaaatcataaatcagcactaaagagaatcagacaaaacgaaactagaagacttcgtaacagatattaccacaagactgctagaacagctttaaaagctttaagaaatgaagagaacaaagctgctgctacagaacaattgccaaaagttatcgctttattggataaattagctaagaaaaatattatccacaaaaacaaagcggctaacttgaaaagcaaattaacaaagcacgttaataaattagcgtaataatatagccggcccgttcgtctatcggttaggacctcagattttcattctggtaagaggggttcgattcccctacgggctacttacatcttgaaaaaccactgtataacatcagtggttttttaaagacaacgtagtaaagctatataaaacataactaaccggcccgttcgtctatcggttaggacctcagattttcattctggtaagaggggttcgattcccctacgggctacaataagagttgatacttataaaaacaaaaactaacctattactccggtaatagaagatagagggcccgttcgtctatcggttaggacctcagattttcattctggtaagaggggttcgattcccctacgggctacaaaaggactttttcggaagtccttttttcgttttcatacatctatattcagctattatttcaaaccatatatagatggtgacttctggatatcttctgatttcagattaggcaaaaactttctcaattataatcccattaatcaaaccgataatgctatttcattttgagcaagctatattaaattttattaaaaatatcaccagttgtagaaatattattttctttttactccttttatacttatatttgattaaactattcactctaaaatatataaagtgtaataaggaaaacctgtttattaaattgtaattaaaaaatttaatcataataatataagtacgataaatttttaaactgcgtattttaattcattttcaaagtgatacgaaaagaaaaccactattaaataaaataaattcataatcacaaatatcaacaaattattaacaaatcacacaaatatgaaataaattagccaacataatcattttatttataaatttacaaaaaagctaaaacccaaaattttctacatatgaaaacttatttattacttagccaacgcgcgatgaaagccgcaattttggcatcgttcttatttttaacaagcgcaatgtcttttgcacagattgtaaaaacttatgcaagcagtcagaccaatcaggtccttggaatatgtcttggttgcggtgtattgaatccacagaatgctgtagggagcaacgagaatgactactctactttgcaagtttcagtggggctcctggcgagaacagagcagacattgatcttccctactaccaacattgcaaataataccaataagcttgttctggcgattggttcaaatggcacgcctttatctgctcaagtgttaggtggcgtttctattgaaacatttaatggagatgtttccaataatgattacaaaacgcttgacacacaaattatcacccttggcgcaggagatccaagcaaaggtgaaattgagcttacaatgaacatcccttttgaccgtattaaaattaatgtgaattcaggattattgaatattggtggtgaacttagagtatactatgcttatcagtacaaagatccatacatcaattttatggctcataaccaaaacggacagtttactcttgataaaaatatttcaacagccggttcagaagtaacgcttacgaatacttcaggaaaagaggtattccgttccaagctgacatcaaatacttttgaaaccaagcagccacagggagtatacattctgaacatcactacaaaagaaggaaaaacatattctaaaaaagtgaccattaagtaacaaaaaatacataatagatcgggcccggcaagcttaaaagcttgccgggcttttatttacaattcatgcttataaaaaaccctgaccaatttggccagggttagactaacaagattaactatctaaatagttattagtttttgataactttttgctgatataccgctttatctgttactgcttttacaatataaatcccctttggaagagcacttacattgatttgcccgttattcagctgtgcattaatgactctgcctgaagcatcataaatggaaacattctgaattttctcctgtgttttaatagtaagaatatcagtaaccggattaggatagatactgaattcaagtttcttcacctcagcagtagctaaagtagatgttgtactagttaccacaagtgttttctctactaattttccgttagagttaaagctgatcacaatatcagatgttcctgaaaccagtggtgttaaaacaagctcatcactattattaattactgcggaaacgactgtaggattgctgtttgattttatagttttaacaacggataccgccatgttgtctgcatcagaaattactgatttcagatcgattgaagtcgtatttgctgctgtaacctgtgaaggtaaaatattacttacaacaggaactgaattattggtaaataccgtcaacgcagggaaccaataataatcgttcagtgttttggtattggtaagcgttccgctcatattgtaggtatgaatccagtttttctggaagtgtgcaccatacccgctttctgtggtattcagaacaagttcaccggtaacggggtttacacgaagagctgcaccgtaaggaatttgcttaaactgtcctgtctgtcccggaattgcggcaaagttttcattaaatgtttttgttgtaacatcaaatcttacaatctgtgttcctgaactaaagctgctgattgaattgatccagtataaggcattttctttgctactcgctgtaaatctacctgcattccatgcaccccagtccccaatgtatttagtggtaggtatattgtaaacctgtgttgcaaaagtggtaggattaatgctgatcagcttttgatcctgaattccccatacactcccgtctttagcctgaactactgaatagaatccgccggcaacagtactcacgatggtatctgtattgggatcgattactaaaattccgataccctgctttactgcaaatacatattgtgaagtacggatcatgtttccaatctggccggtcccgccggttccggtaatcaaagaacctacctgcagattatcaatattgaaaaggacaattccggtagaagtaccgatataacctttatgtacattcactcccacaaaagatcttccatcaccacctccgatattattaaatcctgcaattttctgcatggtctgcgcattggcaacaaccagtcttccacccggagtatactgagtatctcctccatcggcagcctgctttgatacgaagtaaaatttatccccgtagattgttccatattgtgtagtggcaccgaaagcctggttattattggcattactgtacactcggtaattgatctgaccattattgtcaatgaagtttacagagccgttggtatgaccaaaccattcttcgttcaccataaaatatccgttggtatagttcgtagaagctatatatggagaaaccggagtaatggtagaagaaacaggtgtttcattaaatcctacattgaaattccatacatcccatgaaccattttgcaatgtacgtgaggaagctccaacactggaatatccgaaatctgcatcagccggatttttcacccaatacgcccagtatccgttaacggtccatcctgactgccagtgatcattggcagcatctacaattgtatagctgtcaaaatcataagccgttgtgtttacaaaaccgtttacaggatataacggatatgtggtatttccgtttttaatgagagcattggtaccttgaccgttaagatcaaaacctattcccccgacggctgatccgaactgtgttccctgatacagcaatgtgtacagcctgtgatctgctttagcaatagctttaagcatgtcttctcctgtggcatttccgtcccatttgaatccccagaccatagcatcaggatttttagcgtcattccactgtactacaaaagcagcctggttggctcccgatcctacccaatactgaatatcagaaaaactgatcgtagtggtattaagttgactgatctctgaaatatcatttctgggtacaccctgaacttttatctgtgcattagataaacatgcaaacagaaaaagcatcataaaaagataaaactttttcattttttattaatttaaatagattgtattattgacttattatttaaaatgtaaatcgtaagctcctgccacttccgtagaaacttctcccagccagccggcttcctgattgactcctgtatatattttcataaaatcaattccgggaagttttacatattttccgcttctgtctactgcccaggaaatatcgatgtttgaagcttcatcattattcggagcattatcagcatatccaaacgcatacgattttcctacccaataggaaccgtctccgttctgatcgaagaaattatttgcaagcctggtccccgaaaagccgtaagaagtatcggtaaaccacaaaggataatagctttgcgcatgaaaggtattttttgttttgaatccctgattacccagattgtcactccacttgatatattccacatcggtctgccagaattcagttccggctacaggtgttttattttcgttaggtttataataggttatactgtaatcttttacggttgtgtttttaaaatattcactgccggcaatttcataccattcatcattatccggctttccgtttttgtttctgtcataagcgaccataataattcccggttcacaggatcctgaacgaggttcactggcatcatttccaaagaatgcatttcccagtactttaaaatctcttccattcaggttgggaatcgtgtgatcaaaaccgaacactacatatccgccatatcctcccaggctgatcatggtagagtttcctcccaccaaagattcattggctttctgaagcatattcgcagcagtattccctggtaaatattccgggatttcattcatgaactgccctaccgcaggacggaactccaatacttttgaaatgtatttactgtaaggtgttttttctttggtaacaatgattttagaatgaaaaatctgttcgtttcctttactgttaatctttaaagtcagaggataagcatctgcattcagacttataaattcaagctctgggttttgagaaataatagaatcgttaatactccacgtaaccgatcctgatgcattcgtaggaatacttaatactttcaagcgctcaatagtgtaagaatcatcaagccctttaaatgtaaattcatcttcgtcatcgtgtttacacgctattactcctataaggaagcatgatagaattccggcttttaaataagtaaagctatttctgttcatttctttaatatttggttatttgtataaaaaagcgaaatgggcagggatatttccgccttccgttttccatttaaagtgtccgtttttatcaaagcagtacacaaatcccatggaaacgtaatttctggcatctgtgatgtagatatcttctgtaatggggtttacggctattccgtaaggggttttaatagcggtttcatattctttatcaaaaatactgttggcgataatctcttctgttttcacatcaatgatcccgaatgattttttatagctgtgggtattgtaattgaattcattgccgtagaaatagagtttatcattaacaattgtcatttcactgactgagagatgaaaatttttcttgacagttcctgttgatgcatctattacataaaggttggaaggaacattgtaatagtctcctctggagctcacatacagatcaccgtaattgtcttttttaatgtgatgaagattaatggcaacttctatttttttaatttctgtaaaagtattcagatcgactacggaaactgtattgtcataatcaggcgctttgtatcctccggaattggctacaaataatgtatttcccacaatttccatttcttcaggctggtatcctactacaacttcacgcttgatagtgagagatgttgtgtcaatttccactactttccctttcggggctttcgggttaatcgctaccgggccggcataactgctcgcataagcttttccatttttgaaagcaaggtatcggcagttttgcaaaggaattgaagtaatacgtttagtggttctggcatccagcacttcaattttgttggaaacgttaacaacaatatagagtttgcttccatagattttaatatcatttcccacatctcccagttcttttaccacattgggattgatttccgcataaatatttctgaaataagttcccttcgtataatcaaaaaaatcgagggtacatttattacttcccatgtttccttcattcagcatgtaaaagccttttattgctgtgttttctgagggaagtccttccaccacttcctgacggacaataatatcatctgtacggcatgacgtaagaaaagctaagacaagaaataaaaaataaaagtttagttttctcatagggtgaagtttagaataagtttaaagtttcttccgggcatcggataattgattacaacatcgtagtattgattgaaaatattattcatctcaaggcttactttaaattgatgatttgcccagttgaattttttctgaacagagagatcatgcgtataccagggttgcacataattgtactgaatattgtcctggttcacatcatatctttctcctacgtacattgcactgtaattgaaactccagtctttataatctgccatcagactgaaagatccgctatgccacggtgtgtaaggaatctgatttttgtagaaagtatcttcaggatcactcacatctcttgcactttgataagtgtaggaaaataacggtctaagagttacttttcccagctgaagttctgtctgtatattcacatcagcaccaatgatttccaccattccaaggttcatcatcagccagcggaacatgcttccgttgggagcggctacaattttatcctgtactttattgtagtaaccatctactttagcataaaaggttttaaagaaacgattggtataattcttctgataggtaaatccaaggtcatactgattggtaaattcaggttttaaatacgtgttcccgatattggtataatacagatcattaaaggttggaagtctgaagattcttttatagaatgctctaagggtaagctccggaatgatctccggctgataactcataaatacggctggcgtccattctctggcatctcccggccttttgttttttcttacttcttcaaatgtaaaggttcccaacaggcttcccagaattttgaatctgttccactgataggttgttgccaaggctaccaatgtggtataccgtgtaggataagaaaagttatccagattagcatccagattattgtactgaaaatccccactcaggctgacatcccatttgggagtaattgaataaatattagatgaagaaagataaagctccctttgaatataggtgttatcggtatgaataatagactgcgaacgaacggtatccataaaatgggtataatcgtaagcgaatttagcttttagctgagtttcgaatttcgggaacagctttttcctaagattggcctgtacaaaataattctcatcggaaagtctcgctcctcttcctccaaaacggccattcacaatgggagccggcattccacggtctgaaatataaccataccctctgatattccagcttccgttatttaaagttccattgatagcagtttcaaaacgttttgctttgatatctgagtcctgtctctttgcgatggtatcataagcctgctgtccgtccggatatttcttcgcataccggaacctgtaaattccgccactctgcataaattctccgctgaagctggcagaaactctgtctgaaatcttctgttccagcctgaatgaaggattaaagagatctatagaagcacttttagctcttatcacaagattggtttttcttgtccctttaaaaacaggtgttttaggctgtaaatagatagagcccgaagatccgaagtcttttgcaggttgaaaaatttcacttttctgcccgttgtataatgatatttcttcaagatcatccagagaatatcttccgagatcaacaagtccgttctgggcattccccaattgaattccatcatagaaaacccctacatgctggcttcccatacttcggatattaatggtttttaaaccacctaatccgccgtagtctttaatctggacacccgaaaaataccgcagcgcatctgctacagaatgactattcaacctttccagctgctcgccctgtaacgtttgtgcaggaaggatttctttaaaattctttttataaagattgattcctttaatggtctcctcctgaagactgtcttttttcttagtttgggaaaacaaaagctgagatgttaacaccagtacagtgaaaacagctttatgaattgcagaagtagttagttttgccaccattagctcatttaggataatgatgacgctaatggatataagaatacaaagataaagcacagctatcactgcacagaatcattgatgtcctaagctttattccacgaaagcgtcaaacgattattatctggcaggtcttctgacttactccatttttgaaatccttcccattcctaaaaaacagtggatatattcttcaaaaactttggtgcggagcttacagcagcgggtctgtcccggatttgcaccggattcccttttaagagctttttacggctcaccaaattccggcaaagataaataattattcctaatacccaactaaaatcatgatttataaacaattaaagctcccgaaggagctttaacatgatttcaacaaggatttctttttaaattccaaaattcagaaaaatactgaatcttgatttggcttcaatatctcctcctgccagatgagtgtacatgggaagcatgacttcacttcccaggctcaacattttataggaagcttcaaagcctaattttccgtacaaggcacttcctgcagtattcggtagcgcttcatcaaactgtttattctgagcatatacttctccctgaactccggtttttacagagaatatagatttttcgtttccggcaacctgataaaaacctgtcgcagcatagttccattggtttccgaaacggtaatttttcttgttctctgttttgatcgtataatctgtattcaccagtactgccactttatttttctgaaatttatagtttaaagcggcctgataatcccagcttccggtccccaattgaaaacttggattgacaccggatgctcctttctcatcaaattttcccagaggaattttcacgcccaagcctccgctcagatgatggaaattatctttagaactcatcaactggtaaattcccatcaggttcaagtctcctatccctttgattttaatatctccctgcatcgttttcttttcatggaaatggaagggcagacttgcgtaaacactcagttttttcgtcaatggaattttcccccaaagctgcagggtattaaaatactgatcctgcgtaaggtcttttacaaataaattttctttggctttgtaatgctgggcgaagtatttgattccaataaactgtggattcagcaaagattcaaaaccggaagatccgtttcctgcagcacaaccacaagcatcacaatcatcatcaaaatcgaatctgctaaaggtctccggagtgctataagcactgtctcttatggtttttgcctgatactgattcaacaggatcaaactgagtattattataatcttcttcatgtttctataaattattctgcaaattttggattggatataaagcttttatccgataatgttttcaggaatgtaatgattgattgtttttcctgactgttcatggcaattcctacatgaccgttctgtttcagccggggatcaagattgggattatcttccacctgatctgaatagaaattgagtactgcttccaaagtgtaaaaccttccgtcatgcatataaggtgcagtatattccacatttctcagacttggaacccggaatttcatccagtcaacctgattgagagtaaccctgtaacgtccggcatccttgaattctgtattgtaatacattcctgtatttcgaaaactttcatcagtaaacagttctccgctatgacaggaagcacatttctgattaaacaatgccattccctgagattccgttgcagtcagctgttcttttccctgtctaaatctgtcatattttgaatctgcagagattaaagaagccataaactgtgataatgcctttagaattctttcaccggtaatggtttcgtctccataggcttctctgtacagttttttatatttctgatcgtcttttattttcgaaatggcttccggtatagagctgtccatttcgttcacgtcggtaatcgggctgatgggctgttcattcagattatgaatcacaccgtcccacatatatcgtttcaaaaaagccatattctgaatgggtggagcatttcggattcctattctgtcatccacgccatggcttactgtatgcccgtgatgagtaaaagcattttcctggatatggcagaagccgcatgaaatggtattattcctggaaagcctgccttcatagaagagttttcgtcccagctccactccgttttttgtcaccggattggctgattgattaaaagtcatttccggaaaataagacggaaactgcaggttgtaggcttcatccttttccaatggctggataacctcatcggaacatgaaatacagcttaatataaataaaagcagaaccaatatcgttttgataaaaaaattaatcattgtgaacgtggtctactttgaacatttttgtaagattattggtaacgtctaccagatgctggtttgaacccatcaacatgtcattggctgtagtaagagtaagtgctttatctccgctcagaaattggttcaggtccgccagaatgtgaacagatggacgaatctgtcctgtaactcttgctgttgttggaaagctcaatgtgatttcccgataaaggttcggtgtattattggctgcagtattgcccatatttccggtatgattcatgaattctttagctggagcatccgtaccatattttccttccagctttacaaaaacatagccggcagcccatgaccaggacattcctttctgcttggctttcgtccagaattcagcctggccgtcctggcctaataagtaggctttctgactgattcccaatccgaatcttatttttttataattgtttttcggaataccatccagattaagatagataattccggctacggcatctgcctgatcgacaataaatgcacctttatcagggttgttttcattgtatttaaactcgtttccgttctcgtctatcagtgcgatattactgatgacgtatttcaaagcagaaaaattatgtttctgaccgttggaagaggtctgaacagtctgattcagaacaatgtctcctacgttattaaatccgttttcaaacttgatctgaagttttccgagcgtagtatcctgtgaattttcttcatccctgctaccttcgcaggctgtaaaggataataaaataaaggcactaaagaatagtgataaaaattgagaaattttcattgttgattttttaagttgaattaatttgaattgctgcaacagcattgtttttaccgtaaaaggcacaaaaatccccacacttaagctatattaagtgataagctttatgtagaacaataagaacacttaagcttttaaaaatcaaacatttaaataagcttttgtgacttttgcgattgaatagtgatagttttaacttaaaaaaccggtggtttgaaaatatgggttagaaacaggaaagaataggctgtttcgtaagtgaaattgaagctaaaaaacggacttctttccgtagtattgatcgctgtagtttcaggaagaatataagtatctagtattttctgtcctgagtttttgagtttctgaaaaggggaagattctgagtcattggttttagccaattctttactcagataacattttccattacagtgaatctccggtctgtttttattaatacagagaactttagcgatataatcataatttacagcatactctactactggtactaaaggccttagcaccatgtaacaagtaaaaagtatgctgtaaaataatttcatcagattatttcttgcttagagcttcgtcatatcttctgctgatttctttccagttggtaacattccagattgcggtaagataatctgctcttttattctgatattttaaataataagcatgttcccagacatcaattccgaagataggagttcctttttcttctacgacatccatcagagggttgtcctgatttggcgttgaggaaacgaatagttttccgtttttatctacagaaagccatgcccaaccggaaccgaaacggtctgctcctgcttttgccattttttctttaaaagcgtccatacttccgaaagtctcattgatggcttttgccaattttgcagaaggctgtgtatttttctgaggcgtaagaaccgtccagaacaactcgtggttataatgcccaccagcattatttcttactgcagcaggcaattttgatacattggaaagaatctgaaacaacgtttctttttcctgtggagttcctgcaatagctttatttaaattggctgtataacctgcaccgtgcttcgaataatggatttccatagtctgtgcatcgatagagccttccagtgcattataagcatatggcagaggggtctgcttaaactgagccagtgcaaactgagccgcgaaaactgcacttaaggcagctattttcataatcttcataacttttttgtttatggttgaacaatgttttattcttaagctggaagatgggagactgaggctggaagtaatcaatgtcataacatcaattcataaacatctatttatctttacagccatctcaaaaatcgccagcgctgcatcgtctggaataacttccagcttctagcttccggcttccctcttctctattttaataatttcttaatatcctcaatcaggatttccctgtccggattgtattttcccgtcagcataggttttttaccttccggatcttcataatttaatcctgagtaataaaggatcggcatattttctttattatatctgcaccggatatttccttcctgatctaccagagcaatcattccgctgtgattcaggctttctccttcatcttctttatcaccaacgtagatattaaatttatctgcaagatcaccaatataggtacggtccccggtcaggaaatgccagttcggggatttagcgcctattctttcagcatgttctttcagtgttgcaggagtatcattttccggatcaatactgatggagataataccgaagccgggatcattgatctgattctggatcgccttcatattggtattcatcaccgggcatatggtagggcatttgctgtagaaaaactcaacgagatatacttttcccagcatgtctttattggtgatttttttactattctgatctgtaagttcaaagtccggaaccttcatcacggtataaagattctttttaaaatagcccattcctacccctattccaaggaaaagcaatgcaaataccgcaatgggtatgattactttacttttatttgtggtcttcttatttttgggcatatttctcaggactttttttaaattcacctttgcaatacacactgcaaaaaccgtacgttttatttttatataccgcagtatctttaagagatccggcagttttcatgtggcagataggatcttcttcgttcactacctgtacattttctattttcttccctgaggagtccatgtggcttgcatgctttaccttaggcgtttctttcgcacatgacattaatgagatcgacagcacagcagccgaaataatgagagatttcatttttaatcttaaattgaaatttataatgttaaaaatttgtaacacaaagacacgagcttaaacttacaaaatggttaagtctgaaaaacacagaacttcttaaaaagaactatgtattctgtacagcttgcaattgttattgtagacatgcagcgtgccttctatgaggtattgatgagtgtttctgaaaacctcaaccaataaactaaaaatatagtttaaaataaaattaagctaaaggaggatgaaatatccttgaaaaatattctgaagaatgagaattaaagtagcttgaatccggaacctctgtcactaattctgagttcagctgtgtggaaaatgaaagaatatcatgagagataaagacatctagccctgcaatctttatggtttgagagctattggactgtttttctgttttggccagttctttttccacatagcatttcccgttacaggttgattgcggtacatttctgttctcacaaaggtttttaacaatataatcatagttcacggcatagtttaccagtggcaaaacaggacgtaatgcaacggtaaaaatgatgaatatagaaagtattatcctcaatgatgtattctctgttacaaatatactacttcaaaattgttttataacagatttatgatgaatgtcattatggttatctactgttacctataaaaatcacaaaactgtgcctgtcaccggtataatattattccgaactttgaataagactttagatctaaataaaaatttagttctttatatacaatttaatcttgttgataaaagctttgctgatgtttttggcagagctttttttatgttttgttgggtagacgcaaagacgcaagttttttcaatgtttactgttttaaggcgcaaagattttatctccgataaaattgaatactcgtttgatttctctttgtagagattcctacggaatgataagctgtgtgtattattttttgtaatagctgcgcaattgtcagccacatagtttaatcacatagtttaatcatatagtttatacagaaagtaaagcggtctctttgtcactccgcaggagtttcaattgcatacggcaaatttcaatgacttgcatgatattaattaaaaaacaaaagccctgctgaaaatccagcaaagctttattaaatataattgagttgtgtttattatttgcttcttaaaatttcattctctgaatccttaccgcatttaaaatcgcaagcagcgctactcctacatctgcaaaaacggcttcccacatggttgccagccctccggctccaagaacaagaacaactgcttttaccgcaaaggcaagaataatattctgccaaactatctttttcgtttgtttcccgatattgattgccattggaattttactcggcttatcatcctgaatgacgacgtctgctgtttcaatagtggcatcacttcccaatcctcccattgcaattcctacatcacttaaagcgactaccggagcatcatttactccatcgcctacgaaagctacggtttggtttttagctttgatttctttaaccttattgactttatcttcaggcagcagatcgccaaaagcgttatcaatactcagctgttctgctacatatttcacaacagtacctttgtcaccgctcagcattgttgccttaacattcattttatgcagcttgtctacagtttctttggcatcttcttttatactgtctgcaatcgtgatatagcctgcaaattttttatcatatgctaccgcaattaccgtgtagacaatattggcatggttgagatcataactgatattgaatttatccatcagcttaaaattccctaccagaagttctttaccgttaatggttgctttcagtccgtgaccggcaatttcttcaacattttccagaggaatagaatgattgatatctcctacaaaattatggatggccgttgcaaccgggtgtgtacttttactttcaaggacatttaccatctggaggatttcttctttattaaattcagggcttatgcttacttcctgaactttgaacactccttctgtcatcgttcctgttttatccattactacattctgaatttctgcaatgctgtccaggaaattacttcctttgaataaaatcccgtttcggctggctgccccaattcctccgaaatatcctaacggaattgagatcacaagcgcacaaggacaagaaatcacaaggaaaatcagtgctctgtacagccagtctctgaactgataatcgttcacaaagaagtacggcaataagcagattcctatggcaagaaataccactataggagtatatactttggcaaatttcctgatgaacaattctgtcggtgctttctgcgctgtagcattctgaacgagttcgagaattttactcagtttgctgtcttcgtaggctgtatttacttttaccaaagcaatactgttcatgttaatcatcccggcaagaaccacttcacctttatttttggtatcaggtttactttctcccgttaaagctgcagtgttgaatgaagccgaatctgacagcaattcgccatccaatgccagcttctcacctggtttcagctgtataatgtctccaattttagcttctttagcctttatggtctttggctggttgttttccattaccgttacctcatcaggacgctggtccaataatgcttttatgtttcctttggctctggtgaccgccatagactggaatacttctcctaccgcataaaacagcatcaccgctactccttcaggatattctctgatggcaaaagcaccaatggttgcaatactcatcagaaagaattctgagaacacatctcccttaatgatacttttataagcatctttcaataccggaaaccctacgggaatgtaagccgccagataccagaccaaacgcacccagcctgtaaaccatgctggttttatatagttatcaaaggcaattcccaataataagatcacaaaggatataatagccggaagaaacatctgaaagaccgtttgatctcctgaatcatgagagtgatcatggccatcgtggtcgtgtccgtctccttcttcatggttatgtttgtgcccttttgtatcgggtttttccggggttgtactacagcatttttccataactgatatttttatacaaatgtaaagatgagaatgatgcaatgctattgcaaactttcaagacagttttcgcagattcctttggcaaacagccttatttcgtcaatcctgaaattggtctgtatgttttcaggaaaggaaatatcttctttgcaggtggtttgcttgcaaatcttacagtagaaatgcagatgccagtctttatgtgttttttcatcgcaatcatcttcacacagtttgtatttcgtagtggtattttcctgaatgctgtgaacaattcctttttcttcaaaggttttcaatgttctgtaaatggtaattctgtcagcattgtcaaaatgattttctatttcagaaagggatagagccgcttcctgagaacttaagaaatcatataccagaatcctcatactggtaggcttggtatttttatcaatgagtttgtgttctatatcttttttcattgtacgtttttaatttgttacagatggacttcattttcttcatagccttcttcttctatctgaaaagtggtatgacttattttaaaattattcacagtagtatccgtcaatatttttaataactgattctgtgaatatccattctcttttacaacatgtacactcatcgcattcacactggatgttagcgaccatacatgcagatcatgaacatctttcacaccaggagttttctccaatgattcacgaagttcatggatatcaacatcttttggagttccttccagcagaacattaatggcttctttcaggagtctccatgttcttgggaagatcaacagtccgatggcagctgaaattaaaggatcagcatagtaccagccggttgtcagcataattattccggcaatcattactcctacagaagtaagcatatctgaaaggacttcaaaataagcacctttcatattaagactgctttctgaatcttttctcaggattatcattccgacgatattgacaatcaaccctattcctgctacaatcagcattgatttactttgtacctcaggcggattctgaaacctctgataagcttcaaataaaacatagactgaaattcccaacaatacaacagcattgattactgctgccaatatttctgtacggtaatatccatatgttttggaaggatctgcttttctttctcctattttaattgctataaatgccaacaataatcctaccacatcggtcaacatatgagctgcatcggctaacagcgcaagactgttggttactattcctcctattacctcagcaatgagataagttccgctaaggcaaagtacaatgagcaggttttttttatgccggctccctgcagaaactgtttgtgttggtgaattttccataggatgtatggtttatttacatttcataataagatgtattcttttttttgggtggaacattgtgttctcccgtcatctgtctgatattgatttctatggtctgcgccaaagaagtcatcggagtatctacaggaccattctcaaaaggatcctgcataatgatggatgttttttcaatcgcaatgaaagtcaccggaaccaggaaagtcactgcaatttctaccagcagctgtgaatcatcaagtccaaacggaaggatggccgcaaaaacatagatcagaatatgtactaaaacactgtaagaacgtgggaaaaccgtattcttcaatctttcacattttcccatactgtcgcagagtcttgtgaggatatcattcaactgcatctgctggaaatccgttaatcctttcgaagctgcaatttctttcagctgtctggagtgttcgtccagaattgcattgggaatattgacagctttgatctgatgtttatccagatattgctgaactttttcagaaaatggaagttttctcagagattctccaagagcatagttccagatgatctgtctttctgcgaattctttgattattctatcattacctgccggcataaactggataatcagtcttacaaaagttcgggaatcatttacaatagcaccccagactgttctggcttcccaccatctttcataggactgggaagtacggaatgccagcagcaatgataccgctgttcccaacaatgccggaatattcaaaggcagtgagattttgcggaaccatggcaattcgtccagaagaccaatggctatagcaaatattccgatcagcagaatttgggtttttatttcacggatgaaataccagactgatatttttttgtttagtaacataatcaggtcatttattaaaaattcggtgagatactctttactttttcctgccgtttttaaattccgtaaacagctctaatgtaaggataaaaatcgacattttacgggttccggctactttcattaatgttcgtgctccccggaatttacgagttttgcgttcacaaaaaaggctcctttcactacaatttttgcattgtcaggaatatttcccactggagttatcgcagtatatcccatatccgttgttccttttactatttctattttttcaaagtttaaggttttcggatgtggttttcctttttcctcatgttcttcttctacttttttatcagtctgaataaacacataatacttcccatctgcttctacaatggcttccgtaggaactgccggtgttgtacttttatcaaggcttacaattcccgtaatattcattccatcgatcagtccggatttgtttccaatcacttcgcaatgcatagaaatggttttactttcgttctcaaaagaagatcctatgctgtaaatttttgcatcatattcagtttccggattgttcgtcagtttaaaatgaacaatctgccctaccctcattttaggaagatctttttcaaatacctgaagatcaagatgaatagaaccgttatcaatgactgttgccaccggagaagaaatatcaacatagcttcctatctgtgctgtaatactactgattgttccactgataggtgctgtgatcacaagacctgatttcatattgccattgctgacttttcccgggcttattcccatcatctgaagctgtttcaaaagggaagctctttttgttcttaatgttttaagctctgcatcggcactctgaaggtttttcttcgctcctgcatcgttatcaaaaagttctctctgtcttctgtattcctgctctgcataggtaattctgctgttggtggtcagataatcttcctgaagctggatgtattccgggttagcaatagtggcaattacctgccctttttttacaatactccctacctgaatattgatggttttaatgattccaccataaagagatgtgatggtagccttattgctgttgggtacactcagcaaaccatttgcttttatcgtagaggtaagctctttcatttctacagttcccaaagcaactcctacagatttcatttgttcttctgtaagagaagctatgttttggggctcttcgtcatggcctttttcggactgctcagtttttacatcagcatttcccgtttctttttcctgttttccgcagcttatgatcgacagggccgtgactgcaagatatatgatattgtgttttagtttcatgttatttattgatgattgaattaatagtaacgacagattggttcacctgctggatagattccaggtattttaactgaatattggttgctgtctgcagggcaaaaagatattctacataggaaatttcccccgttttatatcctaattgcgctgctttcacgattttctcagcgttaggaagcgcctgacctgtgtaatattcatattgctggatatcctgctgatattggctaaaagcattttccaactgtgcagaaagctgtttttgctgcattttagcattggtttcagcaacctgcctttcatattccaatgcctggattcttgcttttgtagctccaaatgtcaacggtatcgctactcctactgttgctgactgaaaacgctttccggaattataaaaattctcctgtccgttgatggtatggaaacctatcagcgattggttggtatatcctaaactgaaatcgggaagcccaagcgatttttcaacttttttgtttttttcggcaatctccatttgctgataaaaagcttttacagcaggattgttggcaacaactgtactgtcgagtacactttctgccttcagaggaatatagtctttattaaacgggacttcaatatcttctgaagtgttcataagggtttttaaattcttatacgcattgttcagaaagacttcattttgtctgagcagcagatcaatttctcctttttgtgtttctgcagtactgatttcaatcttttttatatcacctgctttgaatctcacggtagcaattcttataaattcctcatagtattgggccagactggtcagctcggctttattatattggagatattcaatctgataataataggtacgcacctgttttatcagttcattcgctgtgatttccttatcaatctgtttgcttttaatattctcattaattaagtcttttcttgctttaaatagtgttggaaaaggaatactttgtgagattgcaaatgactggtcaaacttaggactgttgtattgcccaagctgagcttcaaaacttaacttaggaagttcttttgccgtaggtcttaatgcttcggcggatttaatgcttaaatcttttgactgcaaagtcagattattattcaaagcctgttctactgcctgttctacagaaactagtcttgactgtgctttgaaggtctgtcccagcatcatgaaccctacaacaaggatcgcagtatacatgcctgtattattctttcttcttttcaaaatctttgtgttaaaaatgatgtacagcatcggtaaaacaaataacgtaaggaaagttgctgttaccaaacctccgatcactactgtagcaagaggtttctgtacttcggctcctgctccggtggaaatagccatcggtaagaatcctaacgaagctactgtagcggtcattaatacaggtcttaatctggtttttgttccttcaaatactcttttcagaatatcggtttcaccctctttttctaattggttgaatgtcccgatcaaaacaattccgttcagtactgctactccaaaaagtgcaataaatccgattcctgcgctgatactgaatggcatatctcttaataaaagggcaaatattccacctatagcactcataggaatcgcagtaaagatcagtgcagcctgtttaaatgagcggaatgtaaaatacagcagcataaaaataagaagtaacgatacgggaacagcaatcatcagacgcttactcgcttcctgcagattttcaaattgccctccataggtgaagtagtatccagaaggaagtttcattttatccagttttgcctgaatatctttcaccacactttccacatccctgtctttcacattgaatccgatcacaattctacgttttccctgttcgcggctgatctgtgccggtccaagtttatagctaatattagccacctgcgataatggaatctgtgctccgctggcggacgtaatcatcagattattcacatccgaaatgtctgttctgtgaagactgtcgagacgaactaccaggtcaaagcgtctctcattttcaaaaacctgaccggcagcttttccggcaaaggctgtgcttactgcattattgacatcttcgatattcaatccataattagctattcttgttctgtcatactgtacattgatctgcggaagaccgctcactctttcaatctgaggagctgtagccccatcaacagtctgaatgactttcccaactttatctgcatatatggcaagagaatcaaggttttccccgaagatctttacggcaacatcctgtctgatcccggtcatcagctcattgaaacgcatctggatgggctggtttttttcaaagaatactccaggaatcgtttccagtttttcactgatctcattagccagttcgttgtaggatttcttggttttccattcgctttgcggttttaatactacaatcatatctgtagcttcaggaggcatcggatctgtaggcacctcagcggaaccagttttccctactaccattttcacctcatcaaactgcttgataattcttgatgcctgcatggaggtttctatactctggctcaatgaacttccctgcggtaaaatacagtggaaagcaaaatctccttcctgcagctgcgggataaattccccacccatatttttaaagataaaagcagagataagaaaaactactgcagttgcggaaacaatgatatattttactttgattgctttctgcaataatggctgatagatcttctgcaggcggttcatcattttatcagagaaagtttctttgtgggatattttcttggataaaaacagggcactcatcatcggaatgtaggttagtgacagaatcaatgctcccagaatggcaaatcctactgttttagccattggagtaaacatttttccttctacgccggccaatgtaagaatcggaatgtatacaataaggatgatgatttctccaaaagcagcactgcttctgatttttgatgcagaaaggaatacttcttcatccatttcggactgcgtcaaagcgcggacagattttctgacacccaaatgatgtaaagtagcttctacaataattaccgctccatccacaatcagcccgaagtcaatggctccaaggctcatcagattggcacttaccccaaaaacgttcatcattcccaaagcaaacaataaggaaagcggaatggccgaagccacgataagtcctgctctcaggtttcctaagaaaatgacaagaacgaaaataacgatcagggctccttcgatgaggtttttctctacagtattgattgccctgtctaccaaatctgttctgtcaaggaatggttctatcaccacatcatccggaagagatttctgaatggtgggaatttttgctttaatgttattaactacttcattactgttggctcctttaagcatcatcacaactccccctacagcatctacttttccgtcatatgttaatgccccgtaacgaacggcgctgcctaaacggacatcggcaacatcctttataaaaatcgggacgctccctgtttcatttttaacagcaatgtttttgatatcctcaagtgaagttaccaaaccaattccacggatgaaataggcgttgggctttttatcaatataagctcctccggtattttgattatttttttcaagtgctgtaaaaatttcggtgatgctggttcccattgcttttaaacgattgggatcaatagcgacttcgtactgttttaattcacctccgaaactattgatttccgccactcccggcgttccgttcagctgtcttcggacaatccagtcctgcatggtacgaagttccttggcattgtatttcttctcgcttccttttttagggtgaagaatatactgatacacttctccaaggcccgtacttacgggagcaagttcaggagttcctactcctttgggaatttcttccactgcatttttcagctgttcattaatgagctgtctcgcaaagtacacatctacattttctttgaacaccacggtaattacagagagtccgaatcttgaaatacttcttgtctcctgaatatcgggaacattggcaatgctctgttcaatgggaaaggtaaccagctgttccacttcctgtcccgccaatgtaggacatacggtaataatctgtacctggttattggtaatatccggaacagcatctatcggtaatctggtggcattccatgttccccagatgatcagcaccagggtcatcaatccaatgatcaccttgtttttgatactgaattttataattttatctaacacgatttgtatttaatttttattgaaaagtgaatgcatacagcgtaaaatgctgcagcaaaaatatcctgaaaacctctgcaatggtattgcaaagtttcaagcacagataactatcagaaagcaaaactttctgaaaatcaataaaaattaaactttaggaggctgccagataggatcgtaaatctggtaagcaaaatcgtttttgtgaaataagatcttttttgaaaaataagcgggaatctgctcaggaatttccaataacggatccatcttaaatgccgaaaccgtcatctggcaacagctgcatgcacacaacggagaacagatgtctcctttttcttttgaatgattttcctgaacactcagggaagctactttccctgaattctgcggatgagacacgtcagcacatggcattaatgataacgccataaagtaaattgccagtatccatcttaagagattcattgttacaaagatagagattttttataaaatgaatatttgttgagcatttacccaatattcttttataaaaacttattcacaaatactataccagacctttatgataaaattcatatcattgaaaataaaaatatcttaacatcaaaaagacacatatgaataattttcccttgatcaccttttgttcgcttcaatacaaatgaggtgaaacaacttttccattatagcatgccaataaaaaatttttgattatgattaaatatattttttcaatactatgtatgatgggattcttaaatagttacggacaaaaactatataaaatagaaaaagatcaattcggggaacctttattaaataataaagcacaatattcatttacaggaaaaccttctggagaagatttaaaaaattgatactacaggatattatgttctggtctttgaggggagatattacaatgaagaagaaatgaagaatccaaggataatcatttttcataatgatggtttttttaagaatgaatcacttatgtattttggaaaacttaatgagcagagaggaaaaaactctgtttattatggggaaaaatataggataaaaaataatatcatccaactagaacaatttggaaaatctccagattcaaaaaaatggtataccaggagaataactaatggtagaatagatggtaataagattatttttaatgaagggctagtttctgtttttgaaaaaagaaaaaatttgcccgcaaaataacaagatctttagttgagaaccaataaatgaatcgggttaataaccaacaaactggaataattaatttgaggagtgaatatttttcaataatctatagaaataattttaaaacaaaaaccgttgctaaaaagcaacggtttttttaataaaaaaaaccaccgcaaaagcagtggcttaaaaaatcaatctaattatggactatatcctataaattcgggttattctcaaattctctttgtggaatactgaataaataatagttgctgttcggtacaaaagcagatttatcagggaaatcaagaacagaatgtcctttaccgtctacggttttcacggtaccatccggtgtagttacctgaacttttatcggtttgccgtcagcatctacaaacggttttcttactactgttccctgcgttctgataatatctgaaagggaaaatccttctccgaataattcttttcttctttcaatcagaactgctgcgataacatcactttgcgataacgagtcattataaatattggcatttctggcagatttcaactggttcagtacggttaccgcctgagaaacatttccacttcttgcttcagcttcagcttcgatcagatacatttctgcagctctcatataaacaatatctgcaataagagtaggtttaaatttaaacttagcatacctcagcaatccttctcttcctttctgcccgtcccatgaaaataattgatatctgatgtcattggtatcaaaaaggtctttaaaataaggatccgccataaagctgtaataataactccccgaagaagaaacatccagataatggaaggcataactttcatcagactgctcctgggtctgtgcatgtccccagatccactcgacattgttgatatcattgaaaccttctttatacttttccggagccatcaacgggaaaccttctctcgcaattttcgcagatgctgcagctttactccactcgcccgtattcaggtaagttcttgctaaaagtccgttcaccacagaacggttgattttatctttattatttcttgtataatttttcaacaggttatcggcgtcggtaagatcacttttaatcaatgtatagatttcttcaaggcttgctcttttcttccctaccgtacttgttgtggatggttctgtataaataggcgcagtcaaagctgatttgtctttgagatagctgaactgataaaagctcgccagattcagataacagaaagcacgtaatgcttttgcctgtcccttcacctgatcttttttctcctggctgccttctgtgccatcaattcttgtaatcacattgttcatattattgatggtggaatacaacagagaccagataaacaacggccggctcgctgtattattcaccatttctgtaaaagcataagtagaagcaaaaccatatttattggtcaatactgccacatcacttcccatcgcatcactggctcttaacacagtggaatacccgatattggcataggttgtcccgtcattattaaactttgcccaggtaccgttcactactgtttcagcactttcagcggttttgaaaacttctacactattggcctgatcagtcggagcagtgtccagatcactttcacagcttgccagtgacaaaaatccaatgattgcaaacgatatgtattttatttttttcattgtttcaattttaaaaggttaaagcgttgcctgaagaccaaaagtgatcgttctcattgcaggatatctgtaatacgttgttccgtccaaagcctgttcaggatccattcccttatgtttatagaatgtgagaaggttttctgcctgaatatatattctgaattttttaagtcctattttctcaaaataatcttcaggaagagtatatcctaaacttacatttttcagtcttgcatacgtaccggaatacaggaatcttgaagacgttgatgtccagttattcgttgttgtacttaatgcaggaacatccgtattaggattatcaggcgtccatctgttcaatatttccgaactccatgcgcgtcctccggcacttccgttatgcatgatggaagtataatcggtatccagaattttacctccgattttgaatgtcaataatcctgaaaaatcaaaattcttataagtaatactggtactgattcctcctgtcagtttaggcaatgcggaaccctgcagcaattttgtagcttttgaatattctgaagtcgttccttctactgagtttccgctggcatcagtagtcaccgttttccacaaaggctttccattgcttggatctactcctgcccattccggaataaagaaatcatatactgaacctcccactgtcagtaacttagttcctactaccaaagaacctccgggaagtttggttactttattgtttaaagtactcagattcacatccacattccactggaaatcatcatttttaaccggtgttgtgaataatgaaaattcaaaccctgtattctgaatcgttccgatattggctggataatcactgattcccagcgatggagccaccggcatattaaacagaagatcctggcttttccttttaaaatattcaatatttcctttaactctgttattcagaattgagaattccaatcccacatttaaattaaggttggtttcccacttcacattattggtatacgttttttccagggttgttcccggttctccaccaagactgataaacctgtacaactcctgataagcgtaataaagtggttgaccatttggacgaagtaatttatcattaccctgccccccatagctggcacgtaatgtcaactgattgaaaacatttaagcttttgatgaattcttcattggatattttccatgaacctccaactgaccagaatcttccccatctgttattttttgcaaatcttgaagaactgtctgctcttcctgatgcagataagaagtaagtattattgtagtcatactctacttttcccaggaaactcaacaaacttagtttattgctgtttccactgaaacttcccagcagtgaggcagcatccggctcataataataaggcagtgaaaactggcttcttgttccggaaattgtctgataatcgtatttatagaattcatgtcctgctaacgcattaatgtggtgctttccaaactttttatcatacgtcagaatattactggttgtatacgaaagcgttctggtatttgttttcgttaccgaacctccaatttctgctccctgaccaagtaatggatttgaataataatgtccgttataattcacaaggtcaacagaaaagcttgtcttgaattttaattccggtaagaaagtaaattccatgaatccctttcctgaaaagttatcttctttattttcgtttttgtctaatggaagggttgcagcggcattttgattctgtaaagcattcgtaggtctgtattttccaaaatcataaaccggatttccatcagcacccaaaacgtaagttccatctgcatttctttcataataaggatagaatgaaggaataaaccttgcggcattgatgatattgctcgccttggaatctgaagaagttggtgcctgctgaatactgttggtatagcttaagtttactcctaaattcaaccatttcttaacttcagaattaattttcaacctggtattatatcttttaaagccagattcaatagccatacctttatcatccagataaccaagggaaaagaagtaattgcttttctcacttcccccgctgatatcaagatccacctggtttcttgatgctactctctgtaaaatatctctccagtcatcattccagagtggtgaagcaccagctaataactttccatctgttcctacaggttttggataagctgtcccatatgggttgattccaagggtagaaacaagattatctgtagccatctgagctgcctgctgggaagaaacttttccggactgatatccgtttctcaacgcttcccaatataattgaaagtactgatctgtgtttacctgctcataatctttgacagctcttcctgagaaaccctggctgatattaaaattaacttttgcttctcctttttttcctgattttgtggtaatgatgataatcccgtttgctcctcttgaaccatataaagcacttgccgttgcgtctttcaaaacactgatagattcgatgtcgctcgggcttatagagttcaggttaccatcaaaaggaattccatccactacatacaatggatcgctggaagcacttattgaaccaattcctctgattctgatggtagaaaccgcacccggctgacctgatgcacttgtcgtctgaatacccgctacctgtccttccaatgctttggtgatgttggtaacaggcctgttattgatcttatcactggaaattgtcgccacagaaccggtatagctgtttcttttcgcttttccataggctaccactaccacttcatcaatctccttttcatgaagactgtctttttttggttttgaattctgcgcatttacattagccactcccaaaaaaaatgcggctaccggtggtatccatattttagaattgaataaatttttgctaatcataatcaattttatttatcatatattaaaattttaccctttgcagaaaagtcagcaaatggcatcaataaatacgataaaccaaatgcttatttttccataaaaggctgaatgtaacaccttgcctcacgggtaggttgttaagatttcacagggtcagttccctccatctttctttataagccgatcgaaatatggttgcaaagctaaaaacttttagtctacaaaacaagtagacttattaatatttaatgataaatttttaataattaacataaaattttaataaaacccattacagtaaggagttataacagttacactattttcaaacatgacaaatatcattattaataattcaataatgtaaaaattcagcagagtttaatttctatgtgattttattggaaaaactttttaattttatagtatgaaagttttaattataaacggaccaaatcttaaccttttaggcaccagagaaccggaaatctatggaagcgtttctatggagagttatttggaaattttaaaagccgaatttcactctcacgaattaaaatattatcagtccaatattgaaggggaacttatcaacagacttcaggaagatgattttgatgctataattattaatccgggagcttatacccattattcttatgcgattgcggattgtttaaagaatattcgtaaacccaagattgaagttcatgtcagcaatatttataaaagagaagaattcaggcagaaatctgtaacagcagctaatacggatgctgttttatctggttttgggatggatggatatagactggctttattgagtttgaagtgattttagattatattccccaaagatcgcacagattctcacagataattatgcatacagaggaataatttatgaatataaagaatcaaatttatttcaataaaatactcctattactaaaaaataaaaagcctcatcagtgatgaggcttttatatgtttatggataactattagatagtctgttcctgcaattgaggtcctgaagcaactaatttctttccttcttctgtatcacagtactgttcaaagtttttgatataccttgaagcaaggtcttttgctttctcttcccattctgaagcattttcatacgtatctcttggatctaagattcctgtagaaacatttggcaattcagtaggaatttcaaggttcatgatcggaacctgagttttaggagcattgtcaatagaaccgtcgatgattgaatcgataattgctctggtatctttcagagaaattctctttccggtaccattccaacctgtattcaccaaataagctttagctccgtgctctttcattttaccgatcaatgttttagaatacattgttgggtgcaatgtaaggaatgcttcgccaaatgcaggagagaaagatggttctggttctgtaattcctctttctgttccggctaatttggacgtatatccgcaaaggaagtggtattgagcctgatcttcattcaggatagaaaccggaggaagtactccgaatgcatctgctgaaaggtaaacaatcttcttagcgtgacctgctttagaaggtaatacaattttgttgatatgatagattggataggaaactcttgtattttcagtaattgatccgtctgtataatctgctactccattgttcaccacaacattttcaagaagtgcatctctcttgatggcagcgaaaatatccggttccttttctgcagataagtcgataactttagcgtagcatccaccttcatagttgaatactccgttgttatcccatccgtgctcgtcgtcaccgataaggtatctcttaggatctgctgataaagttgttttaccagttcctgaaagaccaaagaataaagctacatcacctttttcccctacgttggcagaacagtgcattgaagccataccttttaatggaagataatagttcatcattgcgaacatccccttcttcatctcacctccataccatgtacctccgatgatctgtagtttttcagtaaggttgaacatgatgaagttctcagagttaaggccctgagcttcccagttagggtttgttgtttttgatccgttgattactgtgaaatccggctcaccgaagttttcaagctcatagtgagaaggacggatgaacatgttggtcacaaaatgcgcctgccatgctacttcaacaataaatcttaccttaagtcgtgtatctgcattcgtaccacagaaagcatctacaacataaattttcttagcttcggaaagctgattcatcactagttctttacaagacccgaaaatttccgcggttgtaggtaaatttactttaccatcccagaaaatagtatctcttgtaacatcatcctgaacaatatatctgtctttaggtgaacgacctgtgaaaattcctgtttttactgatactgcgcctgattctgtaagctcagctttctcaaacccctgattttcaggagaaacttcagcctggtataattcttcataagaaggattatacactacttcatagtttcctttaatccctaatttctctaaatcctggatgattttagtgtttttcattttacttatattttctatttctttattgctttcaacaaaaataatattaattatttgttaaaggtggtttaaatatactgatataagtcagaatggcaaacaaaaaaacggctttgtaaattcctgattattaaccgattatttcagaccattcaaaaacaccaggaaaacctttctcccaaaaatagttcttatagtccccaaatttggcactcatcacgaaatctccgccccatgcgcctaaacttttgacaaatgaagggcaatctgagaacaatctctccttaactgtgagaatttcaagaaaatccgctatttttcgctcatgaatcatcattaattcagaaaaagcttccaattcattgcataacattattttctttgtgatttccgaaaattcgtttaccagttccggagacttcttttttgatttgtaaaaactgattccttccctgctgtcctgtttctgatttaagtggataaaaatgagttcatttttaaaagaaggattaaagtttaccttttcatatttaatttcaggtttactttggaaaagaactgcagatttttcttttgcaaccgcaatatcatatccacttcctcccagacttatcgtattcagataaaaaggatcaatctctgcccattccgcaagattggtcatcagggtagaactgcttcccaaaccatagtctgcaggaaactgaaggttggtttttaaatggtaagtaaggttagttttgaatttagtatgggaaagctgctgaacattcttcaatgttttcgtaataaagtcagcgcttgatggaatattggtttccagaatctgccatgtttgataatcaatgacagcttttaaccataatgtattctgatgataagcttcccaaagaataagagatctcccatcttctttttcttcaaagaaaaactcttgtcccagcctggtaggtaccgctaagacaagagctccatcaattgcgaaatattctgaagtaagcataagcttgcccggtgaaaatatcgcgttcatatatttttattagattgcagaagtagcttctactgacccatcaattttcttgattaatccctgaagggttttccctggccctacttctacgaagttagatgcaccgtctttaatcatattctgaacagattgtgtccattttacaggaccggtaagctgatcaatcaggttttgcttgatctcatcaggatttgttacggctgtagtagtgatattctgatatacaggaattgttgcttttctgaatttggttttttcgatcgctgccgcaagtctctcctgtgcaggctgcatcaaaggtgaatggaaagctccgtttaccggtaacagcaaagctctttttgctcctgcttctttcaactttacacaagcttcttctactgccggtgtttctcctgaaattaccaattgtcccggacagttataatttgcaggaacaacaataccgctgatctgcgcgcagatttcttcaacttttgcatcgtctaatcctaagattgccgccatagaacttggatttgcatcgcaagcctcctgcatagcttttgctctttcggaaactaatttcaaaccatcatcaaaggataaaactccgttggcaaccaaagctgaaaactctcctaaagagtgtcctgctaccatttcagcaccaaggccatttacggcttttaatgctgctactgaatgtataaatattgaaggctgggtaacctctgttttcttaagatccgcatctgttccgttaaacataatggaaagaatatcgaaacctaaaatttcattggcagattccatcagatctttaatatcttttctagaatcatacaattcttttcccattcctacgaactgagaaccctgccctggaaatacaagtgctttcatgtattgaattaaatattatgcaaatataactataatgttaacaatattcgttttaagtgctatgaatcatttatggtactaacctgattactctgtaacctgtatttacataagcaccgttagctttggattttacaaactcaaatttggtagcaagctgagtctgaactttattcatctgtttaaagatttctccttttttattttctctggttaacatgtcatttaccacatcaaaacctacgatagcatattttggcggagttttacagtatttgctcttataggcagccagaatttctttttcaaagctaccatctgtattgatttttctatccatcagataaaccagatttgcctggcttaattcatccacttttttctcaaaaaccggagcgtagaacatactgaaagccttcactccctgaacttctttagaaatagcaatgattctgttggcaaaagcatcccctactgcattatcatcatttgccagaatagcaataaccggagcagactgtcctgtcatcatattctggtccagctgaatatctgccggagaattaacaataatgatatttggatttttcaccgctttttcaagtcctgccttgatataattggcattgtctttcttggcatctgccaccacatatattttctgatctgaatagattccttttacctcttctacaattttatcagcatacgtctgattattggtttctacgataataaggttactgtagttatagagttccggagtgttggcaaatggtgctactaccgggattttctgattttttgtaaaatcaaggacgtcaattacgtttgatttaaagaagggtccgataataagatccgtattatcgggattgatctgcgttagagaatttttaaatgaagcttcatttcctgagtctaccactttaatatccagcttttgtcctcctcttgcatttctttcaatggcaagtttggctcctgttaaaaagtctagtgccattcctctgtactgagtttcgttggtactgtatccgaaaggaagcattaagatgacacttaaggcatcaccatttttctttacgtatgccgcatcttgttttttgattttcaaaaccattccggttttcaaaccatgtgaaagatccgggttcagagcaataagttcatctatagacactccaaatttgttaacaatagagaaaacagtgtctccctgctgcacggtataggtaacgtaatcatctcccgctacaacattggaagaggttgttgatttttcgtttccggaatccatttttgcttttggattggcaggttcagcagcggcgtcagtacttgtattgttagtattggatgtttttactttaattgtatcaccaggcttaagtcctttttcttccaatccgggatttaaagcgaaaagatcctgctggctgataccaaactgttttgtgattctgtaataattatctttagcctggatcacataagattctccttctgctgcaactggagtcgtagttgttacaactttttctacagctttctccacaggcttttcagtggctacagcctgttgttgttcaccaccatatttcttaatactagaaagaggtaaggtaatttcatcaccgattttcatatgagaatccagttcaggattcaattttctaagatcagtttcagaaattctgtattgctttgtaattccatagatggtttgctttggaagtaaaacaattttacctaaagcagaagcacttgtgtttgaagttactttttctgccggagctgattttgtcacaaccggagaggctgctttgtctgattttatggttaaaacatctccgatcgccagtttgccatctttatgttttgggtttagcttcagcaattcatctacagtcattccatacttttttgcaatgttgtaaggattgtcaccttgcacaaccgtatgtgatttctgggctgaaactcccaaaaccatacataaactggatagaataaaaaacctctttatcatattcgataattataatttacaaaaatacttctttaaaattaaatggcaacaattattaatttggaatcttgaaccaccatttcttccaaacaattttcaagccatgaatagccataatctgaaaagaatacgctaaagttatacaccctttcctgccatgttttagccgggtgaacatctaaaaacagattttcaagtctttccagcaattcattctgttttattttctcggcatgaagcaagcgttttttcattcttttaaatgatttcaactgtcgtacttcttctgctttcaccatatttccgaaagatttctcagtagtttctgccgcagccttcaatgctgaaaaattactagccagcaattcttctttttcttccagtaattgtaaaatgggactatcttttaaaatcttctgattagtcaaaaccgtaaaattgtgaaagaaatcttctattttcagatcaagtttctcaattttccccagagttttttctttcaggaagagcatagagtttcttggaatcaggatcggaaagggagtgttgatttttgagaagtaatctttcaactccagccaatacataatttcggcatttcctccgatataagccagattaggaagtacattttcctgatataccggccgcatcaaagcattcggactaaatttttcaggatgattttccaactccgtcagaatttcttcttctgtaaagtgaattcctttatctacaatgatatatttttgtccgtcaaattcaattctgtctctggtttcagaaaggtaaaaaaggtttatttcacggggatttacctgaaccttaccatatttttctgtaagaaaattcactttagcttcagaagctttatgtaaactgaaatgaagaagctcatctttaaaaatctccttcatctgatttttaagttccacggaatctccatccagaatcaaaagcccaaattctgaaaaaagacgattgacaaggattttaatagcttccgtcaacgtgtttccctgtttgtaagcttccttcatcatcaggataagttccgtaccgaaaatagaatctttgaattctttttcaaattcagaaataaaataggtatcactgatttcaattcgtcctaccgggcctcccgatttttcattggtttcgtaataattattttcggttttaaaatgattaatctctgcaaaatcatgatcttccgaagccatccagtacaccggaacaaaattaaaatccggaaaattttctttcagataagtacatgacttaatggtctgaagaattttatatacaaagaaaacaggccctgaaaacaggttcagctgatgccctgtcgtaatggtaaatgtgttaggcaatttaagattctcaaggttttctttctgccttgcagaaagagaaagacttgttaactggctttcgaatacttcagctaaaatatttctcttctctgatgcgaaagaatcttttttcaggtgaatctgctgtctgaaatgctctaaggaaaatgtattattttcaaaaccctcgattttctgatttaaaaaatcttttactaattgaggaatgctttctatatcgttaaatgatattttattaattgttttcaacctgtacagtttttagttgaacaaataccacacaatcccgatgttcaatctgaaatcatataccggataatgtggaaatgcgtatgctttgttattggaaataacagtcccgatctgctgaccttctatgaaaaagaacatttttttcactttcatattaatataaatatcggcaataggctgtcctccaattgaaaatgaatctgctcttggaagaatatattcgttaagaatagggaaatattctcttgaagcaaatttagagaagtaatatactttaacaccagcctgaatttctgctgcttttttaaacgcttgtgtctggtagaagaaattagctctaccaacaaaactcggtaacggaagtagttctttgttagttaaagtattctggaagtgtaatcttgtattcaaatggaatttattgaaactgaacgtggcatctcctccaatctgagaaatatttacagaattatcactttgcttcggacttccgttgctgtcaaagtaagtatagttatcgatcctgaagtagttggcaaaaatttcagttttaaaccatttcaagttgatacttcctcccacttccatgacagattggttcttcgcattttcaagataatagttgaaattgttataaacggaagtatttaataagtaattaaatgatggatatgcactttggaaattcaccttagcattaacaaaataatctttaacaggttcaaatttcagattgttggttgttttcagatagcttttaaactggcttccgtttgagaattccaggaatgaattcaattgaattttgtcccaaagttttacctgcagatttcctacagcaccaattctgttttctttaagttcattcggaaaaggaaatccattattaatagacgcaatatctgttaccccaaacttaatgatctgataacgcacacctgcatccagtttgaatttttcattattaaagatcaggcttaccgtattactgaaattttcagaatatttttttgttgtcagcggaaagccattcaccaaatctgtaggagcactataccaatatgcttcaggagttgtctggttgtaataatatttatttccctgatgagaaatagtatgtctgatactgaaaggaaatttttcagcattgaatggagtaaactggtgactaagatagtatcttctgtaagaaaactgagagctggaagaggctaaacttacctgagcattttgtctgttactataattgctgtcaccactctgaaacagattatcttcagtaatacctccactttcctgattgtttacattctggtgaagatagtgggcaaaaagctcataattcccgctttttgaaacatagtgtccggagaataaagtattgttattcgctgctaatgaatttctgtaaagtccctgagaacgaagccccatatattcaagagcaaaattgaacctctttcctatattttgggtataggtagatttcagagctgcaccgttacgcattgcattatgataaataaatgatgcggtaggtgtttttacgtcataatacttcacatcgttggctccaatgatcatataagatttattggaaggcagtaaggaaagattttgctcgtcgttcacttcaaaaacaagaggattgaaccccgaaccaatgttggcaggctgtactctcccaaagttatctttattattttgctgtgaaaaaatgtatgttttatcaaaagtcattacggtatcaaaaactttcttttcagaaaactgagtctgatactgataatcattaatcgtaggcttgaaaattttcagagaatcttttttcccggagtctatcaccagcgtgtcttcttttttgggttgcggcttcacatcggctttatttacgacctgagccctagctacaaaacttaaagagaagagtatgaaaaggatgtacttcattattcattattgtacagcaaaaataagaaataaaaggacataaaaaaccccacaaaaatgtggggttaatttatataagtatatataatttacttattgacctgtaaatgtttcgtcatagtctccgtaacttcctagtgaagcaccagtagtaggatttttaacaaaataattaacacgaagcttcaatattctcgtacatgcattgaagcttgatttacttccatcagcagcatctttcatatagtttatacctccattagctgcagaacctaaactctgttcaggagtagtcacaacatatgtatcaggattatatttcaaagtaagatcactaccatcatccataaatccgatcactttaaatgtacctacaccatttacaacacctaagtcctggatagtatagtttacaccagcagtcccccaagaagctaaagtattcttgaatactccatttccaacgaatgatgatgatggacaggctttagtatatgtaagagtataaacctgatcaaatgaagcattagcaatggatgaagattgcaacttaaatacaattaccttagggtctacagtagcccctgcttccaaaagtttcacttggaattgcccatctattttacctgcatccacagtctgattttggttaacgatctgaaaatcagcaccctccactgctgttgaaagacttgtatctacaacaagctttacttgcgctgatccagaaagtgcgtgagctgtaccaaagctaattcctacagtagtaggtcctgatcccatctttacaacagcttcacttcttgttcctttattaaagtgtaaataagattcgccatcataaacctgagcttcatctttacaactgttgataaagaacacaacaaatgctaatattaaaaatgcaatttttttcataaattctaaattattatattaatacccagggttttgttgaatatttgggttcgcattaatttcatccaatggaatcggtaatgtaaacctataatcactagcaggtagtgtaagaggtaatgtcttgttatcatcatcataaacatctctatccactcctactccagcagctacacccattctttttaaatctaagtaacggtgtccttctaaacacaattctcttcttctttctaaaagaatatcagcatatgcttgctgcgcccccgtatagacaggtaaaggagatgctccgtttttagatctagcttttctaactttattgatattatctgccgcagtaacccaatctccttgatttgccgctacctcagctaaaataaaatacatctcagataatctgaacattttaatatcatttcgaatctgcattaaagaacttgcaagggtaccagatttccctggatatttgttaataacgattacatcatcctctctcgcattagctccgttaggataaaacgcatcaaatatacttgtagcatctacataaacatcacgtcggatatctcctgctcctgaattagataattggttattgatagtagaaaataattttcttcccatatcataatttactgagccattaagatctgtagagttagtagtccataatcctgcgatattggaccaagaaccagtagaactatttggtctgtatagagaccaaagaatttcacctcttgcagtatctgcccacatagcagaatatgatgaactaggtgttaaagctaaaccacttgtattgattgctgcttcagcattaagttttgcattaacattatctcctttatagttataatatcttgcagcgattgcgttaattgaagcttttttatcaaagtaatgctgtgcagaaacccctgtagaaacaacacttgagttaaaatttgtaagtgcatattgtaaatccgactcaatcaaagcaaaaacttcagagttcttaactcttggtaatttagtattaaaaatgtctgctggtttagtacttagcattactcccagcgcattcggatctttcatattcgtagagaaataagactctaaagtaatataagcatatgctcttactgctcttgcgtttaccaaaatacctgtatataaagctttattggctggtgatagtgaattataatcaatcagagcacttccctcaagaagaatatttactttgttgataatattataattgctcacccagattccagaaacctgacttgttgtagaattaagaacaaatctatgcgttaagatatctgaagtgcttacactactcggtccaaatccaacttcatctgtaaaaagagacgtaaaaaagatctcatttgttgggtttacagccggataaacacttccgttaagaaacttctgcatgtcatccactgactgaaaagcaacattcgcatcattaatctctccatcctggacaatttccagtgcgtcattacacgaagtcagcactaagaaaaacgataatatatataatacttttttcattttaataatttttttagaaatcaattttcacccctactgtatacattcttgggttaggatatacacttaaattagatcctgtaattggttcagggtcgaaacctctccattttgtccatgtataaaggttctccccttgtacatatattctaagcccagttattggcaggttctgtaactgctcttttcttagctggtatcctatggttacggatcttatttttaagaaagaagcatctttgataaaataatcagaatctgcagtatacccccagttggtagctcttaagcttggagtgtcagaatttgaattctgaggagtccatgcattaagtaagtctgttgacatatttgacgatcctacagcactagatcctaatccttcaggattggctaaccaataaagtgcattatcaaatttcttaactccttgttggaatgtaaataatccatcaaagaaaaatcctttataatttgtttcgaaaccaaaacttcctgcatatttaggaataggactcacgtcaaggaattgtgcatcttcgacttttggagcttcagtaactcccccgtctttggtgtagaacaataagttaccattacttttattaactccagcatatttataaacataccactcacttagagtatgaccagccatattaactgttgaacctggttcaggatctccgaaaattgtatactcattaactttgttattgttataagaaccgttagcaaatacacttaaagtaagatcactcgtttttataacattataacgtaacccaagttcaatacctttatttgtcatagccccgttgttacctgcaatagtataggaaccagacacacctgaaactggtattgtactgaatagattggtcgttttcttctgatacacatcaagagtaccttctaatttattattaagcagtgtgaaatctagaccaatgtttgcttgagctacatcctcccattgtactaatggatttccataagcaaacccaaatccaatagcattaccatatccgataggggaagtatataaatctcttacaacctggctagccgttaataatgggtttgaaccaggagtagcagcaacaatattttgattaccattcgtaccataagatgctcttaacttaagagtactgaatgtagatccttccatgaagctctccttatcaatattccatctacctgctactgaccaataagtcgcccatctgttttctccaacaaatcgataggatgcatctcttcttaatgtaccactgaaaccaaatcttccagcataatcatagttaacagttccaaaaacagctacagttcctgctgtaactcttgaagcacttactgaagggatgtaaggtgatgttgctgagttatcaaacggaatatatcctgtacctgaaccaggcacataagttcttggatctaatccattttgtcttcttgtcgtagatctgtaatacactttattgtattccatgtttacggaagcatctacagaatgttcatctagtttcccgctatatagcgcagaaataacgttattaatagttaaatctcttgttgttgattgatcttcaaaacctgtgtatttatttgcgccttgtgttgctaaagccaaatatgcccaaggagctctacccgagattctatcactttgtctataatcaatacctaatttattactaagagtaaaattcttattaatattataagacgctcctaagtttgcaccgattgatacctgatctacaaagttcggaagatttcctcttgttaataaattttgtagtacgtatatattattaccattattgaaattcgtcttaatatcattaaataatgcctgtccatttgcatatttagtaggagacaaatatggtaacccttgaagaactcctaaaagtgggttttgtacagagttatttctgataccagtgtttgtttcttctaataattcgtttcttctggagaaagcaagagcaatctgcgagttaacgtttaacttgttatctttagatttagcctgaatgtttgatctaactgtaaatctcttgaaatctgtagttggcacagcacccccttgctccatgtaaccaaatgagttataagaagatacattcgccccacctgtagaaagtgcaacatcgtgagactggaacatctccggcttaaagaaatagtttttccaatccgtattaattccttgtgctaaagcatctttagctttaatgtattctgagttagtatcagaaaaaccatacagtttcataatccccatatactgttcagtattagcaagattatatttatcaagtggtcttagagacatacccgtcatccctgtataggaaagcttaaatccactgttatatttacctctttttgttctgataactacaaccccgttagcaccacggttaccatatacagcagttgctgctgcatctttcaaaatggttgttgattcgatatcattaggattcaggtttctgtactctgaagcgttagatggaatatcatcaataacgattaaggcatctgtattaccattaatagaactcgtcccacgaatcaataagctaaacttagcagaacccgggctaccagaacctccgttcataatcacccctggagcagatccctgtaaagaagttaacatattgacatttggtctgttctcgaagaatacttccccaacagtattagaagctacagttgacttaggtttcgtaatactttttgagtatcctagcaaaaccacttcatcaattgatgtttctttttttaccgtgtcttttttcttagttgttgtctgctgctgcgcaattaccattcctccaaagaaaaacagcgccccagcactcaatacacgtaatttaacattcatattaacaaattttaatatatttaatggacaaatatgttaataaatattaacattcacaaattaaaccagtgtttaaacagtgtttttttttaatgttttatttataaatcacgtaaatagaatgaaattaaataataatagctgacttttatttaataaaaaacaatttttaagcaaaccattttaaatttaacaaattattgataatgtaaaaataattatttagattgattataaattacaagaggttggaaaataaaaaaaccactttataaaaaagtggttttcacatatttaggatatatttatttcagtttcttcttaaccgctacttcctcgtacacttcaagaatatctccgatttcgatgtcgttataacctttcaggttcagaccacattcatagccttttgtgacttctttaacatcatctttgaaacgcttcaagctttcaagttctccgtcaaatttcacaataccatctcttaataaacgaactttagactgtcttgttacttttcctgtaagcaccatacaacctgcaatggttccaactttagaaatcttgaatacctcacggatttcgacgttaccgatcacctgttcctgaatttcaggagaaagcattccttccattgcttcttttacctcatcaattgctttatagatgacagaatacgttctgatctcaatttcctcacgatccgcaagttcttttgcattagcacctgctcttacattgaatccaatgataatggcatctgatgctgctgctaagttgatatcagattcagtgatttggcctacacctgagtgaagaatcttaacactgatttcttctgttgataatctttgtaactgatcagaaagagcttccacagaaccatccacgtctcctttaaggataatattcaattctttgaattctcctaaggcaatacgtctacccaattcttcaagcgttgtatgcttcttggttctgattgacaattctctttgtaactgttctctcttattggcaatagctttaccttcactttcatcagcatatacacggaatttgtcacctgcagtaggcgctccgtctaaacctaaaatggttgcaggaattgatggacctgcttctttaagatttttccctctttcatcaagcaaagcttttactttaccatggtttttacctgctacaacatagtctccaactcttagagttccggactgtaccaacatagttgccacataacctcttcctttatctaaagacgcttcaataacaactccatttgctgaacggtcaggattagcttttaactcaagcatttcagcctgtaataaaactttctccaataatacatctacattattaccgaacttagccgaaatctcttgtgcctgaacatttccaccccactcttctacaagaaccggaggattcaaaccagaaagctgttgacggatgttgtcagggtttgcgttaggcttatcaaccttattgattgcaataatcattggaacctgtgcagcctgtgcgtgggcaatagcttcttttgtctgtggcattacatcgtcatcggctgcaattacaataattgcaatatccgtgatctgtgcccctcttgctctcatcgctgtaaaggcttcgtgaccaggagtatctaagaaagtaattctctgaccattctccagtttcacgttataagcaccaatgtgctgagtaattccaccggactcaccagcaattacgtttgtttttctaatgtaatctagcaatgaagtcttaccatggtcaacgtgtcccattacagtaactacaggagctcttgatacaaggctttcttctgtatccacttcatcttctgaatctgtatcttcaagatcagcatctgagaattcgattttatatccaaattcatctgctactaataataaggtatcagcctcaagtctttggttcatggtaaccattacccctaatgagaaacaagcagagattacttcggttggagaaacattcatcaaacttgccaattcacctactgtgataaattctgttactttaagagttctgtcttgtgcttcaagctcctgctgacgctcatcctgctctctacggaaggttcttttatcttttctgtgttttgcagatttagatttacctcctttattagtaagtttttctagtgtttccttgatctgattcttaacttgttcatcagtcagttcaaccggcataactctttgaccaggtctgttgttttgacctccttttttgaagccaccaccttgtccctgacggtttccaccaccctggttatttccaaaacggtttccaccctggccaccctgaccttgaggacggtttccttggccgccctgaccttgacggtttccaccttgtccaccgttattatgctgacggtttccttggccctgaccaccctggttgttatttcctgagttttggttattcccctgaccttgctgattattctggccaccaggtttttcaattctctttcttttcttttttgctccggcacctggttttggtgcaaactgagttaagtctatcttttctccaacgatcttaggaccatcaagtttctgataaactgtttcaattttctgtggttcctgagattcagactctgtctctacttttggagtttcttcttttttctcctctgcaatcactggttttggagtttcttttaccggttctgccggcttaacttcttcttttttctcctccatttttggtttgtcttttttcacaggtctgtttctagattctatttgagacaaatcaatcttatccaaaaccttaaattcctgtttttcaggcgctgctttaacttccggctgttcttctttcacgatttcttctttcttttcttcaaccggtgtcgcaacaggagccacaggagcttcttcaacttcaggcttcttagtttctaagtctattttacctaaaattctagtttctggtttatttgctttagctcttatcacttcaggggttttcttttcttcaatttccagtttttcttccggaactttagtgatcaccacctcatgggaagcctttctctgttcgccgtctttagcaaactcagcttccaatgcagaatatgccgcttcttccaattgagcgttaggattgctttcaacctcgaaaccccttgactgtaaaaattctactaatctggacatcgaaatgttgaattccttaaccgctttatttaatctaatttttggcatttatattatttactgttttttaatttttaaaattaaagtatttcctttttactgtttattaaaatttatttaaatcttaatcttcaaattcctctctcagaatacgtttaacctcttcgattgtttcttcttcaaggtctaccatatttaaaagactctcagtttctttatccaatactgattttgcagtcgtaagtcctactttcttaaactcatccaaaatccactgctcgatatcatcgttaaattctttcaattcaacatcatcatcctcgctggactctctgtatacatcaatctcatatcctgtcaaccaagaagccagtctgatattctgaccttgttttccgataactttagaaatttcctcaaccggagtatacaccaaagcgtagttggtctcctcattgatttcaattttgttaatggtaacgtttcctaatgctctcttcaccaagatctcagggtttttagaccactgaataacatcgatgttttcatttctcaactctcttacaacgccatgaattctggatccttttactccaacacaagctcctaccggatcaattctgtcgtcataagcatctactgcgatcttcgccttttcaccaggaattcttactacctttttcaagataatggtaccgtcctggatctcaggaatttccagctctaataacttctcaaggaatttaggtgcagttctggaaataataatctgcggtttagaacctttaaaatctactgtctcaacaatagctctgatattctcaccctttttaaagaaatcggatgggatctgattttctttcggtaaaataaattcatttccttcatcatccagcaaaattacgtgcttatgacggatgtggtggatttcccctacaactatttccccaattttatctctgaactgttcgtacagcattgcattattatgctcctgaagttttgtagccagaatctgcttcagggtaagaatatttcttctccctaactgagcaacaggaatttccattgtaaagtcttcccctacttcgaaggtagggtcaatctttttggcttcagaaatttcaatttccaggtcatcatcttcagacatttcgtcctctacaattgttttatttaaaaatatctgaaaatctcctttatccgggtttacaatcacgtcaaaatgatcatctgaatcaaatctctttcttaaaagagttttcagtgaatcttcaataattgccataagatcaatcttactgatccctttttcgtctttaaaatcaccaaaggattcaatcaacgctatattatccatctattcttttttctttttaaaatttaattactactaatgcttttttgatctcagagtaagaaatctctttttcctcctctacatctacttttccttttccgatatctttcggcttacggtaacgcaaaacaagtgtgatcttctcatcatctacttttgacaattccccttcaattttagaagaatcctccagcatcacctcaatctctcttccaatgtttttactgaactgtcttggtgtggacaatggttcactcagtccggcagacatcacctgaaggctgaagtcgtgctcttcacgatccatattgaattctattgcacggctcgcatcaaggcaatcctgcaaagaaactccgttatcaccatctaaaatcactgtaatatcatcccctgcagaaattttaagatcaataagaaacagatcttttctggtctcaaggaattcatttaataattcttcaattctttttctaaactccatatatttttatcttgatttacagtacgaaaaaaggctttcttccgaagccttcccattttttccgtaaatccattgcaaatataagctttttttctaaaaatgcaaaattatcttaagtatcaagcaaatagcgtaagattcatttaccataaattaaaagaatatgtcccgggatttttattacttttgtctttagaatttaaaaacatacattttgaatataacgattgtaggaacaggctacgtaggattagttacaggaactactctggcagagcttggcaattcagtatactgtgttgatattgatgaaaaaaaagtagaaggtatgaaaaacggcattgttcccatctatgagccgaatcttgaagaaatgtttttgagaaacattcagtctgaaagattatttttcacaaccaatcttaaagaagctttagacaaaagcgaagttatttatctggcattacctactcctccgggagaagatgggtctgcagatctgtcttacgtacttaaggtagctcaagatattggtgaattgatgactgaatataaagtcattgtcaataaaagtaccgtccctgtaggaactgctgaaagagtaagagaaacgatctcttccagaacagatattccttttgatgtggtatcaaatcctgaattcttaagagagggctttgctgttgaagactctatgaacccttcgagagtagttgtaggtgccagctcagaaaaagcaaaagacattatgtctaaaatctatcagccttttaccaataccgggattcccatcatctttatggatgaaaaatcatcggaactcaccaagtacgctgccaattcatttttggcggtaaaaattacctttatgaatgaaattgccaactactgtgaaaaagtaggagcagatgtggataaggtaagacttggaatgggtagtgacgacagaattggacacagatttctgtttccgggaatcggatatggcggaagctgttttcctaaagatgtaaaagcgcttataaaatcggggaaacaggaagattttaatttccagatcctggaagcgactgaaaaggtaaatacaaaccagaaagtaattttagtatctgaaattgaaaaatatttcggaggaaatattgaagggaagaaaattgccatgtggggacttgcctttaaagccaatacagatgacatcagagaagcttcatctttagataatattgctcttttattggaaaaaggcgcagaaattgtagcatatgacgctgttgcagaaagcaatgttcaaaaacttttaggtgataaaatacaatacgcaaaaggaatgtatgatgcactggagaatgtagacgcactgtttattgctacagaatggccggaattcaaaaatccgaattttgaacttatggctaaaaaaatgaaaaacaaagtcatttttgacggtagaaacatgtatccattggaaatccctgagcaaaacggatttcattataaaagtataggaagaaagaccatctcaaaataaatcaatgaaaaacattatcattacaggaggtgccggattcatcggctcccatgttgtaagagaatttgtaaaaaacaatccggacactacaatcatcaaccttgacgccctcacctacgccggaaatctggaaaacttaaaggacatagaaaatgaacctaattatgttttcgaaaaagcagatatcacaaaacctgaggagcttagaagtattttcgaaaaatacaagccggatgctgttgtgcatttagctgcagaaagtcatgttgacagaagtattactgacccgatggcatttatcaataccaatgtaaacggaacagcaaatcttctgaacctgtgtaaagagttctggacattaaatcccgatcacactcacggcagattcccggatgaaaaaagaacaaatcttttttatcatgtttcaacggatgaagtctatggaagcttaggtgaaacaggattctttctggaaacaacatcatatgatccccaatctccatattctgcttcaaaagctgcttccgaccatttggtaagagcttatggaaatacgtatggaatgccattcatcgtatccaactgctccaataactatggacctaatcatttcccggaaaaactgattccgctttgtatttcgaatatcatcaatgaaaaacctcttccaatttatggcgacggaaagtataccagagactggttatttgtaattgaccatgccaaagcaattcatcagatctttaaagatgcaaaaaccggagaaacgtataatattggcggctttaatgagtggcagaatattgatcttgtaaaagaactgatcaaacaaatggatgccaaactgggaagaccggaaggctattctgaaaaactgattacttttgtaaaagacagaccggggcatgataaacgttacgccattgatgcaacaaaattgaataaagatctgggatggaaaccatccgtgacttttgaagaaggactagggaaaacgattaactggtatcttgaaaataaggaatggctggagcatgtaacaagcggagattatcagaaatactacgagactcaatataattaatcatgaagctggtttttctattgctatttgtcatgtcttctctttttaatgctcaggcactccctccgcctccggcaatggcaaactcttcacagcaaaaactgattgatgagtttatagaagtttcccattataaggaatcattgattaattatgcaaaagattatctggaactgaaaatgtttgactacagtgtggatccgcccaaagaactgattacaaaggaacaggcaggatctattatcaacggttttaattttgatgagtttaaaatttcactatacagctcattctcttttattccggaaaaaaatttaaaagaacttatacaatttcacaaaggcataggaggaaaattatccaaagacaattcggtattcctcataactcccaccatagatttaaatattaaaaatcaaatggattatgccatagaaaacatacaaaaataaaagatgaaaggaataatattagccggaggatccggaacaagactttaccctctaacgattgcagtaagcaagcagctgatgcctgtttatgacaaacctatgatctattatccgctttccacattacttttggcgggaatcaaggatattctgatcatcactactccacatgaccaagaaggtttcattaaacttctgggcgatggttctcaaatcgggtgtaatatagaatacgttgtacagccaagccctgatggcttagcacaggcttttattttgggcgaccagtttatcggcagtgattctgctgcattagtgctgggtgataatattttttacggttctgaaatgggaactttgctgaaaaataaaaccaacccggacggaggtgttgtttttgcctatcacgtggctgatcctgaaagatatggtgttgtagaatttgacaaagatctgaaagcggtttctattgaagaaaagccattaaagcctaaatcaaattacgctgtacccggactttatttttatgataacaatgtagtcgaaattgccaaaaacattaaaccttctgcaagaggtgaactggaaattaccgatattaacaatgtttatttaaagaatggtaaacttgaggtagctgttcttaacagaggaaccgcatggctggatacaggaacttttgactctcttcatgatgcttcagaatttgtaagcgttattgaaaaaagacaaggatttaaaataggctgtatcgaagaaattgcattcagaaataaattcattaatgaagaaaaactgcttgaaacagctaccaaatatggtaaaagcggatacggtgaatatttgaaacagctggtaataaaataataaattcatctacaaaaatcaaaagctatttctataaaaatgttaatagcttttgattataatacaactattaatatattagttgtaattttcctgttgtatgtaaatactatttcataatacataaaatcaggataagattaattattataaatttgaaaaaaaatctactttgaaaaccgtagtatacacatctgataaaaaaacacatttcttccaagaactcaaatcaatttttcgagatataaaatcatctaattttctggcctatcaaatgacaaaaagagatatacaatctcaacacagacagtctttattaggtttcttttggatattagcccccgtaattataaattctttaatttggttatttttgaatggttctggagtcgtaaatgtaaatataccgggaggaataccttatcctgttttcgttattttaggcaccacaatctggaatatttttgcagaagcagtacaaagtcctataaactcggtaaactccggaaaagctatcatatctaaaatcaatttcccaaaagaagcattactgatgaaagggatatacactactctctttaatatgttaataaagatgattcctgctgttgctattttgatcatttatcaggttacgccatcagcgagtctgctcctttttccattttatattgtagccttaatcattttttcttttgcgataggattaattattactccactgggattgatttatacagatataagtaaagttctcattacaggtattcctttattaatgtatatgacgcctgttgtttatgctgtaccgagatcaggaatttttaaggttttattcaatttaaatcctttaacttatataattaacgatacccgaaatacactggtaggattggaaacgcagtcattaatgtttacaatgatattaacggctgttagctttattgttttattgataggcttggttatttttcgaaagtcaatgccaatagttattgaaaaaatcgcaggataatgggaaaagatagagaggtattagtttcggtacagaatgtatctaaaaaattcagcaaaaatctgaaaagttctctgaaatatggagcttcagatattatccgtagtacactgggattatcaataaataaagaattacgtcctcaggaattttgggctgtgcatgatgtaagctttgagctgagaagaggagaatgtattggcttgattggtcataatggtgcaggaaagtctactcttttaaaagttctgaacggattatacactcctgataaaggacaaattgtaatgaaaggaaaaataggtgccttgatagaattaggcgccggttttaatcctatccttacgggtagggaaaatatttataataatgcgtccattttaggatttacaaaaaaagaagttgaaaagaaattaaactctataatagatttttccgagatcagagaatttatagatactcctgtacaaaattattcctcagggatgaaagttcgtttgggatttgctgttgcagctcatcttgaaccggatatattaattattgacgaagtattagccgttggagatctgggctttattttaaagtgcttcagtaaaattgatgaattgcttcctcatactgcggttatctttgtttctcacagtatgccaatggtatcacgaatatgtaatgaaataattttaatggatcatggcaaagttgaatatcagggaaaagaaataggaaaaggcatacaactttattacagcaagttttcaaataatagcgaaaataaagtatatgataatggtatattagaattgatatccttacaaactgatctggtgaacaatgaaatacaccgccatcaggactttaatcttacttttgaattcaaaattaataaacctgttgatgaattacctactttatatcttgaatttaaagataaggagcaaaagccaattgccggaatttctgttcaggaatacaaagaaggtataaaccaatctgcaaaaatcgtttataaaacaactgtgaaaaatcctcttttcactttaggaaagtatattatggatgtaggactatataaccctaccacagaatccccttatcttcgaatcaataacattctggagtttacagtaagtggagaaaaagaacaatggataccgtttgagcttgatagcgaaaatatcataactttacactaaaatttattatgattcccgtaacacaaccctttcttccacctaaggaagaatatgaaaaatacatagatggcatctggaaaagaaactggcttaccaatatggggccattagccagtcagcttgaaatggagcttaaaaaccatttaaagcttaatcatctgctgtttgtaaccaacggaaccgttgccattcaaatggcaataaaagcattgggaatttcaggtgaagtaattactactccattttcttttattgcaaccaccagctcaattgtctgggaaggatgcacccctgtttttgttgatatcgatgctaaaagcttatgtatagatcctaaaaaaattgaagatgccatcacggaaaaaaccagtgcaattctcgcaacccatgtttatggaaatccgtgtgatgtagatgcaatagatgcaattgcaaaaaaatataatttaaaagtaatttatgatgcagctcacgcttttggagtggaagtgaacggaaaatccatttttgaatatggtgatatttcaacctgctcgctgcatgcaacaaaactttatcatagcgttgaaggaggcttattgataacaaaagatcctgaattattaaaaaaactggcttatatcagaaactttggaatttcaggctttgattcattctcggaattgggccttaatggtaaaaattcagaatttcatgccgcaatgggacttgttaatctaaaatacatttctcagatacatgaaaaaagaaaagcactcgcagaactctatgatgaaaaacttaaaaatttacacgctgtaaagcctctctggcattcaaaagctaacaataatcatgcttactatcctgttgttttggaaagtgaaaaattattactgaaattaaaaaatgagatggataaacaggaaatttttacaagaagatatttttatccaagtttagcttccgcattgccgtatttgccaaaactggaactttctgttactgaagatatagccaagcgagtgttatgtcttccgttctattatgatctcacttttgaagaggttgaatatattgcaagattaatgttaagaatacaaaataattagtatgaaagtagcgataatgcagccctattttttaccatatcttggctatataagtcttattaagcattctgatcttttcattctttttgatcctgttcaatttataaaacatggctggatagagagaaatagaatcttgaaacaaaatgaaggttggttatatgtacaggtacctttagtaaaaagtccccgggaaactcttataaaagattgttttattgataattcgcaaaactggaaaaacaaaattttatctcaactggagatttacaagaaaaaagctccttattattacaaaacgcttaaggtaatacatcaaatatttgatgaagattacaatgatattgtcagtctaaataaaaattcattagaaaaaatatgtgaatatttaggtttctacaaagatcttcctgtattttccaggatgaatcttgaaattgaaaaacctactgcacctgatgaatgggctttaaatatctgtaaaaaacttccggtaaatggtaatttacactatataaatcctattggtggaatggatttttttgatagagataaatataaagctaataatatagatatttcttttcaaaaaatggaacttcctcattatgatcaaaaaagagagtcctttgaaagtggcttatctataattgatcttatgatgtttaattctccggaggaaataaatgatatgttggaccagtttgaattaatttaatgagtacaaaatcaataggaggatattttgagctagaacttcccaatacagtaaataattgggataaggatttcattgagttaaattcagctagaaactgtttggagtatatcctattggcgagaaaaagcacaaaaatttaccttgcatattatacttgtgatgttcttttagaacccatcaaaaaacttaatattaactacgaattctatgatatagatttcaacctggaaccaatatttgattattctaaaataaaagattcggaaatatttttgtacactaattattttgggataaaagataagtttatcaatattctgtgcgaaagactttttgataaaataataatagataatgctcaggcgtttttctctttaccaataacaggcattgatactttttattctccaaggaaatttgtaggggtagctgatggaggttttctaagtagtaataaaagaattaatttggattttgaaaaagatgaaagttatgatagaatgagccatcttttgaaaagaattgatctgtctgctgaagaagcataccttgatttttgtacaaatgatcggtcattggaaaaccagcctataaaattaatgtccaatcttaccaaaaaaattctttctaccttaaattttgatgatataaaaaaaagaagaaaagaaaatttcgcatttctaaatgaaaaattaaaagaaaataatcttttaaaaattgatatttcagaagattcagtccctatggtttatccttttagaactaaaaataaagatctcaaaaggcaacttatcaataagaaaatttattgtgccacttattggcccaatgtttttgaatggtgtagtgaagaaaccaactcctacattttggcagaggaaattatagcacttcccatagatcagcgatactctattaatgatatgagaaaaattttagaaaatgtataatgttttaatcagacctcttcaaaaagaagatgcgcttatttcatatcagtggagaaacgatccggaagtttggaaatttacaggctcccgtcccgatatagaaattactgaagaaatagaatccgaatggattgtaaaagctcttcaagatgaaaaaagcaaaagatttgctattttatgtgacagcgaatatatcggaaatgttcaccttaataatattgaaaataatactgcagagtttcatattttcatcggtaataaagacttttggggaaaaggaatctctcaattagcaacataccagatactttattatgctaaagaagtattgaagctttctgaaatatacttatatgtaaagcctgaaaatattgcagctgtagaatcttataaaagaaataattttgtagttattgaagagaatctgggcaatgttaagatgtcattacagctatctcaacttaaaaaaactaccgttagcatatttgtaatggtatataaccatggtcaatatttaaaagattgccttgatagtttattagagcaaaaaacaaatttcaactatgatattgtagttggagaagattgctcaaaagataattccagagaaatactgctaaattatcaaaaattatatccagggaaatttaagcttttacttcatcctaataatataggagcagtagataaccaaaatattacttatgaaaactgttccggaaaatatattgcaatttgtgaaggtgacgattattggattgatgctttaaaacttcaaaaacagattgactttctagaaaaaaatccggaatacagtcttacttttcataaaatcaaggaaatcacaacaagagaagagagatattcttatgataatccaaatgaggaaaaaacatacactttagaagatttatcaaaagaaaattttatcgttactgtttcagttgtattcagaaaaaattttgaaaaacttccggaatggatgaagtattctcctatcggcgattaccctttacatttactgaacgcttcttttggtcttataaaatattttccagaggaaatggctatttaccgagttggaagcgggatatggagtacacaaaacatagttgatcagattgtaaataccatgttttctctgaaatttttattacaacattttaaaaataataaacccgtatatgataacttgaaaatacaatatggtaattttaaaacagctcttaaaaagccttttgaggaaaaaagagaattagaattaaaaataaaagattacaattatctcgaaagaaatattagcactaattatcttttaaaaatgctaaaaataaaaattttaaaaaagttgaaatttaatttctgaatctttacaaaatgagtgaaacaaaaaaaatattattaatatcccacgaagcatccttatcaggagctccaattcttgttttaagtgtcttgaaaaagcttagacaagaaaggaaaaactataaagttgatgttttattattaagaccaggtcagctttatgaagattttgccaaactttctgataataaaatcattgtcgccaactattacaaccaatctttatcgtttgtaaaccgaaatttcaaaaaaattcagaatgcttttttcccaaaaacagaaagcaaagaagaacaaattgaaaaaataacaggaagacttcttcagaataactatgatttggtttatgcaaacacagcggaaacgttaatctggacaatacctttttataaaaaaaacattcctaccgttgtagcaatccatgagcttacttttggtattgaaagcgcatattcaccagattttatcaaagaaaatatatcaaatgtttcaacaattattgcagggtctaatgctgtagccaataatcttattaatagatacaatgcagatcctaaaaaagtaaaagcgatccattcgtttgttgatgaaaagcttgagattcaaaaaaatcagattcaaataaagaaagaactaaacattgcggaatcggacattattatgggaatagcaagttctcaggaattaagaaagggaacggatttagtgccgcttcttgtcaaaaaaatcgcagataaaacagatattaattttaaattcattaatctgggaggttcttcaagcattggtccggtaaaatgttcaaaattggatgcagagaagttgggggttctggataaaattatatatgtagatcataacaagttcccgaatgattacataaatatattcgatatttttttactattatcgagagaagacccatttcctttggtaatgcttactgccgctaagcttaagaaacccattgttgcatttgaaaatagtggaggtgcggtagaatttcttgaaaatggcttcggagttttagccccataccttgatcttgatgtcatggcctcagaaatagtaaaacttttacaaaacaaggaattaagagaaaattatgggttgaagattcacaacagattggaaaaagaatattctgaaggcaagcttacatccgagattttccaaattattgatgatcttataaattaattaaatgatctccatcatcatctcatcataccttcctgactatttttctgcacttgaaaaaaacattgcagaaacaattggagtgtcttatgaaatcattaaaatagacaatcctggattgatgggaatttgtgaagcttataacaaaggtgcagaaaaaaccggttttgattatttgcttttcatccatgaagacattttattcaaaaatgaagattggggcaatacgctcataaatcatttaaaccagaaaaacacaggaataataggactggcaggatcatcttatgttccctctgctccatcaagctggactgttacagagaaatataattctgtcaatattttacagggaaataaagagaacacattgtattttcctatccaaacaacaaaggaaaacagaaataaagtctttgcagttgacggcgtttttatgggaattaaaaaagaaatatttaatcagtttaaattcaacgaaaatctgctgaaaggcttccacggctatgatcttgattttagtttgagagtttctaaaaaaaaccagaattatgtagttaacgatatcctgattcagcatttctctggcggtaatctggataaaaactggttagatgccaatatcaaagtaagggaaagtataggatcagattttcaaaaagaaatcgacactgaagctgaaaagaaaatatttataggctttttgcacaattttttcaaatattacccggttaataaaaaaaacatatttctcacattaaaattttatcccaaaaaacttaattttaatgagcatttggaaatagcaaaaaaatattatgcctacatacgatacgccggaagtatcaataaaaaacacaacacaaagaattaaaattatttaaaattgtttaaaaatgatcataggaaacggacttattgccaattcattaaaaaatatagactccgaggaaaatcttttttttgcctccggtgtttcaaattctctggaaacgagaagttcagagtttgaaagagaatttgctcttttggataagtgtattgagagtaatagtaatcacaaattaatttacttttctactctaagcattcatgatcaatcaaaacaaaacagcctttacgttttacataaaaaggaaattgaaaattacattaaaaataagtgcaacaactacctcattctcagaatcgggaacattgtaggtagcggaggaaatcctaataccttattcaattttcttaaaaatcagattaaaaattcaaaccagtttacagttcatacaaaggcaagaaggctattgctggatatagaagatatttctaagtttttagagtctcactgcctgcatcttcctaataaggttattaacttttctttcccctataattttgatttaaaagaaattattagcgccattgaaaaagaaacccttcaaaaagccttctattcagaagtaaatgaaggggacttttacaaagtagattttgatgaagaagttcacgccttcttctcaggtataagtcctgaaaattacctggaaatgttaacccgaaagtatatttaaaatggcggctattcatgtaatcattgttacttataatgccatgaagtgggcagaaagatgtttttcaagtttaagaacctcttcagttcctgtaaaatgtattgtaatagataatggatccacagacggcactcaggaatatatcaaaaagtattttcctgaagtagacttcactcaatctccacaaaatctaggttttggaaaagcgaataatacagggattgaaaaagcgtataaagaaggagcagattttttttacctgatgaatcaggatgcatggatttatccggacagctttcaaagactattggatgtttacaacgcatacccagacaaaaatcagctgggaattttaagtccgatacatatggatggcagcgaaaagaagctcgatatttttttcgaacgttatctggcaagaaatacgcctgataacagaatattttcagacagttttaacaatagtctgaaagattattatgaaatagactttgtaaatgctgctcattggttacttcccaaagctacgattgaagaaatcggtggttttaatccttacttctttcattattccgaagactatgaatatgtacaacgtatttcatttttcgggaaaaaaattatcgtatgtccgcctagcacagttgtacatgatggtaaacaggatttccataaaaccagccatatcaatgccctgagagtacaacgggaacaacgctatctgaatccggcgctcgcgtttgattccaaaatattgaacagagatttcattcctaaaataataaagcaggctctccaattgcagttttctgctgcttccgatactttgaaagaatatcaatatcagaaagccagatttaatgaaatcataaacgcaagaaacatcattaaaaataaaggtgctgcttttctcaatatgttgaagtaatcccactgatgaaatattaatccaaattgacacaaatgaacagagccagtcttattaacaacacaatacaaaagggaaatcttaaaaataatcctcaggaattaataaatttgagacctaaagacattctttcatcttttattaacagatttcattactaaatcaatgaagccagaaatatcggtcattatgctcacttacaaccacgctccttatttaaaggaggctattgaaggtgtgctttctcaaaaaacagactttccgtttgagttgattatttgtaatgacaattcaccggatgattctgacaggattatttcagaatttgcaacgcaatatccgaatatcatacggtattttaatcataagaccaatatcggttttgtggaaaatcaaagatttgcattcgctcaggctaaaggaaaatatttggcctactgtgaaggggatgattactggactgatccggaaaaactacagtttcagtatgatttccttgaaaacaattcagaatacgttatggtgactgccagaaatttactgtttcatcaggatgaaaataagatgaaagaagatggaaaagactccatgttcaacggacagaaatatattgattacacccaagacagcttttttgtacagcgccctacccaaactttcacttatctgatcagaaaagagtgtattgatgagaaatggattgatatttatcccaattacagagatctttactatttttaccatgcccttgaattcgggaaaggcagaagttttaataaagtagtgggagtctacaggcttcacagcggtggtgtatacagctcattagaaacagaaaaacaataccgcacttccattgatatttttaaaaatattaaaaggattaataatgacccgagagcagaccagcagatattaaaaaccttggatcagctcatcaataaatattattatgaaaaggaatttatttcacctttatggaacagaaagctttatgcagccatctttgaacgcttttccatttcaaaaaatataggaatagggataagccagctgttaaagattataaaatatactttcaccagataatcaacacctgtaatggctgatatgtatggtgaatatcatcccgctctttttcattatgaatgtggataatgaatatatcagccgtattcatttttcaaccatttcaacataatagatcaaatagtttgagggatcagctgatgtaaaccgatcatactttccttaatttatcgtaatttagccgtacaaaatgataaaattaatgatgaaaaataaaagcatatgtgcggaatagccggaattgtaagcaataacgcagcaaattatcaggaggaaatcaaaagaatgacagattctctgattcatcgcggaccggatgcttcagactttgagttctatgataatgctatattaggccaccgcagactttccattatagacttgtctgaaaacgggaagcagccgatgttctccaatacaaaaaaagaatgtattgtccttaacggagaaatctatggatatctggatctcaagaggcaatatgcggaatatccataccatggaggctccgatacggaagtgattcttgcaatgtatcagagaaaacagcagaacctcatccatgatcttccgggaatgtttgcttttgccatctgggatgaccgtgaacagcaattgttctgtgccagagaccgttttggtgaaaaaccgttctactacgccatcggaaataataatgaatttatttttgcttcagaaatcaaagcgattctggcgtccggattaattcatcctaaagtaaatcctgaagccatttccaactatcttcaatatggatacgtaagtacctatcaaagcatttacagcaatatatatactttaccacctgctcatcagctgatctggaaagatgggaagattactgtttcaaggtattacagcctgccgtcaaaagacagggtgatcagcctttccgatgctaaggaagaatttctgtaccttctgaaaaatgctgttaaaaaacagcttatagcagatgtacaggtcggaagttttctgagcggcggtttggattcttcgtctatagttgctctggtagatgagttcctgcctcatcagacaacaatcagtttcggatatgatcataaagacagcgagctcaaatatgccaaagagattgcagagaaatacaataccaatcatatagaagttcatgagcaaaaaaaggacttggctgaatcattactgcatgtttctcctttctttgacgaaccttttgctgatacttcttaccttccacattatgagatttgtaaaaatgcaagaaaaaatctgaccgtagccctttcaggtgatgttggagatgagctgtttggcggatatcatttttatacggtagaaaatatgatgaaaaatcatttcagttataaaaatttaatcgccaaattcggacttaacctttataaaaaagcaaagacggtttcgtttgtaacccaacagaatttaaagtatgactctattctggattttcatctgaattccgtcagaaatgtatttaataaatcggaacgtagtcttttggggtgttcaacggattatcagcagggatacagctttactccaaatcctgatttattaaatgatatcatgagggtagatctggaaaattatgttcctggaaatatgatggtcaaatcagacagaatggcgatggctaattcattagaagtaagaactccttttcttgatgtcgattttgcagaattctgtattcagcttcctgatcagctgaaaattaccggtgaaaatgataaaataattcttcgtgaatccatgaataattattggaccgatacaatcagaaaacgtcacaaacaaggtttcggacttagtgttaagaactggtttgatgaagaaaaccttataaaactctccaacgatcttctaaaagattcgtctcaaaaggtttttaactatattgattttgatatcacccaaaaatttttgaacaaggaccataagcactggaatttattgcagcttgctctttgggctcataataataaatcggttctctgatgcttgatatttctgtcattatccctgtatacaatgctgctgattttctagagaaatcagtacagtctgccctgcaatttgaagaagtgaaagaagttattttagttgaagataaatcttctgatcattccctggaagtttgtatagaattagctggtgaagatcaaagagttcaattgttccagcatcctgacaaaggaaaccatggtgctgctgcttcaagaaatctgggtattgaaaaagccacctcaagcttcattacattcctggatgctgatgattattacctacccaataggtttgatgcggagaaagaactttttaaagagccgcaggtagatggaatcttcaatgccataggggttgaatatctcaccgaaaaagggaaaaaggaatttcagtcgaaattcagtgacaatgcattgacaactgtaaattatccggcagaaggaaaagaagtattcagagggcttctcgggcttacaccgaaaactttcggtacatttttccatttgaatggattaaccgtcagaaaatctgctctagaacggaataatctgagatttaataatattctccacgtacaccaggactctgattttatcattaaactggcttaccattgccatctgaaatcaggtagtatagaccaggccgttgcgatgagaggaatacatgatgataacagaattaccaagattgtccgatactcgccacaatacaacaggagacaattccttttctggaattcattatacgagtggtccagatctgtgtccatggatacagatgccgcaagtcacctttatttacagaaaaaagcatttgaactttctgagaaaaaaggagtttccaaaatggtgaatctattggctgccattctaaaaaatccagatatcctgaaaacgcaataccgctttacgtacatccgctcatgaagcttaataacctacaaatattaagaggaatatcagcattactggtatgctgctttcactttgctgattatattaattttcaggatctgcggttgggtgaaattttattcagtaaaggaagtatcggtgtcaatattttttttgtaatcagtgggtttatcatcacttttactacctataaaaagaaatttacagcaaaccaatcttccgaattaactttgttttataaaagaaggataatcagaattattcctttgtattttatattaactttagcctggatggtgcttggtggaaattttatgtcttattttcatggcgagggagccaagagacttattcattcggtattttttcttccccaaaaggatacttttcccgttctgtatcttgggtggtcgcttaattacgaaatgtttttctaccttattttcggaatctctctcttatttaatacaaaaaaatattcttttattgttcttttctttatttgtacttatatcctgggaatcatttatccattcgaaggagcttatttgcagttggtaaccagttcacttaatctctattttgttatgggaatattattggctgtattttttaatagattcacagttaataaaagccgggccagctttatcagtatcataggagtatcgtttttcttactctatttattcgagtttttgaagatcacaaatccgctcatcaccttaatggtagtctcactattggtattttcttttctactttttgattttacctttcattataaaggaaaccgttttctgatatttctgggggatatttcttattctctctatctatcccatccttttgtagaaatattcttcagaaagttcaaagtagcaggatattttaatattccctattttatatttaaaatacttgtggtaattgcagtagctgcattcctatatcactttgtagaaaaaaagataacccattacttaaaaataaaattaaaagcttaaattcttgcaataagaaataacgcataaacacaatataattcccaattgaaaaaatgaaaatctcagtcatcattcccgtttataatgcagaaaaatatgtctcccaagcagtagaatctgcgcttcaatttgatgaagttcatgaggttatattagtagaggacaaatctcccgataacgctttggaggtctgtcagcaacttactgaaaaatacagcagagttcagctttaccagcaccccgacaaaggcaaccacggtgcaggccctaccagaaatcttgggatagaaaaatcaaccggtgattttattgctttcttagatgccgacgattattaccttccgaatagatttgatgctgaaagagaattatttaaaaatcctgaaatagaaggtgtttatggtgcattgggtgtacattattactcggaaaaggcaaaagaacagtattataaactttttcaggatcgtttaactacggtgtacaaaatttatgagcctaaggacgtatttccgggacaaattaatatgttgggaagctttggtttatttagtattgatgctttaacgatcagaaaagaatctatgctgcgcaagatgaatcctttatttaaaacaaatttaagattgcaccaggataccgaatttttattccgtttatcctattaccttgatctttatcctggtattttagacaaagcagttgcggtaagaggtgtacatgaagacaacaggattacaaaagtagattctaagaaaataaaaccttccactacaagagttttgctttggaaagaagtgaaagactggtcagaaaacgaagatacaattcccgctcatatgaaactccacattaagagaatgcatcgtagttttgaaattgccaatgctccctttttcaaaaaatggaatatgattctgaaatatcttgtcacagattatccaagcatccgctccggcctgtataatattaatttcaggaaatatctattctgatgtaattatctttttgttttggacagaatcgaatccgctatttgtgcggtaaatacttttccggattctttatacatatgattcccatctgtatattgatagtccttggctttggaagagaaatcgaagaaataaacgccatattttttggagacctctttcattttttcattaaaatcaggtgaataggactgttccagtgctaccattttttctgaagcaggaattcttacaagatagacagtccctttacttttaaggaatctgataatgtcttctaaggcattgaacctggcttgcgaaatattctggttctgagccaattgtttgtagaaatttattttctcaatttccctcttggctatagaatctttttgcatgtttaccgttacttccatccaaccatttttatgcagataagtatttgatcttcctgcttcctctctctccgtgtaaagcttaaaccagcttcgggtgtaatttctcaatagatattcataattcggggacagatcataaaaatgcatattctttagcggagaatgattttccggaaagtcctcttcttttttcacattcttatctaaggatagattccatgggtctacggttataatgaataatccgtttttggtttccgggtccagttttctttgtaacgccttataatagatttgtccgtacggagactgaacaacgttcaatgcaaaattatcaaaatctcttcctaatttttgatttaaaagctggggaagaactgcctgagcccctcttgaatctcccaaaataatattctgtggtttttttacggcgaaatgcatataattatcatctgtatttccatccgcaaaccatcccaaaaccccgaatacgattaggactccgacgatataaaaagatattttaaataaaaattttttcatgttaaaactgaaaataaataaattcattatttccgaaattggcataccgcagaataatatagatgataaccagatatagaattcttcttatccacggcctgaattggtcaatttccaacccatggttcttccctctgttgatccactcaatgacaaacatgacagcaaccagcgaaaagactttaaaaggaaacggttggggaattataaataaagccgggtcaatgatctttttaatatataaaacagcctgagtaacagactctgcgcggaagaaaatccatgcaaaacaagtaagaccaaaggtgagtaatattttaaaaaattctttaaaagagggcaaaagtctgtccattgcaactacttctaaattctgacgatttttatcggcaagcagcaatggcataaaatataaggcattcaaccctccccaaatgataaaggtccagttagctccatgccagaatccggaaacaagaaagataatgaatgtatttctcaccttcatcatcagccctcctttacttcctcctaaaggaatataaagataatctctgaaccatgaagacaatgaaatatgccatcttctccaaaactcagcaatatcccttgagaaataaggaaaagcaaagttcttcagaagttctattccaaacagccttgaaacacccaatgcaatatctgaatatcctgaaaaatccccataaatctgaaaggcaaacaaaacagctcccattaagagattagcaggactttcagtttgataattggtaaaaatctcattaactaatggtgcacaattatctgcaattaccattttcttgaagaatccccataaaatctgtctcatcccatccgcagcctgctcataactgaatactcttttcttttgtatctgcggtaaaagatgggtagctctttcaataggtcccgcaacaagtaacgggaaatagcttacaaacagagcgtaatctatgaaattggtctctgctttgatcccttttttataaatatcgatcacgtaagaaagaccatggaaggtataaaaagagatcccgacaggaagcacaatattgagtaaccagacatttaccgtaaagccgaatccgcttaacagatcggcaaaactttcagcaaagaagttgtaatatttaaaaaagccaagaaagcctaaattgattacaatgcttagtgtcaaccagaatgtagcttcttttttcgttttgcttttttctatctgaagcccggacacaaaatccagtcctatagaaaacatcagcaaaaataaaaatctccagtcccagcaggcatagaaatagaagcttgctaccagtagcatcagattctgatgctggtattttttcctgaaaacaaaccaatataatataaatacaatcggcaggaaaattaaaaagccaatggaattaaataacatagatattcttcaatgcgttaatactaacttagattatcagcagtaaaaaaatatccggaaaagatgggaactattaattcattcatgtgtttatgtatttgtgtaattatagcaaaagtaaatattttcagcttatttttagttttttcaggtaatctcttaaaggcttttcaatccactgatagaacaaagcagatataatcagcaaaacagctatatatatccagaaaaccgtatcaatgtcaagcaacaaatgctgccatttcaaaatctcccttacgatatacaaaaccggaatatgcacaatatagattgcataacttatttctccaagatattccaaaggctttaaagagaaaagcctggtgagtactccattattataagagatcagaataattaatgggatgaaaagcactgccataaggccattatgaaaattaagcggaataaaaataagagccagcaatactgccataaataaaataatgacaggaacgtcatagttcttttgcttaaaattcttcacaaaatacattcccgccagatttcctattaaaaattcattaaggtgcatgagcggaaaataaaatccaaattcatggcttttcgtatgaggtccttcataccacaaagattttacataaaaattcgagaaaacctgtgtgatcagccatattaagattgtaatcacccaaatgctcttattcttttttgaataatatctgttgtataatagaggaaacagcaaatagaaaaggaattctacagaaatagaccatccgggaaaattcaggactaaagcttcgccagggatccagctttgaatgccaaacagatacaatatcactttatataaactgaagtcggaggacctggtaacaagatataacaaaagccctacaagatataaaggataaatcctggcgaatctgttccggtaaaaatccaggtaatcaatggaattctttttatgataggcaaccatcataatgaatcccgaaagaataaaaaagtagcttacgccaacattggcccggaggaaaatatctgacagataattgatctgatataaaaataagtctttattaaaatgcgaaatgacaatcgcaatagctgctacaaatctcgtaaaggtaatctgacttattttcactgatcattcaatgctgtataactttaaagtttatttgataaagacacctacatatttgccttcaaactctactacagttgtgttaatattatttttttcacaaaaatcctgataagcggaattatcaccaatatcatcactaatgaaaacccctccttttctcaaatgcttataaagctcatcataagcccatattcttccattataacttttatcagaatcataatgaagaacatcgaatacaggattttcagcgaagatttttggaagtgattctttatcggcaaaacgaaataatttccaattactttttagcttttcaggaactacatatcctacatattgatctccgtcctgtgccagataaggcatgtccgagctatacaaacgtcctcctctttttgcaagagataaaagagatgccagtgaagaccatccgtaagcgacccctgtttccactacatgctgtgcatttgtaaattcacaggcataataaataagctccaatgctccaggcccacccatttttacaggacattctttttctctttgttctgcaaaacttaaaatttcatggtattcaacgcgaaaaggtttaatatcaagtccaaaaagtctggacactgcctcttcttgtgaaatgcatctttctgcggcccaggaatttgttttttcctttcctttaaaggcattacctctattaactgtatttttaataatttttcggcctaattcgggataaagatcaggtcttttcaaatagccgataaaagttttgagaactcttgtaatttcacccattgtgttgtctttgataagaggcaaaaataaagatttttttttatttttataaaaaaaccttctacctgtccgaaacattataggttaagttacaattgaataaatcatttttaaacaattggtacaggtttttataatacctccaaaaagagaaatgaaaaaagtaatctatcatttctcttgtataaacaaaaacattgtaaggctggtatttttattggccatatccggatagataaaggagatattgtttttgatttctacaaaaacagattatatttgtaaagctcaaatgatcaaaaagataggatatgctctatgattttttcgaaaaaataagcagaatgaagcaattatttcttctgagaagacatccaaatgtttattttgaagaccttaaattaggtgttggtaatcgttttattctagataaagacttaaaaaaattaagtattggtcccgctgcagacttcagaaactataccagtattctgatcactaaaaacgctactttagaaataggcagccattttttcatgaataatttctgctctataaactgcctggaatatatatcaattggcaacaacaccttgtttggcgaaaacgttaaactttatgatcataaccatttatacgaaacctctcctactatgaaagtatatccctccttattttctaaagcacctataaaaatagggagcaattgctggctcggaagcaatgtaactgttttaaaaggagtcactattggtgataactgtatcattggtgccggatgtaccatttataaggacgttcctcccaatactcaggtgataaacaaacaggaccttttattcagagattttaaataatgaaattttcaatactcattgctcattataacaatgcagctttattcagggattgttatgactatttaattaaacaaacgtatcccaattgggaagctattattctggatgatgcttccacagaaaaagagaaaaaagagattctggatattattcacggagacgaaaggtttaaattttttgaaaatgaaaaaaattccggggtcggaattacaaaaagtaaacttattgagcttgctgcaggagaaatatgtggttttgtagatccggacgatgctattcttccgactgccattgaaactgcgattcgggtttatgaacaaaaaaaggatgttgttcttacctattccagattgatgatttgtgataaagaccttaagcctattaaacccttcaagtccccaaaacaggtcatcaacaatgatatgttttttttcaattttcctattcagattgcacattttgtaactttcagaaaaagtatttatgagcaaactgaaaaaataaatccggagcttaaaattgctgaagatcaggatctttaccttaagatgtacgaaaaaggtaatacttactttattaacgatgtcaattatctctatagaactcatgacaaaggtatttcacaaaatgataataaaggaaaatcttacgactatttcgcacaggtcatttttaaggccatgaaacgcagaaaccttaaaaaaatcaatggaaaaaaaatcccggagcaatactctgacagcaaagaaatctttgatcttctggaatatcaaactaaatttgtgtataggctaaagaaaaaaatcttcattactttacataaaattttctgataatgtctgcaaacaataaaataaaagttctttttagacatcgttctatggaaatgggcggggtagaaaaagtaatattaagtatacttaacaatcttaatcctgacaaatttgaaattacggtttgtcttaacctcaaccagggtgaacttcgggatgagtttccaaatcacgtaaagaaggtctttcttactgatggcaaagaagagttttctcagaatccattccttcataaactacagctattgcgaaggaggataaagctatcgagagcattaaaaaatcatgcaatttctgaccgtattttaggaaatcaaaaatttgatattgaaattgctcctacatacagtgcattttcatccgtaatcaattccagcaataaagcttcaaaaaaaataggatggttccattctgagatcaatattccaggcatgaaacctttaatcccggacattcttaaaaattttccaaagtttgatcacatgatttactgctcgcagaaaatcaaagacatcatgcatcagtgttacccggatcttaaatatcccgccgagagtgtaatcatcaatgcaattcctattgaagaaattaaaaagaaagcagaagagcaaatagaagatttcccggaaggaccagtattcgtttctgttgggcgtcttcatagcagaaaaggctaccacaaactaattgaggctcatacacgacttattagtgaagggtttcaccataatattataattataggaaatggtgaagaaatgaaaaacctgactgagcagatccaacgtaacaatgtaacgaaaagctttatcctggctggaaacaagatgaatccttatccttatattaaaaaggcagattattttattcttccttccgaatctgaagcatggccattggtcattgctgaagcattaatacttcagaagcctattattgccaccaatgttggggatgttggtttcatgattaaagacagggaaacgggatacctcattaattatgagatcgatgaaatgtattcggctatgaaaaaatttcttactgatcccgaccttgttctccatatcagggagaacctaaaaactattgaaagtcagtttgataataagaaaatatttgacagtgtggaaaacatcatagagacgttacacaaaaaataaattactgtgcggaatatcctccgtcaatcacaagattggaacccgtaacccatcttgaggcatcagacagcagaaaaatacaggcattcgctacatctttaggttcacctattcccagcggatgtttttttatgatctctgatgaagcttcttcaccaatatctccaaacattttttctaaaatcggagtgtttaccatagcagggcttacactgttgacacggatattacttcttgaaagctccatagccaacgaacgggctccggaaattaccgctcctttactcgcagaatatgcagcttttcctgcttctcccaccattcctgcaactgaagagataaatacaaaactggaggtttcgtctttatatttttttaaggataaaattttagcaatttcgagtcctgcaatgacatttatagcaaatatatcctgatacagctgaggattatgcttttttagcggtaatgttttttcgataccggcacagtgtataaatcctgatatcttacccaaagccgaaactttctctgctataattgcttcaagattttcagactgagtaatatcttcagtaatcgtttccactttcgtttcaggattcagcatggagacggttttcataagttcttcatgatttctacccacaaggatcaggtctgcaccgcttttgctgcattctacagaacagcttctcccgatgccggaagaagcgcctgtaatgagaataattttattttttaatgagaaagcatccattaatcttcaaaattttctttccctataacatccattaaatctgatacggtttcgatatctttaaagtgcttggtatcaattttcttgctgaaattttcatctacaaacgcaataacagaaagtaagctgatagaatcgtagctttccagagacttaagattcgtttcagtagttaatgtttcatcttcttctaattcctcttgtagtttttctaaaaaaacggatgttttcatattgtataattttaaatgtttgtttattaaatttccataatcgtagctccccatgaatatcctactccaaatcctgccattaaaactttatctccctctttcagcattcctttatccatcatatttttaagagcaataggaatggttgcagaaactgtattcccggttttttccatatcaatataaaacttttccgccggaattttcgttttctttctcaaataattcaacataaaagaattagcctgatgaaaaacaaaatggtcaatatcatccatggtcattccgttcacctccaacgtctcttttaccagcccgggaatattatcaatcgtgaaattaaaaatttcaggaccattcatataaatattttcagggctgaattcatgctcaggattcagtttaaaatcttttttgaaagctcctttcttcacaataagattttctgcaccgcttccgtctgttcccagacagaattgataatcattaccctcagacttttcgataatggcagaagcagaggcatctccgaatatgcttcggtttcctttatcgtcagggtgaatgtgcttggtatatgtttctgaagtaaccaaaagaatactctttgcaattcctgcagagatcaatccttttgcaaaagccagcccgtacacaaatcctgaacagcccaggttaaaatctatagctccgatattttttctaagccccaatctgtcctgcaaaagacaggccgttgtaggcagaaaatattcgggactctgggtacagaacaaaataaaatctactttgctcctgtcgtagttttcgaaaattttttctgaagattgtactgccatatccagtacggtttcattatcagaagagatgtgtcgctgggaaatgcctactttctcctggatacgttctgagctccattcggggaactgtttttcaagatcgtcgttagttaacacctgctgaggcagataatattctatttttgaaattttcatcatattaataaattctctttctttgcaaaagtaacgaaaacaaatttacacttgtgatgatttttatattcagaatcttgttaaaaatagacgctctctatcattcttttttgaacagagccagtcttgaagtggcaaaatacagagggatgaaggtaggtaaaaacttcaacatgcctgacaaagtgtatttcggaacagaaccttaccttatcgaaattggtgataatgtgaatattgccggagatgtaaggtttgtaaatcacgggggaaccactactcttctcagaaaacttccgggctatgaagatgcaagaatactgggaagaataaaaatcggaaataactgtaccataggacttaattgtgtaatcatgcaggatgtacagattggcaataactgtattctgggagctaattctgtactatcacagtctatgccggacaataccgtctttattggaaatccggcacagtttctctgcaccattgaagattatggagatattgttcttaaaaacaacccggaatatccccgtgaacttgagaaagacagaaaaaagctggatgcttatatcaaagaaaatcttccttacaagtataaaaaagcaagaaaaattaaataaattaatcttgtaaaatcataaaataaacaaatttgaaaaagaaaaaactcctcattcgtataggttcattacgtcatggtggtgctgagaaagtattaatcaattttttgaaaaatcttcctccagataaatatgaagtagaccttttagtaaatctctattcgggattatacataaaagaggtcccgtcatgggtaacgctgtactatttgacaaaaggagaaatgatcacaaccaacaggccgcaggatattccagtgaaagcttacagggtgctttatcagaaaatgtttctttggtttccttctcttctttataaatttgttttaaaaaataaaaaatacgatgtagaaattgctgctatccatgcaatgcatcaggagatcctctccagccctcaaaaagattcaaaaaagattatctgggtacagaatgacatttttaatctgaaaggatacactcctgagctgatcagacagttttttaagtttgacaaaattctggtgatttccaataagctgcaggaaggcatgtttgaactggcaaaaaatgaagctgaaaaagcatctgtaattaagattttcaacccgattgacaaaaacgatacattaagaaaggcagatattgaagttgatgattatcctttcaacaatgatcttcctacttttgtaacggtaggaaccgtatatccccagaaaggctacgacagattgcttaatgttcataaaaaacttattgatgaagggctgaaacatcaacttctgattattggagacgggtatgatttcaataatattcaggatcagctcaataagcttggacttcaggaaactgcaaaaatgcttggtttcagcagtaatccatatccatacatgaaaaaggcggatttttatattatgtcttcacggcatgaggggtttcctacaattattgctgaagctcttattcttaacaaacctatttcggcaacagacatttccggaattcgggatcttctgcaggatggaaaactgggaaatattaccccgaattctgaggaaggaatatatgaaggaatgaaaaagtttcttacggataaaaatatcactgaagaatacaaaaaacgaatctcagaaaccgagcttccttttgttctggaaaaatccgtggagcaccttcagaaaataattgacgaagtataaaaacattgacaatggctgattattcgattattcaaaaagacttttaccgggaaagcggaaaatggctttcaacatttcagatctggaaaaagtgcatcaatcccaatcttcattttgtctacattttgagaaaagctcagaaatatcagaaaacccctgttctgaatgttttctggagaattgtactcagacattatcagatcaaatatggttttcagatttatccggagacccagattggcgaaggtttctatttgggacatttcggaagtcttgtcatcaatccgaaaacagtgatcggtaaaaactgcaatattgctcatggagtcactattggccagcaaaaccgcggaaaaaatgaaggatctcctgttattggggatgaagtctggataggcaccaatgctgtagtcgtaggaggtattactattggcaataatgtactcattgttccgaattcttatgttaattttgatgtaccacaggattctatagtaatgggaaaccctggaaaaatctttccaaattcaaaagcgacacaggggtatatcaacaataagatatagatccgtcaacagcaaaagattttaatttcagatctacaacttttccagacaagcagaccggcatcttctttggtatccggagcgggtcaacaatgcggaagttcattaaaatcattaaggaacaatcattctcggtattgttatgattgtttagtgaaaatttagaatattttaattcacaagtctcagattttgatttatactttgtaattttatactgttttttaaacgtttggattaaacttatagatctcaatagttttaaaataaaagtatactggaatattgaatatgattttaagcatattttaatattaaactttgttaaaagtgattgattctttaacaaaaattatatttttgtatgattattgatttgatctattgattttgaaaataatttaaacgaaatgaataattataaaccttaaaatttaaattatggcacaatcgtacgaagttattttcgaaaacaacaaaaaatgggtagagtccaaattagctgaggatcctgacttctttcatgaacttgcaaaaactcagcatccggattatctgtatatcggatgttcggatagcagagccacagcagaagaactgatgggggcaaaaccaggtgaggtatttgtttacagaaacatcgccaatgtggtcaatactttagatatgagttccacagccgttattcagtatgctgtagaacatctgaaagtaaaacacattattgtttgcggacattacaactgcggtggtgtgaaagcagcaatgactcctcaggatctgggattactgaatccatggctgagaaccatccgtgatgtgtacagactgcaccaggcagagctggattctattgaagatgaaagcaagcgttatgacagacttgtagagcttaacgttcaggagcagtgcatcaatgtgatcaaaatggcctgtgtgcaggaaagatacattttagaagagtatcctattgtgcatggctgggtatttgaccttagaacaggtaaaattattgatctggagattgattttgagaaaatcctgaaagacatccaaaagatctacaatcttacaagttctgattgggtaatgagcagaaagactaaatagtttttctaaaaagaaggtaaaatgaaattctggagtattattgtattaacgttttttctgaattttacagcgctgccaggcattgctgcggttgcgggctgggatattgcaagaacgaatgtaataatcaacgaagaagaacctcattctcacccatcctcattcattgtttacgaaaagactattccgaaacctttagatgttttcgattatctgaagttttccgaacctgatactcagggcgtgtcttttgttctgattgatgattcttttcatctatcacctttacttactatattttctccccctccggaagcttaattcctatagttagatttttttgatactatttccatatcatttttgatatcggatacacacgtactttaaaaaattattttttcaacttttataacagacttatttaaagcagataagccggttataccttacagcttcacattatgaaaaagacatcattaataggaggaatcaaggagaattttccttcaggactcgtggtatttttagtagcacttccgttgtgtttaggaattgctttagcatcaggcgccccacccttatccggtattatttccggtatcgtaggcggtctggtagtaggaacaatcagtaattcaaatatttcagtatcaggtcccgcagcaggtctgacagctattgttttaacagcaataacagatcttggcgcatttgagcttttcctttgtgcggggattattgcaggacttattcaattggttttaggctttgtaagagccggaagtatttccaactatttcccgaataatgtcattgaaggaatgctggcagctataggaatcattattattttaaaacagattccgcatgcattgggatttgacaaagattatgaagggcacgaatccatttttgataacggcctgaatttcggatattttacagaattgtttggagcgattcatcccggcgcggttgttattactttaatttctgtagcgatccttatcgcttgggataaaatccacgttctgaaaaggatgaaaatgcttccaggagcattggttgccgtcattgtaagcatccttttgaaccaattatttaagatgtccggaagctcgctggctatcgaaacccagcatttggtctctttaccggtaccacagtcttttgacgactttaagaatctgattacgactcctgaccttaacggctttaccaatcctaaagtatggattgtaggagcaacgattgcgattgtagcttctattgaaaccttgctttgtattgaagcttcagatcgtctggacagacagagaaggattacggataccaatcttgagcttaaggcgcagggaatcggaaaccttgtaagttcattcatcggcgggcttccaatgacttctgttgttgtaagaagttctgccaatgccaatgcaggagctacctctaaaatgtccaccattattcatggtgtcttcttattgatctgtgtattgtctattcctgttgttttaaatttaattccgctagcaacattggctgcggtgttaattctggtaggatataaactggcaaagccggccacattcaaacatttctggcatttgggaaaattccagtttattccgtttgtagcaacggtggtagcggtagtggcaacagatcttttaaaaggggtgggaattggtctcgcaatctccattttctatatccttcagggaaatatgaagagagcgtattatttaagcagagaaaggctggatgatgcagacgggatcaatatcaagctggctgaagaagtatcatttttaaataaggcagctatcaaaaaaacacttaaaaacataaaacctaactctacagtaatcattgatgcaagaagcacttcctatattgcaaccgatgtactggaaatgattcaggactttgccaatatccgcgccaaggaacaggacatcaatgtagaactgataggctttaaaacttcatacagagattacgaaagaagtcaggattcccatattctggttacccacaaaagggctatgtaatctccattattaattaatttttttaactttaaattcgaaaacaataaaaatatgaaagcacatacacacgaaacccaatctactattacccctgagaaagcgttagagttcttaaaagaaggaaaccagagatttgtgaacaatcttaaagcaaacagagaccttcttgaacaggtgaatgcaacccgtgagggacagtggccttttgctgtagtattaagctgtatagacagccgtacctctgcagagcttatcttcgatcagggattaggagacatcttcagtatcagaattgccggtaactttgtgaatcaggacattctgggatctatggaatttgggtgtaatgttgcagggtccaaacttattgtcgtactaggacataccaagtgtggagctttgaaaggaggtcttgacgctgcgaaaattgaaggtatgggaatggacaacctgaaccaccttatcaatcacttcaatccaatcatcaatgaaattattgaagagaatgaagagcgttcatctagcaacagctctcttcttgaaaggcttaatcagcaaaatgtaagaagtgcgattgaagatatccgcaagcaaagttcaacacttaaaaatcttgaagctgaaggtaaaattaaaatcgttggcgccaattacgatgttgaaacaggtgctgtaacctggctataagaagcaaattcatttaattccaattataatttacagaaatgccatcggaatccgatggcatttattttttattacattatatatattataaaagtaaatatttaaacagaaagtgtgttgaactgacaaaatcaccgatatatttcatttcaaacagacagaattttatttttcaaaaaataattttaaattggcgtcctttaaataacttgaaaaccagattacatgatttttccaaaagcaaaaaaaatagccagagatcttgcctggcataaaacagacaatggagtattcgggctttacaaaggttacttttttaacgtttcagacgcaagcctgatgagcagccctcaatacaaatttgtaacagcaacaaccggcaatttgaccgaagggcaaaaacaacaaattgtaacagaattagttaaaaacaaaaagaaattaaaatttacaggtctcgaaatcagagataccactatcttttttcaatttgtggaaaatttaattcctactaagcttaagactgtttattctttacttgactttttatctgatcttttcaaaaagctaaacataccagagcaaaataaatgtcacagctgcggtacagatcaaaagatcagctattacaacttaggtgataatggtgtaatattttgtgacagttgcttccatcagacaaataataaattctatgaaattgaaaaagaaagaatttcaaaagaaaaaggttatctgacaggttttttaggaacacttattttttctatcccaggcattatactatgggttttgcttgccatatatgtaggaaaacttgcctctggaatggcctttatacttgctttttttgcttttatggggtacaaccttttaaaaggacgcgaaggtacattgaaaaaatatatcatttttctgacaaatattgtaagcatcattatcgcaaatgttattactgtacttgctttgttgctaaaacaaggctccactataaaacaggcaatatcagaattacagacaagtgaatccgtaaaagaagtattttatgcaaatatggtattttcttttgtactggcattaggtgcctggatctggatactatttattatgaaagatgataagttatcaataaaacctgctgaaaaattttaaagagcataaataaatgactgcctcacaataaggcagtcattcatttataaactattttgtaattgcagttttttcctttctgaaattattttccgttaaaggcagacatcgtattattcaatccggcaaaaacgaaagaaagagcggctttggaaaaggtttcaattctttcggtaagcttttcagcttcttcttcattccaggttcctaatacataatctacctgtcgaccggcagcaaagtctgcagagatcccgaagcgaagcctggcgtagttttgagtctgcaatacttcattgatatttttaagtccgttatgacccgcatcagatccttttcctttcaatcttaaagttccgaaaggaagggcaaggtcatcggtaacaatgagcacattctccaaaggaatgttttctttctgcatccagtactttacagcatttcccgaaagattcatataagtatcaggtttaaggataaaaacttttcttcctttatgttttccttctgccagccatccgaaattcgatgtattgaatgatacttcaagggtttctgctattttatctgctactttaaagcctatattatgtcgtgtattttcatattctgagcctttgttcccaagccctacgattaaatatttcatcagaaattttttgcaaaattaagggataaaaaataaaaaactcaatcttcgtaagattgagtttgaatattgttaaaaaaattctttattgtggtttgtagatgtaattaacgccatatccttttgtcatataagtctgaggatcataaacgtaatttgtactcttaacaatcggagtaggaattggtggcgtaagatctgtcaccgaccatctcttagggttgttcggggaaaggataagactttctttatcattgataatagtagataataatcttgaaattttatacacatgcggcaataatgtgaatgggctcacctgctcatcataagcataatattcgtagctgtattttcctgtaacagctccaaatgcacctcctgacattgttccgtagtatcttacaacttttgatacattatctcctacatagctataccctgttttggaataatctgtgaaagtaagaggagctcccggaacgtccggtccgtttctcataatgatagaatccagttttcctgtagaagcgctgtatttgatatcataagcagttttctcttttctcagcaaagtctgtggccccggagtcgttgcaggtggaacaggcggaggtcttctgaagattgaacggctttcagaaataagctgcaatctgttgttatttgcgtaagtgaataattgagtgtaagacacactgtctttatccagcttcccgtttccgtcaagatcaagaaaaccattgaaattgatctggctgattttatcaccactgtacataatatccgtaacggaagcactgtctgtgattacttttgtcacaagaagtccgctgtaacgatattctgcgatagtatctttatctgtaatttctctgtataatgctctggggccgcttaatcctcctgtatcgttaagatccaacaatggatttccatcctcatccaacatgtccttgcaggaatgaattgaggaaaaccctgcgatcagtaaaataaaatagaaaatttgtttcatttccttgtaattgattatttttttgacaaatataatttttttttgcctaaaaattgtattattatttatattatggtaagattaataactatatttctcctataaatttttataggtaaaagttaaattctggtttttttcaacggttacatacccctgattatcataagaataactttgggctgtatttacaggtgcagccggtgatggcagttctatgaacattgaagtagggttgttcggagatattttatagaactgggccggattgatcaaacttcgtgtgataaaatacactgacggaagtgttgaatacgggcttttctgagcatcatagttctggaagctgtacttactaatcacagctgtgctcatatccgggtttccattgatattcagtatacctttggaacaaaccacctgtataacattatcaccattgtatacaaaactatagtcaataaatctgttataggcactgattcctccttcttttctcttctcaagaattttggtaagcttattagtagttgcgctataagtaaatgcatagtcacttacaacagatacagacggggtggctcctgttgctgtagaagtagcattgtaaatctttttaccggtagcatcaggaacaatgttgaattcatacacaaggctggatgacgcagaacttacatatttaattttagtaatattcttatccgtataggttactgttccggtaaaataagcacttcccgaagcaaattcatctttagacacggcagtctgcaagtctccggttaccgctgtagtagtgtattcttcctgagtgacattattggagctgacttttgccaaaatctttttaggcggtggaccatcatcaggattcgggatggattctgtaggatccgaggtagtattacatgctgtcagcatcccaagaaaagcaataccggcaaacattttaaaaaaatagttttttaccatatagaatttttttagcttgtccaaatataattcaattttcgataatacactttactttatctgaacaaattcacaataaacagagttaataaacaaaaaaaatctaaaaacataacgtttttagatttccaaatattgtatcattatgaaaattaataaggctgcaatattgatgtcgtcaaaacagactgtgacatatcactgttgaggaaagtagcgtcaacagctcttcctatcccaagcactgttcctgcaatagctctttttatacaggctactttaacagaatactgattttgaggggtaagattggtaagggtagcattaagattaaaaatcttataagccccactgtctcccaggagcacatctgttctcaccgctctaagtgcatcatttacaaaaacaccacaggcaaagcttgcagaatttgtacctgttttctgaacagttgtctgaaatgaaaaagtagctttgtttgtaccgttggtaacagaaaatgtatctaccgtcccagggattacagtccagcctccagtcagaggatctccattactataagggttagtagagccactggcaccagaaaagcttattccggttttatccgaaacagtattgatggaaaacaaagacatacttccctgcccatcagcaattttaatagctttccagtcattagtacttaaatctgcattattgtgaaatatatcaccggctgtaccggcagaacctttcagtaaatcagtacctcctgttcttaattctttcccaacattaagatctccgttcacatccagcatattagtcggattaggagtattgatacccacctgggcatttgttgcagctgctaacaaaagagatgtaacaaataatatttttttcataacccttcttaatttataatattgttaaatacctccggaacttcatatacatctattttaagagaagactgggcaataaacttattgatattactatatacattggtgcctatgctcagcgtatttcctgaacctccataagaacctaatcttgtacatgcaacacttaccgtatggtttcctttggaaagattatctacaatcccgatctgggtatgggtaaggaaaggatatgaggtagtaatggcctttaggtttcgctgcctcaggttgaccagtttgtcatccacaaaaattccacaagcataatctattgaattatctgtacttcctgctcccccaaaatctgcctgtacaacagtttcaaactgaaaatatgccttactttgggtactgaatacactgattacttgtgaaagcccatttatttttttgaagttagtaagagtactatattgttttccctgtgtaaatgttcctcctctggaagccagacttactgaagagtcttccgaagaggtaaaggtaatccctacatcatccgagaaagaattgttataaatcaggtaaaatttattgggttcatattcaggaattcggagtgatttccacaccggcggaaaaccttccccctgagaaaccagcaactggtcattatttccatggaaaacggagttatcagtagaattaaaaaccccgattttatttctgaaattcacatctccgtttacatcaagtttggcttttggagactctgtttttattcctacctgagctgatattaaaagacccatggtaagaaacagcgtggataatagttttttcatcattagttgtttttatagctcacgtattcgataacatccattttcattgtagattccagcgtaaacgcactggaagcaccatttgaagactgcacattacgtcctatcgcaaattgtgaagatgaacttgaagtatcaatctttctgcatgcaatgtcaatattatgaacgcctacaggaacgttctgctcagtataattaagcgtaaagatataatcctgaagccctgcttttccgctgttattattggaagctattctatccggacgtacagccacaagtgctccgtttctgaaaacaccacaggcaaatcttacactctgtactgtagtagatgtggaagccttcatttcaataccagtctggaactgatacgtaagcctgttcttaccgtttttgatggtaaaagtattgctaagcccgttaattttcttccagtttcctttggtaatatccgtgatatcgtccccaactttgttggtgtagatcccatcacctgcaactccatcggtaagtgatataatacccgtttgatccgacgacagataagaatcaatcagcttatactgcccctcttccataaaggaaacattcaaagatttccacacaggaggtaagccctcaccctgagaaaccaaaacctggccgttcaatccagcatctccagcctgggttgaagtcccgcctactctaagttcttttcttaaggtggtttttccgttcacatcaagaacagacttcggtttagcagtaccgattcccacctgtgcgttggcatagaatgatagaagtccagccacgcagcaatatataatttttttcataataaggactgcaaaggtacacaatgaagtccaaaaaattccagttatatatcggtaaacctatagaaataaacacattacagaatagaattaatcacacataaaagtagaattatttctacataactccactttttatatttaaaaaatactacataaggtctcaaacccttactgtacggggatttacaaaacttctttactcattaaagagtgattttatagcctcaaaacaggccttaattctcttcatcaggaatattgcaagagaaaaacatgataacaatcacaaaaaaacgtataaaaatttaaagcttttatacgtttttcacaatttttataaagttgttcccaaagaacaaatcgtaaaatttaattatgctcaatgatggctttcaacagtagatttacctcatctacatttttaaccttttccttcctcatcatcagctgattgccttcttttcctgacttttctttcagctgagcttcagcagggtttctggtcagataattaataatatgcctgaatctgtctgtctgataaaacttgtcgtgaggatttcccggaaagtatcctaaaaagacaccgtttttcataacaattttttcaaaaccgatctctgccgcaagccatttcagggaaacactcttcaacagatttatcgcttctttaggcaatggcccgaaacggtcaatcagctccagctcaaactgatgaagatccgcctcattattgatctcggcaattttctgatataataacagcctttcttccgtattagatatatatgaatccggcagcatcaactctaaatccgtatcgatattgacatccttcacagatttgaaaagcttctgcctgtcttcttcattttcaaacaggttttcaaaatcagcatcatcttttaactcttccaatgcttcctgcattaatttctgatacgtttcaaatcccatttcattgataaaaccactctgctcagcccccagaagatcaccggcaccacggatttcaaggtctttcattgcaatctggaaaccacttccaagatcagaaaactgctctatcgcttccagacgtttcctcgcatcggaagtcatcatatcataaggaggagtaatcaggtagcagaaagcctttctgttgcttcgccctacccttcctctcatctggtgcaggtctgccataccgaatctctgcgcatcattgatgaaaatggtattggcattgggtacatctactccactttctacaatggtggtagatacaaggacgtcatatttaccttccataaaatccaggacatttttttcaagctgtttcccttccatctgtccgtgtcctgtaatcactcttgcatccggaaccaacctctggataagaccagcaatatctttaaggttttcaatcctgttattaataaaatacacctgtccatctctctgtagttcataagaaacagcatcacgaagggtttcttcattaaatccgatcagttgcgtctctacaggctgcctgtttggtggcggcgttttgatcacggataaatctcttgccgccattaatgaaaactgtaaggtcctcggaataggagttgccgtaagcgtaagagtatcaacattattctttaaagttttcagtttatcttttactgataccccgaatttgtgctcttcatcaataatcagcaacccaagatctttaaatttaacagaactgcttaccaattgatgggtgccaataataatgtctaccttcccattcttcagtgcttccaaagtctctgatttctgcttcgccgttctgaatctgttgacataagcaacatttaccggaaaatcttttagcctttctttaaagcttctgtaatgctggaaagccagaatagttgtaggcaccaacaccgctacctgcttgccatccgtagccgctttaaatgctgcccgtattgctacttccgtttttccgaaaccaacatccccacaaacaagcctgtccatcacggtatcagcctccatatctctttttacatcgatagtcgctttttcctgatccggcgtatcttcgtaaataaagctcgcttccagctcgttctgcagataagaatccggtgtatacgcaaaacctttggccgtttttctctgagcatataatttaataaggtcaaaagcaatctgcttaaccttcgctttcgttttctgctttaaggatttccaggttggagaaccaagcttgctcagtacaacctctcttccatctggtccgttgtacttcgaaattttatgtaaagagtgaatacttacatataataagtctccgtttttataggtcagtttaaaacattcctggattttcccgtcattgtttacttttaccaaacccataaattttccgatcccatgatcaatatgggcgatataatctccgattttcagagacatcagatccttcagagtaagctgttcagatttggcaaaagtatttttagctttgtacctctggtaacggtcaaagatctggtgatccgtataaaccatcactttatgtccgttatctacaaatccttcatgaagttcagatttaaaacttttaaaaggaagctcatgctcaagctcttcaaaaatagattccagcctttctttctgtttttctgttgaaaaggaaatccaggtatcgaatccattgctctgcttttcctcaatatcttcaatcaataactcaaagtttttatgaaaagatggttgtggaagctgatccatttttacttcagtaacttctttcaacccttcaatcaccactcctccaaaatcaactgttttgaattttttataatcgaataagaactcctggtcagaaataaaaagttcctgcggagttctgtgagcgatatctttactcagggtatcatacttttccagggacttttcatagaatgttctgattttctgcattcctaccatgccgtttttagaaacaacaaagctttcatgaggcaataattgcaacaaagacacccttgttcctgccactgaaaagttcatattggaaaccaattggaaatcctttactttatctacagaaagctgtgtttcaatatcaaaagttttgatgctttccacttcgttaccgaagaacgtaatcctatacggcttttcatgcgaataggaaaagacatccacaataccgccccttacagaaaattctcctggttcagaaacaaaatcagcctgctggaaatgataatgattaagcagttcatccacaaaatcaaaatccagctggtcacccactttaatatgatgggatattgctttaaaatcttcctttttcaaaaccttttcagataaggctccagcataagcaacaatcactttcggagatctcccggaattgattttatttaaaacctcagttcttaaaaccagattggcattctgtgttttttctacctggtaaggttcaaggtgggttgccggaaagtataacactttatccttacccaaaagatcctccatctccgtattggcatacaaagcatcctccttatcatctaccagataaacaatatttttcttctggaccaaaaagagttcagccacaaaaatagaaaccgaagatccggcacttccttttacggcaatatgctgattattttctagcttggtaaaaatttcttttccaaattctttctgtaaaaggtctggaaggaacttttcattgatggattttaactgcataaatagtaatggtataaacgacaaaagcgatttcgggagttttccgaaaccgtttatgatatacaaagatacggatattttttgtgttgctttgaaaaacagaaagactgatagtttaaaatgaatcacttacattcattactcttaattttttacaattttatttaataacctgttaaaaaaattcaagtattttctccgtggcacagtgtttggcttttaagtcaaaaccaaacattaagaatagtattatgaaaaaagcaattaaaatcttaggagttatgatgctgttggtatttacagcattgtctttctcgtcgtgcagcaaagatgacgaccctgttaacaatgaattttttgcaggaacctacaagggaagtgtctcttataatgacggaggctctaccaacatcagtacggacaacggaagtgtatttgtaacaaagatagcaagtggtaccaaatacaactttgctttctcaaacagcattccggacattaatggtgtagagtttaatcaggaaggagatcatacacttgtgatgattggttctactgcgacctcttacatcagaattgacaacaatactttaaaaatattatttgcaaaagacggcaaaacgtggacagccaactgtacacgctagatttgtctatttatatattatgcaagcctgtcttcatcttttgaaggcaggctttttaattgtaaatgaagtgttttaatctttttttaagctgtaataaactttagttaagtttgaaaatcctaattttctagcctgctttttgtatatctttattcaacaaaaacaaacaataattcttatgaaaaaattattatctgcaatgtcattgatccttggattaggacttgcaactgcccagcagactgctcccgctaaaagcacaacaacacatccacctgtaaaagcaactgctgtaaaggctgctgctaaaccggcagaagtaaaagctgccaaacctgcaatggatgcaaaagcagcaaaacctgcacaaccggctgccaaaatgaaaaaagacggtactccggacaagagatataaacaaaataaacacttgaaaaaagacggtactcctgataaaagatataaggagaacaaataagcataacatcaacatatagttgttattttcataatcaaatttcgaaaagccggtggaacctgttccatcggtttttttatgtgatgctttgtaaaaaatgattccagattctctacttatttataaatttgacccatgttaaacttcttcaagaaaaatgcagcactgatctgggcaaagaaacatgtccgaaaagcagaggatttcaaaaaaaatgctgaaagagaccaggagaacctgttactatctcttgtacatacagctcaaaaaacactttttgggcgtgagcatgattttgaaaacatccatagtgtaaaagagtttcaggatagagttccggtagccgattatgaagatctgaaaccttatattgaaagagtaaagaaaggacaggcaaatattctctggacagaaactcctgaatactttgccaaaacttcggggacaacttcaggttctaaatacattcctatttccaaagaaggaatgccatttcagattgccggagcacaaagtgctcttttccattacatcagcaaaaaaaataatgcagattttgtaaacggaaaaatgatttttcttcagggcagccctgaactggaggaagtattcggaataaaaacaggaagattatccggcattgtagcgcatcacatccccaattaccttcaaaaaaaccgtctgccaagctgggaaaccaatattatggaagactgggaagccaaggtagacaaaatcatagaggaaacggaacatgaaaatatgacgctgatctccggaattccgccatggctgatcatgtattttgagaagctgacggaaaaacatggtaaaaagatcaaacagcttttcccgaatcttcaactcattgttaccggaggagtcaattacgagccttatcgtgacaaaatggaagaacttttgggaggcaaagcagatatcattcagacctttccggcgtctgaaggcttctttgcttttcaggatgattatagcagagaaggactgctgctccttactaaccatggaattttctatgaatttatccccctggaggaatatggcaagcccgaagcaagaagattaacgttaaaagaaattgagctgcataaagattatgcattgatccttacgaccaattccggattatgggcttactccataggagatgttgtaaggtttatcagcaaagacccatacagaattctggtaagtggaagaaccaaacattttacttctgcttttggggaacacgtaattgcttttgaagtggaagaagcaatgaaagcaacccttgaaaaatatccggcacagattacagagtttcatcttgcacctcaggtaaatccaactgaaggacttccttatcatgaatggctgatagagtttgaaaaggaacctgagcatttggatgtattcagaaatgagcttgatcagcagctaagggcaagaaacacttactatgacgatctgatttcgggaaatattttacagaaactacagatcaccaggcttaaaaagaatgcttttcatgagtatgccaaatcccacggaaaattgggaggccaaaacaagactccaagattggctaatgacaggaagattgcagatctcttagaaatttacaaactttgatcatattttttcaattccagaaacgtatattcgaaaaaaattataaatttgaaaaactaaaagaaaataatgaaagcatctgtactgttgaaatcatccttactaacgtctttatttgttattacatcttgtgctacgacaaaatacagcgaagatatttcaaaaaacaattactctaatcttgaagccggaaaaatttacaaagtcaccatgagagatggttctccgaaacagaccattttattcagaaacgtcgttggtgaaaatcttgtaggcacagcgggtaaaaaagacagtacagaggtaattattcctaaagcaaatgtagcagctgtaaaagacagaagaaaggccagaattgctgcgggcgctactcttattggcgctgcaggtgttgctgcaattgtattgagttccacaagagccgactaaaatagattttatcttttgggatatatttactatatcttttaaaaatcaacatatgaatagtcctaaataaatttttagggctatttttgttcatgatttcctttaccccgttacaaacattacaaaatgttgagttcagaaatcttctcaccgggagattttttattgttttagccttcagaatgcttgccactttattgggatggtgggtatatcagttaacaaaagatcctttttcaatcggccttatcggtctttcagaagtaattcctgccgtaagctgtgcgctgtatgcaggacatgttattgatatgaatgagaaaaagaggctactcctcatttgtaattatgcgtatatttttcttatcggacttctgctgattcctgcgttttttaatgtagaaatgcattttaccggccatcagattacttattttatttatggagttatcttttttacagggattgcaagagcttttatcgggcctattgttccttccatgattcctaaaattgtaaagaaggaaaatcttcccaatgctgtaactctgaaccaggctatattccttatatcttctgtttgcgggcacgctattggaggtgtccttattggatttatcggagtaaaatggactcttgttgctattttatcattaatctttattgcttcattatttttctggcagcttcataaacagcattcagaatacaaaaaagaaacggtaaatgttgtggaaagtatgcgtgaaggaatttcttatatctttaaaaccaaagaaatcctgggagcgttatgccttgatatgtttgctgtactttttggtggtgcagtggctatgatccctgtatttgctacggatattttaaagtcaggagcggaaggcttcggattgctgaatgcagcctctgatattggttctatgtgtatcattactattttatctattgttccgcttcgaaaaaatcaaggaaaaatcctacttgctgttgttacgggattcgggctttgtatcattggatttggcctgtccaaaatatactggctgtcttttatgtttttggtaatgagcggaatgctggatgggatatcagtcgttatccgtggaaccattgtgcagcttaaaactcccgatcatataagaggccgtgttctgagtgtgaattcgattttcattatgtccagcaatgaaatgggacagtttgaaagcgggcttatggctaaactactgggggttgtacgctctgttgtattcggaggatgtatgactgtcctggttgcattggtggtaggaagcactaatcctaaactgagaaaaatgcaatattaatttattgtttatcaattgttttaaattcccgatatatcaaaaaccggaattcgaaatacttaaaatcagaatagaacgttttctattctgatttttattttatagctgttttttttaaattaataaaagaattaaatctcaaaaattcataaaaaccgctcatatctttacgatgtctacataatttaatctcaagaataaaataccacatttaaaaccaatacattactttcattaaatatatctcaaaatctttaatttaacgttaataattttttatatttgcctcataaactatccccctatgactaaacttttactaattatgagctttctcattgtaaattattgggcagaagcccaaactttctctgacaaagcgttaacacaagccgtcttgcagctcaacgcttccaaaacagccaatgattacgacaatcttttcaataaattttccggagcaaaaacgtcagaaacatggccgtctaattattacgcagccgttgctttataccttaagaacgaaacactgttaaagaaatcatccggagcaagtcttatggatgacaatgctttagcaagaaaaatagcaacaggagtatggactgcacaaagagacaatgctgagatcaacatattactaggcttactgtatgttcagaaaatgcagatagacaattctcaaagccaaccggaccagaatattatctctcaaagtatagcaaaagctgaagccaacgctgtcaataatccaagactaaccgttcttcaggcaaaaatcaaagaaaaatcaggtgataaatctaatgccgacattttataccgtaaagctttaaacgaattttccaacccaagctcttcagacagtaaatctccaacatggggaaagcagctaatacctttccaataatctgaagaccaaattaaaatgatcaacatgaaaaaatatctactcgtttttctattttttatagctcaggtggcttttgcgcagcaggactgtgctactgccataccgatatgcagcgatgctgctatttctcttactcctaatggttggggaaatgtaaaagaaggtcaggtgggctgtcttggtcctaacggagagagtaattccatatggcttactttcagcatagaaacagccggaacacttacttttttagtaactcctacgggtcctaatgctgtgggtattgactatgattttgccttgtacggtcccaatcataactgtgccaatacaacagctactccattgagatgttcttacgccagcgtcaatgcaaccattatcaaccctaccggtcttaatatgacctcagttgatacaactgaaaatggtggtggtgatggttttgtaaaatatatcgatgtccttccggggcaggtttaccatcttcttttaaataattattccacacaaattgctccatttaccttaacttttgggggaacagctaagcttcttacaccgtttgaccataattcagcgcacgtttatcaacctaatccgtttttacagcctggtcctacccaaaatggagagattccggtatgtggaaaaattgtgaactttgatttttcaacactttcctcacaaatcttaaatgctaaccctaattttatagtaaaatattatgcttctgcaacagatgcattagacgatacaaacgcaattactacacctacgaacattaatgtagcgaccacttatacttatgcaatcagctatgttgatccaaacagcccaaccagcttcttaaaccagtgtagagaatatgaacagataaaattccttgataaatcttttacgctgaaccccgcaacactgacttcttgcagcaacaacaattcagggacggcaatgtatgatctatctaccgcaactgtaggagctgctcccaatcatatattaaagtattatccttctatgtatgatcttaataacggaaccaatgagatcaccaatccttacatgtttgtttcggcagaaggttctgttttcgtaaaagcaatcaacgaatttggatgtactgcatctgcagaaatcactcttaaattctatcctttggttacagcaacagatgcttcattaagatcctgttttatagaatccaacccggctactgctttattcaatcttgcaaatgcaccagtgacaagccctacgggaactacaaccaagagatatttcccatcactgacagatgcaatagatgcaacaaacgaaattttaggatttaataattatatagcaccgaatggatttgtatacgttagagtatcagacacaagaggatgttataccgttgcaaaaatcactttaacagtaatccctcctgtgacatcaagtgttctgaaagacaagatcatctgtatggaggacactacaactcttgatgcaggaccaggattcaacggttacgagtggagcacaggagcaactacccagtcaatcaaaaatgtaggggtaggagtctactgggtaaaactgaaaacaggagattgtatcgcaacacagaaagttactgtatatccttctgaacaacctgtagtaaacggtgttgatgtttccaatacaactcttacaataaacgttataggaggaacaccggattatcagtactcaatggataaaatcacatggcagaactcaaatattttcacaaatattgccagaggcacttataaagtatatgtaaaagatgcttatgactgtgatcctattgaagtgactgtagtggttccaaaccttatcaatatgattactccaaatggcgacggtgtgaatgatgttgtagattattctgctatggcagacaaacaaaatcttattttgagtatctttgacagatacggaacaaaaatccaccagggagacaaatcaaacggttacaaatgggacggaactattgcagggaagaaaattccaacaggtacatactggtattctgtaacttggaatgagaatgataaaaagaacactcctttcaagttttcaggttggattgtggtaaaaaacagagaataatctttacataaaaaagccgctttggcggctttttcttttacaaataatgataaaaaatttattgattttctaacttgtttaacaaaaatagttttaacaatgaaaaaaatattacttctttttattttattgataacccaaatggcctactcacagtcagactgtgtcacagcaatccctatctgtggtaactctgacatttcttataccccgtcaggcccggggagcatcatagaaattcttaatcaaaacggaggttgcctcagcaccaatgaaagatatactgtttggtataccttcactgtatctacaccaggtacacttgcgtttacaataaaacctaacgaccaggacgatgattacgatttcgcagtctatggcccaactacaaacggctgcgcttctttacaggacgcaaatcatgtttttatacagccaataagatgtaactatagcggtactccgggagacacaggactggatcttgctcttgctccaccagctgtattcccaaccaatcctcctggtaccacagcgagtatgaataatggaaaatggagtccttatatgaatgtactggtaggtcagacttactatctggttattgacaacttcagtagatccgttaatggtttttctttagaatggacaggtactgccagcttaagttctgcatttaacgatcctgtactttcacctcacccatttatcactccgggaattccgggaactaatcctaatgatccaagccaggtgatggtttgctcattaccaactcagtttgattttacaacactgacagcatctattattaatggtaacagctctaacttctccgttacttatcacaaaactaccaacgacgcccttacaggcgccaaccctcttacagtaactactgtagacggaacaacaacatactattaccgaattgtataccatgatccaagcaatccgaataacccaatcaacggatgtttcattaccgggaagttcaagtttgtcaatgtcggtattacagctaattcagccactttatattcctgtaacaacaatggagccggtaccgcaaaatacaatttaacaacagccaatatattcggaggctccggagcaacaattaagtattatacttcggttgccgatatgaatgccgacatcaatgaaattactgatcctaccaactacgtttctgctgaaactactatatatgcaaaaattgtttctaacttcggatgtattgcaactactacgatcagattgctattctatccaacagtcgtattaaaagatgctgtacttcagaactgctatattgaaaatgatgttacccgttcaacatttgatctttccaaagctgatatcggggtagccgttccaactcctacaggaactattattaaatattatacctcgatagccgatgccaaagctcaggcgaatcctattgtaggagcattaaattatctttcagaaagcaaaacgatatatgcaagagtagacaatgacaaacaatgttattcaattgccaagatagaactggtggtattgcctccggtaaaatcagccgtactaaaagacaaaacaatttgtgcagaagccaaaaccactctggatgctggacctggatttgtaagctacgaatggagcacaggtgaaactacacaatctatcagcaacgtgggagttggcgcttattgggtaaaacttcagaccggaaaatgtttcacacttcaggaagtacgtgtgcacccaagccttcagccggtgatttcaggaatagaaattaccaacaacaacatcactgtaacagctacgggaggcgttcctccttacaagtattctgtagatggcgttacatggcaggattccaatatatttacaggacttccgagaggtgaaaatacaatatgtgtaaaggatacttacaactgtactcctattcaggtgactgtaacggttcctaaccttattaacgctatcactccgaacggagataatgtaaatgatgttattgactattctgcattagcatacaagaagaacctcatcttcatcgtgtatgacagatatggaaacaagcttcacgaagccaataaaatgagaaactttacctgggacggaaccgccttcggtaagaaaattccaaccggaacttactggtacacgatctcatggaatgaaaatgataaaaacaataccgaaaccaaatattcaggatgggtattggtaaaaaacagagaataagctccgctaaaactattttataaaatcacctcggtttgaggtgattttttttatcaacagattcaacctcctgtttacagtattttccgaaagactgctaataatttgttgaatactattttttaattattttttaaataaactatctttgcatcatggcgcagaaagaaacattatcatccctgacacacggaaactttgcaaaagaattgtctattgcggatggaaaaatgcctcccaatgcagtggactttgaaagacttgttatcggaacttttttgattgacaaaaaaggtcttgatcattccattgacctccttaccccggaagtattttatgacccgagacatcaggtcatcttttctactatcctgaaactttatgaaggcaaccatccggtagacttaatgacgattattcaggatttaaaaaaagaagacaaactgagtcaggcaggtggagatcactacatcattgatcttaccatgggagtaagctcatctgctcatattgaataccatgtacgcgttattcttgaaaaatatattttaagaagccttatcaacgtttctgccaatgttattgactcttcctacaaagagtcaacagatgtttttgaacttctggacaaagcagagcagtctttcttcgaaatcaccaacggaacaattaaaaagggattcgacactgccaattcattggtgaagcaggctatcgataccattaaatctttaaaagataagcagggactttcaggagttccatcaggattcagagatgtggataaggaaaccggtggatggcagaactctgacctcatcattattgcagcccgtccggcgatgggtaaaaccgcattccttctttccatggcaagaaatattgcagtgggtcacaaaattcctatggcactgttctctctcgagatggcgtccgtacagcttatcaccagaatgattgcttcggaaacaagaatttcttcagagaaattaagaaaaggaacactggatgatgaagaatggcaaagactgttctccaatgtatctgaactggagaatgctcctttatatattgacgaaaccccttccctttccatattcgacttccgtgcaaaatgccgaagactggtaatgcagcatggcgtaagacttatcatggtcgactaccttcagctgatgactgccggcggtggcggtaaaggagtcggaaaccgtgagcaggaaatctccatgatttcacgttcattaaaggcgattgcgaaagaacttaatgtacccgtaattgctctttcccagctttcaagaagtgtggaagcccgtcccggaaaaagacctcagctctcagacctgagggaatccggagcgattgagcaggatgcggatattgtatctttcatcttcagaccggaatattataaaatttctgtttgggataatgatgaagagggacaggaaacttctactgaaaaccaggctgaacttattattgcaaaacacagaaatggtgctacagcagatgtcagattatcattcttaaaacattttgcaaaattcggtgacatagaagcagcgtttgatggcggagccggaggaggatatccttccaatttcggggagcaaagcggatttgacaggatcaaaacaacaattcagccaggagccgcatttgaccttccggacagctcaaaactttcgggatcatcaatgaatgatttcgacgatgatgatgattttccgttttaaggaagattgaaattcaaaccaggtcagtttaatgtactgtcaataaatcattttaaaaagcagatttgagaatcgaaatttataccgatggcgcttgcagcggaaatccggggaaaggcggatacggaatcctcatgcgtgttccggaaaaaaattaccagaaaactttttccaggggtttcaggaaaactaccaataacagaatggaacttctggctgtcatcacagcattggaaaaactgaagtcaacagaaaatgagatccatatttatacagacagcaaatacgtatctgatgcgatcaatcaaaactggattgcaggttggattaaaagaggatggaaaaatgtaaaaaacccggatctctggaaaaaattcgttgagctttacaataaacacaatcctaaaatgcattggataaaaggtcacgccgggcactttgagaacgaactttgtgataaattagcggttgcggctgccaattcttcagacctagaaattgatacttattttgagaatctggacaataattccttattctagtttaattagtacaaatacgtaatcaccactagaatattcaccattatatcataataagcgataaatttttaaaaaattattaaaattttagcaaaattaacattaaatacatattaattgattgggatttaatatctttacatattaaataagtcccattataaatgaataaaaatctattattgtatttatctgtttttttactctgtatagccgggaagtcctttgcccagacttatcagcttgtcggaaaccctgtaacaacgaccggttggacaatggtttctcccaccgtggtaaacacagattttattcagcttactccggataccaacaaccaatccggctccatcaggctgaatgaccctatcaatctaaaatattgcgacaaatggagagtggaatttgacttcagaatggactccaaccaaacctccaacggagatggaatcgccttctggtatcttgccaatccgcctgttgccagcgtattaggttccggtcttggtgtttctcagaatgcagttggccttatcgtagggctggacacttataacaataccactacagctacaatgagtaaggtacatgtagcttacgggcaggttcaaaatacaacagataccaataacgttgaattcttcaatgttcctggaagctcctttcactcaccggatttaaatacgacacagccttttcagggaactacctttaagcacgttgaagtaacggcacaggtagatcctgctgctccaaccagctggattataaaaataacaatagatggtaatgtaatatgtaatcagtcttttgccccttccggaacggctgctgcaatgacagtaggatattttggattttcagcatctacaggaggtgcaagatcaagacattccattaaaaatgtaaaaatttatacggataaagttcctattttacagaattcagcaacccagtcgttctgcccaaatcccactacaggatatggctccgtaaacctaacttctttcaattcgcagtttgtcagcaatccttccaattatacattcacttactatccttttggaagctcaacgcctatcgcaaacccagccaattatcagtttaataccaacaccactgttaccgttgttgttaaagataacgcaggactgctctgtgataacccggatgggaaaatattactggttcttgcccctttcaaagctgaagacaaaaccattacggtatgtaataacaacaaagccggaaccgctacattcaacctgaataccgcgaatgtcacggatgttcccggcgtcattaaaaaatattataaaacgctggccgacctcaatgctgatagtaatgagattcaaaatccaaccaattatatatctgcaccaggagttgtttatgtaaaagtaacgacgcctcagggatgtacaggcacagcaaaaatcacactggcattttaccctgacactcctgtgaaagaggctacccttagatcatgtttcattgaaaataatattaccagtgctatttttaatctgactactgcagatgttaccactctgggaataggagctgcaaaaaaatattatacttcaatagcaaatgctttagacgggaccaatgagatcatgaatcctcttcagtatttatcaacaagcacagccgtgtatgcaaaagtaacagatgccaacggatgctttaatattgctaaaatcaaccttatcgtattacctcctgtaacgtcctctgttctgaaagacaaaatcatttgtattggcgaaaaaacagatctggatgcaggtcccggattcgatggttatgaatggagcaccggagaaacaacctcatctattaaggatgtaggcgtggggccttattgggtaaagcttaaaaccggcaactgtattactacacagattgtcaatgtaaaagcatctgcaaaccctgtgatttccagcatcaatattgacaacaacacaatcactgtaaatgtagcgggcggaacccctccttatcagttttctgtggatggagttaactggcagaccagcaatatattcacaggtctcgcaagaggagaggtaagagtttatgtaaaagatgtttatgactgtacacctgttgaagttcagattacagtacctaaccttatcaatgccatcacgccaaacggagataatgtaaatgactttattgactactcagcacttgcctataagaaaaacctgctgttcattgtttatgacagatatggcaacaaactttatgaggctggaaaaatgagaaacttcacatgggacggaactgcttccggtaaaaaagtcctcacaggaacttactggtacaccatctcatggaatgaaaacaacaaagacaatactgaaaccaaatactcaggctgggtattggtaaaaaacagagaataaaatttactatttgaaactacctcctttggggtagtttcggtattaaaggagactttatcctatccgaaattgaaaccatacattacgttcgtaattaatataaacataaaagaaacaatttataaccaagaacaaataacatcataatccatccactatgaaaaaagatatactcattttatttttggctatcttactctgtcttccgggaagattattttcacaaacctatcaattaacaggaaaccctgtaaatacaacgggctgggatctggtctctgacgctgtggtaagcggagactttgtaagacttacaagtgatcagaccagcagatacggcgctataaaactatccactccaatcaccctgagctactgtgataaatggaaagtggaattcgatttcagaattgatggaaacggaaccgcacagtttggaagaggagacggctttactttctggtaccttgcaaatccgccaacaggattcgtctcaggaggaggattgggtattccggccaatgcctcaggactgatggttggttttgatatcttcaacaatacaactgaagggcagatgagtaaagttcatattctttacggcaccaacaatacagcaggtaacaacattgaatacaacacgactccgggaagtacttttcactcaccagatcttattgctaccaatccatttgtaggagatacttacagacatgttgaagtaaacggagaaacagaccttaccaatcctaccaactggattatcaaagtaagaataaatggtgttcttattgtagatcagtcttttgctccttccggaggtgctgtgggaatgtcacagggatatttcggcttctctgcagcaacgggaggcgccagcgcaagacattccattaaaaatgttaaagtgtttgtagataaagttcctatcttaagcaacaccgtaacaccgttcgtatgtaccaatccagctaccggaaatggggttgtagatcttacttcttacaattctcaatttgtaaataatcccggtaactatattttcacttattatttactgggaagccctactcctattgccaatcctgcaagctttcagtattcaggaaatactacgatcaaagtagtcatcaaagaccctacttctactctttgtgataacggtgatggagttatccagctaaaccctactccatttgcagcaacagatgccagtcttaccgggtgtaataataacaatgccgggacagcaaccttcgatcttaatacagctgccgtaaccactgttgcaggagttaccaaggaattctatcctactttatatgatctgaataatggaacgaaccagattaccaatccttctgcttatgcatctgcagcagcaacaatatacgtaaaggttaccactcctcagggttgtgtgagtacagctaaaattacattgaatatttaccctgttgtggttgtcaacgatattgaaatcaaatcctgctttattgaaagcaatccgtctatggcctcctttaatctggtaggagccgtcgtttcacagggtggacttacaaaggaatattacccttcattaactgatgctatcagtggaactaatgcaatatctactccggcagcatacattgctcctaatggagtggcttatattaaagtgttcagtgcaaacggttgctactctattgctaaagttacattaaccgtaataccacctgtttactcaagaactttacttgacaaaacaatttgtatagaaaatacaaccactttagatgccggagcaggtttcaaaagctacgaatggagtacaggagcgactacccaatctataaagaatgtaggagttggcacatattgggtaaaacttaaaacaggcgattgtattgcgacacaaaaagtaacggtatatccttccgacaatccggttattaccacgattgatattgcaggaagcactgtaactgtatacgccaatggcggaactcctccgtaccagtattcaatggataatatcaactggcaggactccaatgtctttaccaacattgcaagaggagaagcaaaagtatatgtaagagatgggtataactgcgtccctgttgaagtcaatatcacagtacctaatctgatcaatgtaattacgccaaatgatgacggcaagaatgattttattgattattcagcgcttgccaataaacagaatctggaaatagcaattttcgacagatatggttacaaaatgttccaggcagataaaaccaatggttacaaatggacaggaaccaccaacggaagcaaaaaagttcctacaggaaattactggtattctatttcatggaatgaaaataataaaaacagtactccgataaaattctcaggctggattgttgtcaagaacagagaataattacactttccaacacatcaaaaaaatcaccccgctggccggggtgattttttgtattaacaggaaggagatatttcattttaaagaccctttattcacattcaattcttaaatttgtcctatgaattatttggaagctttaagcagaagatattctgtaaaaaaattcaatcatcagattattcctcaggaaacccttcacaacattcttgagtcaggaaagctgtctgccagttcgctgggacttcagccgtacaagatcattgttgttgagagtgaggagatgaaacagaaactgattcctgccttctataatccatcacagatttccacctgttctcatcttattgttattatttcaaagaaaacaattgaagagaattatatccgtggctattttaatcatatttctgaagtacgggatactcccattgaaaaactggatcccttcagaaacagcattaatcagcatatcagccagaaaacacatgatgaaattttcaactgggcagaaaagcagtcctatatagtattggccaatcttatgtatgccgctgctattgaaaatatagactcatgtcccatggaaggtttccgtcaggatattattgaagaaattctggatatcaatcctgaaacagaaaaagtaaccgttaccctcgctttaggctaccgttctgaagaagatcatttccagcacatgaaaaaagtaagaaaaccaaacgaaaaattgtttaaatttatttaatattttaaacgattgtacctaaagccagcatatgataaaagcggatgtattagtaatcggttccggcatttccggactttcctatgccattaaagtttctgaacagctccctgatgccaaaatcattatcgtaacgaagtctgacgaagacgaaagcaacaccaaatatgcacagggcggtcttgctgttgttacagatttccagaatgacaatttccaaaagcatattgacgatacaatgcgtgccggcgacggggaaaacaaacgcgatgtcgtagaaatggtagtaagagaggccccggcgaggtttaatgaaattgttgaatggggagctcagtttgatatgaaaaatggcaaattcgctttaggaagagaaggtggccatactgaaaacagaatcgtccatcataaagatatcacaggttttgaaattgaaagagctcttttgcaaacagccaacaacagccccaatattgaaattcttgatcatcactatgtcattgatatcattacccagcaccatgttccgggaaaagaactgaatgaaggggatatccactgttatggggcttatattctggatgaaaaatccaaaaccattaaaaaaattacttcgaaaataacactggtagccacaggaggtgccggacacgtctataaaaacaccaccaatcctacgattgcaacaggagacggaattgctttcgtagcccgtgccaaaggtaaggtttccaatatgcagtattaccagtttcatccaacagctttatacagcaaaatggacggaatgctatttctaatttcagaggcggtacgtggagacggagcaaaattaagaacaaaaaaaggggaaaagttcatgcacaaatatgatgaacgtgaagaattggcctccagagatattgtagcaagagctatcgacgctgaaatgaaaattaccggagatgaatttgttggtttagactgcaaggaaatgaatcatgaaaaattcttagaacatttcccgaatatttataaaaaatgcaaagacgaaggaattgatcctttcacccagctgattcctgttgtacctgcctgccactatctgatgggaggcattgaagtagacagggacggacagtcttccatcagaaaccttttcgccgtaggagaatgtaccaactcaggacttcacggtgccaacagacttgcttcaaattcacttcttgaaggtttggttttcggacataatgctgccatgaaaaccgtagatcttctgaatgaaaacaacttcaacttcgatgatctgaaagccgttcctgaatgggatgaagaaggaatgaaaattatggatgaaatggtcatcatcagttatctgagaaaacagcttcaggaaatgatgagcgatctggtaggtattgtaaggagcaaccgacgtttgaatatggcactgcaaaaacaccaggagattgccgctgccgttgatgaaatataccactactctattctttccccacaattgtcagaattaagaaacttaacaaccgttgcacacctcatcattacccaatctatggaaatgacagagaataagggagcattttataataaagatttagcctaaaagcaaaaatataatgaaaagaccaagctacgttacagataaagcattaaaaacatttataaaaaccgctcttgaagaggatattcaggatggagaccactctaccttgtctaccattccacaggatcttatacaaagtgcaaagcttttggtaaaacaggattgtattcttgcaggtgttgagctggcagaaatcattttccacacgtttgacaaaaacctgaaggttgaagtttttattaaagacggaactccttgtaaagtcggggatgttgctcttattgtaaccggaagtgcaagatctatcctgtctactgaaagattagtccttaactgcatgcagagaatgagcggtattgctacgcttacccacgattgggattccagattggtaggtacaaaaactaaacttttagatacaagaaaaacgactcccaacttcagaatgtgtgaaaaatgggcagtagctattggtggaggaaccaatcatagatatggtctttatgatatgattatgctgaaggacaaccacattgattataacggaagtatcaccaatgcagtagcaatggcgaaagactatgttaaaaagaataagaaaaagttaaaaatagaggttgaaacaagaaatctggaagaagttcaggaggccatcaacgctaaggttgacagaattatgcttgataatatggatgtaaaaacgatgaagcaggctgtaaaaatgatcaacggctcatgtgagtctgaagcatctggtgggattacccgtgatatgctgaaagagattgcagcaacaggcgttacttatatctccgtaggagcccttacacactctgcagagaatatagatttgagtctcaaagcagtgaaatagcgttgaatttttaacaaaaacacccccactttgttaaaaattcaataacatgacttttttcatacaaaaattcaatttttagccataatactgatttttaacactttaacattattaagactgattaaaaattaacattgagttaataatagttaaatttaattttgcgaattttgcagaaaattaaatctaattattactaacgattatgaaattaatcaacaaatcaatactaactgcggtaattacattatctacagctagtgtttattacgctcaacaagttcaggacacagtacaaactaagtccaaagatattgaagaggtaatcttaagaggtgttacggatatcgctaaagatagaaagacacctgttgctgcatctaccattaaagcagcacaacttgcagaaagattaggtaaccaggaattacctgagattttgaacactactccatctgtttatgctacaaaatccggaggtggttttggtgatggaggtcttacaatcagaggttttgaatcaagaaacatcgctgtaatggtaaacggtatgcctgtaaacgatatggaaggtggtgctgtttatttctcaaactggactgggctatctgatgtaacaagtacactacaggttcagagaggtttaggttcttctaaattagctattgcttctgtaggaggaacagtaaacttccttacccgttctgctgatatgaaaaaaggaggggtaatcagattaggtattggtaacaacgattatttaaaaacttccttttcttataatacaggaaaatctaaagatggtatatccgcatcattcttgatgagcagacaagctggaggcacttatattgaaaatactgattatgaatcttatgcatatttctttgcattaggttatgaaatcaacaaaaaacataacttacagtttaccataacttccgctcctcagtggcatgatcaaagaacttttgctccaacaatccaaaattatatcaactataatcctgaccacgatggaactccttatagaagatataactcagattttggttactatactgatgccaacggaaacaaagttgctttagcaaacagatcaaactattatgctaaaccggtaatgatgttaaactgggactggacaatgagtgaaaaatctaaattaagtacagttttatacatgtctaacggtagaggtggtggaacaggtgatttaggtaaagtaggaggaaaaggaatgacagacttctatgatgcagcaggacatttcaactatgatgctatttttgcagccaatgcagccgttaatttaaatactgcaggtgcaggaagtactttggttcgtagatcaaatatcaactctcataactggtatggtatcttggctaacttccaacataaaatcaacgacaactggaacttctcagtaggtacagatgatagatattattatggctatcactatcaggttcttacagatctttacggagctgcgggatacaaggataatgcaaacaaaaacttacctgctccaagaatcgtaaatactctttatgattataaaaaacttacttggaatcctttcggaggaaaattagctccagctgaagatcaggtaggatatagcaatgatggagaagttctttggtacagtggatttgcacaggtagaatatactaaagataatttatctgcattcttacaaggttccgtatctaatcagggttaccaaagaattgataactacgtagtagacggaagtacagtaaaaggccagactgtaaacacaaaaacaggatttaaaaatatttttggatataatattaaagggggagctaactataacatcaatgagcaacataacgtttttgctaatgtaggctattatagcaagcaaccatttcttaactctgtttatccaagtaaccaacagcttattaacccttatctgactaacgagaaaatttcttcagctgaaattggatatggattcagatctgcaaaattcactgcaaatgttaacgtatacagaacacagtggaaagacagatggctgagaaagccaggtcagactttcactttagtagacgattcgactactacaggttattctgaaattaatggaattactgaagttcaccagggagtagaatttgatggagtatacagacctaaccgtttcttggaagttcagggtatgttctcttggggagattactattacaaaggaaatgctagtgtagcttctttcgatgataacaacaatcctgttactttagctggttcaggaggtaacgaactatacttagataaagtaaaagtaggaggctcaagcaataacagtattcctcagatgactgcatcattaggtcttactgtaaaaccggtaaaagatcttaatatcttcggaacctggagatatgtaggtaaactttattctactattgacgctggaacatttacaaatatttcagctcaggaaagaggagtattgaaattgcctgatttcaacttattcgatgtaggattctcttacaaaatcagattacaaaatgaagctcagtatttcactattggagctaacgtttataacctgtttgataaaatttatatttctgattctgctacaagcatcttcggaactgataaaattacagcaaacaacgatcctgataaaggaaaaacgtatgaagaagctggtagaatgtacaatggtatcgcaacgggtaaccgtgcttatttcggtttcggaactacctgggcagcaacattatcattcaacttctaacaatataacaatattagattttctcaatatcaatcccggctttgagccgggatttttttatttttatggaaagcaaagtttatggaaaaagcacttagtcaatttttagaccaatggagaagtaaaaaatacgtaataggtattttattaacgggaagtcatgctgtagggcttcaaacagataattcagatatagacattcgaattatatttgattcatcaaaaaacaaaacattaaagggcttagagataattgataatcataaattttcttatctgggcagaaatatagagtccattaagaaaaaattcaataatgaatttctcaatcgacaaaaatttgaagcttacatttttaatgttggcaagatattatatgacagaaaaaatgttatgtccggattaaaggagttagcccaagtctacgtctctactcctctattaaaaaaaacacatataaaaagtgaagttaaagcaggtttatacggcctatacaatcataaaaaccatatcctttctttggatgaatcctctccttttttcagctatcattattatatatttttaaaaaaaatactcttttactattcctcttacttaggatatgagacatttttagatacaaaaacagaaaaagtcctgtgtgatcttacatacagagaacattatcattggccagaattccctgacaaaaaatttacagagcaatggatttattccataaatccagaaaacattaataaaaattcattgataaacatttatcactacatagagaacaaaatagaaaaaatcaatgaagaaaagtttagtatgcaatggaatgagcattaaattttactattttaggtttacttaaaccagaaatactcaacttatgcaaaagaaaaaattagcactgaagaaaacgaaaatttctaagcttaacatcactatccttgacaaaagcaaaaaagcaaatatcaggggaggtgatgtcgttcagcctgatactcatccaacaccggtatatggaggtgacggtggttctgctcatggcgcatggtaccatgaaagttatgatgcacaaaccaactctatacatggtccgacatgctactatgactgcggatcttaaagattaaaattttattatttaatattaacaactttctaaaaacaatgaacatgaagaaaaagctaacactgaaaaaaacgaaaatttcaaatcttaatgttagtattttaagcagaaacttacagggtcatatcaaaggaggagacgtagttcagcccaacacccatcctacgcctgtaataggtacagaaaatgcttcaggtcagggatactggcagcacgcaagctatgatacacaaggtaatccgattcatagtgaagaatgctactatgtgtgtgtttcctaaagccaacatttaaaaaagagccatagtaaattagcttttactatggctttttattaaaaacttttaccatgccatctgattcaaacaaagatatttcaaagaaactcgagaatatctatatatatcttaacaataattatcaacaatataaccgtataggagctttaaacggtcttgcaggtatagctcttttccagtcttattatgaaataaagttcaatattcagcaaagccacagtttaaaaacaatagattattgtattaataaaattaatgaagaaaatctaccctcaacatattgtaatggtgtagctggatttgcatggcttcttcatcatttagaagaaaaccaatttgtttccgaaactgaattttcagaaaccttatcaattctggacacttatctggaaaatgaattatcaaaatatattataaataacaattacgatttccttcatggagccttgggatatattttttattttctaaaaagatcaaaacatcctgaacactataaaaaacagatttctgctctattttcaaacctccctgaaatttacaagacaattacccatcatgagttgagcaaaattgcaatgcgtgaaatgactaatggtagattagaaaataaacttcattttggtctcgcacacgggatctcaagcattattgcaatactatgtttgtgctatgaaaaaggttactttaaagagcaatccaaagaatggattgaaaaatttatactattcctctcacaatatgaaatggtgcaagattctttatcactattcccgatgtggatagatttgcaaaccggtaaaaaatcttttagcagcctaagctggtgttcaggagatattggaattgcaatagcccttacaaaagcatcacaaatcgtagaaagtaagatgctatcaccaattttaacagcgattctagagaaatctttccaaaggacatataatgataaagcattgatcaaaaactatggtatatgccatggatattttggagttgcacgaattttttcgagaatctacaatgatactttatcagagaaatataaagaaacatctctcttttggttaaataagggaatcgattctctaacaatgacaaaagactctccaatgagtattttaaatggacttgcaggtgcaggactagtattaatggactttcgtttgcaggaaataaatagctgggatgagtgtcttttaatttcataaaatcaatcatgagtaaatttccttataaaattttaaatcaatatgttttgaggactccctcaaaacccattaacatcataaccaatctcttgaaagaaagagaggtttcggacgaagcccttaaagctttatccgaagatcctctttttaaagaagcattattcttagcatctcctttattgcacgacatgcttataaactggctgacagggacacttaataaagaaaaagaagaaaaggttaaaatgtctcttctaaaatacataagcagaatgtcatcccggtgtactcctttcggcctctttgcaggctattcattaggccgattaagcgaagagaataatatagaaatagctgaagagaacaaatataagagatatacaagactggatatgcaatatcttttatcactttcacagtctatctccagtaataaaaaaatacgggcttatttgacctatcactggaatactagtatttacaaggctggaggacaatatcggtatgttgaatacacttataccggcggactaagaagagttcaccatattgaagcggttgagatcactccacatttagaatatcttttaaacaatatatctcagaataactcaattcaaaacattgtagattctttaattcaatatgatccggaaattacagacagagaagctaaaaatttcatacatgaacttatagacaaccaactccttataagtaatataggagggtcttctattggagaagattacctaagtgctcttaataaagttctttcaacaattaagggcaatctttacaaccaaatactcaatgatatcagcttcgacctaatccaagtagacaatgccatacccaacgatatagatatttatcattccattcataaaaagactgctcaattaggaatacaatcagatcttaaatttttatttcaaacagatctttctgtaacaactaaaaataatactcttaacaaaaatatcataaaagaccttcaggaaggacttatgattcttaacaatatttcatctgcatcacaaaaaaacactaattctttactggaaaaatttattgcaaaattcaaaaaaagatatgaaggccgtgaaatcccattaagtattgccttggataatgaaattgggataggctatacttcaaatcatcatattatcccaggcaatcattttcttgaaaaaattcacattccacttccacaaaaaaagaaagaagaaatacaatgggatgctgtaagtagtcttttccacaataaaataatggaagcttataaaaatcaatcaagaacaatttgcctgacatccacagatattcccatacaggaaaatgctctttggaatgattttgcagatacattttcattaatgacagagatgatttatattgacaatcagcaaaaaatactttttcatggattcagtggggctagtggagccaatctgttcggacggttttgttcatcagatcctttactcaaagaacatgctgaagcaattattaatatagaaaaagaaatcaataaaaattctatcattgccgaaatatctcatattcctgaggccagaataggcaacgttatctgcagacccagttttacggagtatgaaattccttatctctccagatcagaaaaaaacgaaaattttcagatcaatatacaggatcttatgatttcagtaagaaataataaaattctactacgatcaaaaaaattggataaatttatcatcccaagattacatacagctcataattttagtagaaattctttacccgtgtatcatttcttatgcgacttacaaaatcaggagaataggtttgggcttagtttacatcttgggcaaatggaaaaaaaatataaatatattccaagaatagaatataaaaatataattttaaaacccgctgtctggaatttaaatataaaggaccttcctcttttatctcaaaaaaaatcatctggagaagaacttctaaaactaatgaattgttcacgagaagaatggcaccttccacaatatgtactattaacagaatatgataatgagctgttaattaatctcaaaaatattagtagtattaaaatgatgattgacgccatcggtaaaaaagaaaatttcacattaaaggaattcctctatacagatgaatatcagttggtaaaaagagaccaagatttctttactaatcaatttatttttacattttataataatcaaaaattatactcaatcaagaatgaaagataaaatacaacgtatttttacaccaggagatcaatggctctactacaatatattttgtggttataatacttcagatgatattttaattaattatcttagtccattaacgcagtcatttctttcaagaaatataattgatcaatggtttttcataaggtataatgatccttcctaccacatcagatacagagtaagaataaaaaatatagcttatataggtgaaataatacacaccattaataacgttctggagcaacttttaaaagatgaatacatctcaaaactccagattgattcttatataagagaaattgaaagatatggatataatacaatagaaaatgctgaaaatattttctttcatgacagtaataacattctaaaaattattgcatcgcttgatgaaaacaaacctaatatacgcagtttatggggattgaaactggttgatttttacctttctactttccgtttttcaatttcagaaaaagttctattttctgagaaactgagaaattacttttacaatgaattcaaagtagataaaaacactaaaaaaaatctggacagattatattctgattatcaaacaagtatacattcatttatcagcaataaggatagaaaaatatataagtcggaaattataaaagatgtagctaaaattgtagcaataaaagaaaaaaatcttctcagagttgattttgatagtttaatttcaagttttatccatatgtcccttaacaggctttttgtaggtgataacagactccatgaacttgttacatatgatctcatgtggagatattacaaaaaagagttttatttcagcaaccatacaaccacacatggaacagaatcaaagagaatcttatcttagtattgtagatgcattaaagaaaatatcttttgcttatccctttctgggcttgaacggaagatgtgggggtgctatttttttatttaaactatctcaaaaattaaataatactgaggtttatgacctggcaatagaattaatagaacaagaattaaatgaaataaatatcattgaaaatttaagcttatataatgggctctgtggtattgcatggactgtccaatatttatcagatgaagattttattgatctcaatgaagactccttcattcaatatatggaaaaacattttatccaatttaaggataacaatcatgaaatcaaaaacctttatcaatttcaaacatttatagatctactgttctatttctccagcagatatattagtgttacaaaaaagaaagaaaaggtaaaatatgcgggattattaaaccagattcttattattttaactcatcaattttataaaattcaaacatttgaaaaactaaataatttatctcaccaaaatttatattctctcttacaaacccttatctatcttattgatatagattttcaatcacctttaataaaaccattaataaaaatatctgtcaaacagactgaaaagaatagagagattgaaaacataaactcatatcccaaatatattcttcaaaaagcaactctttatacttccaaagccagactctcagttgcaaaaatgcctttaataaaaggcagtatacagaatgataagaagaaagaactcaataacaacatggggatttgggataacagtattgtccatgatgccattaaaaacatatgttcgcagaagtacaaaaaagatttaggattacattatatattggaatgtcaatataattcataatgagccagccgggatttttgttatctttgtgtacaaaaaaataggattatggatttttacaacattttacttaatgcccacaaaggattcgggtatcttgagattcttttggtaacattatttatcattgcacttttagctaccatgttcggtttcagtggaaaagtgaacaaatttttgaagaaaacgactctttttacgatgattttcttccacgttcagtttttattgggaatcattatgctgatcaccactttcagcaagggattaaatatgggagaagtaatgaaaaatgcagcattaagatttcaatatgttgaacatccattctctatgcttattgctgcggttttgatgaccattgttaacaaaaaagtaaaatccaacgatactatttctttaggagtagttattatgggactgattgcagtaggtttatttgcattcgcattcccttggacaagagtctttggggcttaaaaagataaagaaattatatgcgttataatttataaatagtttaatcttaaatttttaattaaatcaatgaaagtagctgtagtaggttcaacaggaatggttggacaagtcatgcttaaagttttggaggagagaaacttccctgtaacagaattaattccggtagcatccgaaaaatctgtaggcaagaaggtgaagtataaacagaaggaatttacgattgtaagcatgaaggacgctatagctgccaaaccggatattgccatcttctctgcaggaggttctacttctcttgaattcgctcctctgtttgcggaagcaggaacaacagtaattgataattcttctgcttggagaatggatcctgataaaaaattagtcgttcctgagatcaatgctgatgttttaacaaaagaagataaaatcatcgccaatccgaattgttctaccatccaattggtaatggttcttgggccattgaacaagaaatatgatttaaaaagagtaatcgtttctacgtatcagtctgtaacaggaacaggtaaagctgcagtagaccagttaaacggtgagattagtggaaatgaatctactgaaaaagtatatccttatcagatattcaaaaatgcattgccacactgtgatgtatttgctgatgatgattacacgaaagaagagatcaaactgatgaaagagcctaagaaaattttaggagatgatactttcaacctgacagcaactgctgtaagagttcctgttcagggaggacactcagaaagcgtaaacatcgaattcgaaaatgaatttgaactggatgaagtaagaaaaatcttatctgaaacacctggtgtaattgtaatggacgatgtaaaaaacaaccactaccctatgcctctgtactcagaaggaaaagacgaagttttcgtgggaagaatcagaagggatttatcacagccgaaaacgctcaacctctggatcgtagcagacaacctgaggaaaggagcggcaacaaacgctgtacaaatcgcagagtaccttgtagccaacaacttagtataaactaacaaaataaaaaagagtctcagaattgagattcttttttttatcaaacacatttatgaatacccagaaaaatgcccatcaggagaaaataggatttcaaaagctcatcgccatatttggaatcatccttttcgttggaaaaattattgcatggaaacttaccagttctgatgcggtcttttccgatgccatggaaagtatcgtcaatgtcattagtgcgttcatgggactttattcattgcaccttgctgccaaacccaaagatgaagaccatccgtacggccatggaaaggttgaatttgtaacatccggtattgaaggtgcccttatcgctattgccggtgttatgatcatttatgaaggagttcatagccttattgtgggaaaaacgctaagcaagattgatctcggaatctggattattgcaggaaccgcggttgtgaattatcttctgggatatatttccataaaaaaaggagaaagagaaaattctctggttcttatttcatccggaaagcatcttcagtccgataccattacaacgtttggcgtggttgccagtttagtgattgtttatttcactaaaatatattggcttgattccgcagtagcattaagttttggactttatatcatatttgtaggctataaaatcgttcgaaagtcattaagcggtattatggacgaacaggatcctgaaatattaaatcagatcattaaaatcctcgaagaaaacagacatacagaatggattgacgtacacaatatgaaaatccagcagttcggttcttctttgcatattgatgctcatattacccttccctggtattacgatctgcgtgatgcacatagtgaaatggaaaacgtcattctacttcttgccggaaatataaaacgcagtattgagttcaatttccatatggatgactgcaaaccaatctcatgcccgatctgccagatcaaagaatgccctgtccgggaaaaagatttcattaaacgcgtcaaatggactccggaaaatgtaaccagtgtggataaacacacagcaactaaagatgagtaagaaataaatcggtctggttcagctttctttactaaccatttgtttcctgtaataaaacatcggtacaatcagaagtatgattaacggctggattacgaatcgcctcatataaaaagaaaaaagataccctatttcaaatctgttatgaatacaatacagataaataggcaatgtaatggcaaaaacaacagtcatcattattgctccctgtattgtccatcccttatttttaaataaaccgtaaataatcagacaggaaaaaaataagtttaaaataaatctgaaaacatgtccggcaatcagattaccccattcaaatgcaggaaaatcaatattcttattggcttcatgaaagtaatcaaggaaaggatcataaaaaatagttccttccaggattcttacccctatcaacccgcagatccctgcgataaccagaagccagttaagaattttcatgttttaaagcaaaaaatttaatccagatcagccaaagaacaacaacactcccataaataacagcaggaaaaacaaaatcgtgaaatatttttccatactctttatgatcagtcatcacgatatttaatcccataattctcaagagattcattatatacaggataaccaatcctgcacccacaaaaacaaaagtctttattcctttatagaaggcaaatacaaaagacacaaataaaatgatgacagaaaccgcattacagccttctaccattcttgttgcataattttgcttaacataaaaccaaacctgttcgttttttatatcatcatatatttccgtaggatatcctattgcgttctgcagggaagtcacctgattggcaatcacccttgaaaatgaatccagcccggaatctttaccactgttcagatagaactgataagcgaaaagcaacaccagataaataacaataaagcgcaataaaatacctaaaacaggtttaaagtctttcagcataatgcaaagataaaaattagcatgtaatatcctgaatctgaatcaggaaacttaaaaataatagaataaagtctacaattatggagttaaaaggaaaaattcccgctaaaatattcaataaaagtaatatccaaaatatttattataagaggcttcccttttgatattcaattctttaaactataatttccaactcatgttaatttagtatatttgtttccatattatgacttctgaaaacgcaaaacgattttttgaaaaccagttaggtaaaaaatcttctgaattcgtcacattagctcaaagcggctctgcgagggtaaatttcctggccactgccggtacagaaaaatacatcattacctacaatgaaaatattccggaaaatgaaagttttctttactattctgaagtattttcgggcctgaatcttaatactccttctattcttgccgtttcagaagaccggaagatgtatatccaggaatttttaggacagcatactctttctgaagtgattgcaaaagaacagctgtctcccgctgtaagatctttggtacggcaaacgttagaaaagctttaccagctgcagatccagactcaggggaaaattgatttttcaaaaacctttgagtatgaaagttatgatgaacttcccgtgatccatgatctttattattttaaaaactttgtagcagattttctggagcttgaatataataagtcatctcttttgaaagaattcaaaaaaatagcagtccttattgagaatcttgaacctaaaggaattatgatccgtgatttccaggcaagaaacatcatggtaaatgaacagaatgaagtctcttttatagattatcagtcggcaatgaaagggccattaatgtacgatgtgatctctttcctttttcaggccaaagccaattttcctgaagatttcaaacaggaaatgctggatttttatattgagcagtttgatgatcctgcaacaagaattcagttgaaaaatacagtgatgcctattcagatgatgagatttctacaagttttaggtgcttacggattcagaggtttgatacagaggaaacaacatttcatggccagccttgaaaaaggaatccggaatatcatacagttttcaaattcctgggaacacatgaaggattatcctgaactgactaaggttattcagcaattggcatcggaaaaggcacaacaaaaaattgaagaaattataaattcgaaccaataagaagctttaagttattaaggacttattggtctaaaaaaattaaaaacatataaatgctacacatcgagatacacagtttttcttacaaaaaaggaggaattcccaaagataattccggaaatggaggaggttttgcctttgactgccgtggaattttaaatccgggaaggattgaagaatataaaagtcagaccggaaatgatataggagttcaggagtatctggaaacaaaaaccgaaatgccaaagtttctggaactcgtaaaatctcttgtttcaattaatattgacaattatttagaaagaggctttgagcatctgcagatcaatttcgggtgtaccggcggacagcacagatcggtatactgcgcaataaaaatcgctgaatttatcaaagaaaaatatcctgacgggactgagatcactcttcaacatgatgaacagccgcaactgaattcataaaagataagcgatgattgataaatgattatttttccactgttattttaataatcatttattaattataaaagttttatcactcatcaactatcatttatcaattataagaaatgaaagctctaattttcgcagcagggaaaggtaccagacttaaaccgtttaccgaccatcatcctaaagcactggcaaaagtaaatgaagttccgcttctggaaagaaatatcaactatctgaaaagtttcggaataacggattttgtgatcaacatccatcactttggagatcagattgttgattttttaaataaaaataataatttcgggtgtaagatcgaaatttcggatgaaaccaacgaacttctggagaccggtggcggcttgatttttgcaagaaaatttcttgatcacggagaagattttttaatcatgaatgctgatattctgactgacctgaatatcaatactttggtagaataccacaaaaagataaaagattttgctactttagcggtttcggacagagaaagttcgagaaaactccttttcaatgatgatatggtattaagaggctggctgaatgtccaaaccggagaacaaaggcttgcagaattcaacaaaggctttaaagcactagctttcagtggcattcattgtatcaatcctatcatctttgaaaaaataaaaagaacaggcaaattttctgttatggaagaatatctggatctgatgcagaccgagcatatacatggctttgtgcatgacagtattcttattgatgtcggaagaccctcatccataatagaagccgaaaaacattttaaataaattttgcaatggaaattgatggaaccagagatgaaagtttggtaaatccagaacttgatattaacgaaacaaaactacataatagcttcagacaaaaaacatgggatgaaacgatcactaaagacagctggatggtctttaaggtcatggctgaatttgtagacggttatgaaaaactggctaaaattggtccgtgcgtttcaatatttggttctgcccgattgaagccggagaacaaatattatgaaatggctgttgatattgctgaaaaaattaccaaacttggcttcggaattattaccggaggcgggcctggaattatggaagcaggaaataaaggagctttcaatgctaaaggaaaatctatcggacttaatattgatcttccgtttgaacagcattttaatcctttcatcaacaaatcctattcaatgaatttcgattactttttcgtgagaaaagtaatgtttgtaaaatattctcaggggtttgtggtaatgcccggaggtttcgggacattggatgaactcactgaggcgatgactcttattcagaccaataaaattgggaaattcccgattgttcttgtaggaagtgaattctggggaggactactggattggtttaaggcaacgctgttaaaagaaggaatgattgctgaagatgatctggatctttatcgtgtggtagatagtgctgacgaggccgtggcacatattaaggccttttatgataaatattctgtgaatgtaaatttttaattggcatattatttgtgacttataacgaacaagtatgattgtaaatctattaattaagatgaaaaaacttttatatatatcaggaattttaacattttttgtgttaatgagttttatgtatgtagactttttctcttcaatgaccaaagtggattatattgatggaagcaagacattgaagtttaccacaaaaatgaatacaagccatatctctgatgctattaaaataaaccctaacacggctggatttgaagcggaggtaaaaaaatatgtgaacaataattttgatgtatttgtcaatggggctcctaaaacgataaccttcacaggaagtcaggtcagcggagaaactgtatgggtatattttgaaaccggaggcgtttcagatatcaataccttaaagattaaaaatacgatccttttaagcgcttttcctaagcagatcaacattgttaacattgcctataaaggcagccagaaaacgatgaacttccaaagaggaaaagaagtgaatgaggtttctttttaaaatgtaaattagatttaaccattataaatgggtaccctggaaagttaaatttttcagggtatttttttgaatcaaaaacacttctaaaataaagactacagggaaagagaatttctatgtacagttcagactttatattcgattgtgttgggtctaaccattacggttaaataataaaaagccaccacagatacttggatttttattttttaacgggttaaaatcctgtactccataaaagggttgcaaggtccagctcgctgatattaaaatcattctggtgatctttaaaaccgggcttatttttcaattcttcaatagctttttctgctttttctaaagaggaaaataccccgatatacctttcgtcatccagaaagttgtgtatggtataataatggctgacactgaaaaccgtatttaaacgtaattcttttattgaaatacagttgtcatctatctcatcacctttttcaatatagtcacgtccaatttccccaataacctcctgaaatccttcattccaatgtatcttatccagaatataacaatttgtaacaaatgattcgggataatctctgaatccagatagaataaccgcttgggtttttaattcatccaaatcttcaatactatctgaaaatcctaagaattttgtatctgtatgagattcatctgtgtatgtatgatttagtgcataaataaaatattccatagataccgttttcttttcagatacaaaagtataaattatcacctgattcaaattgttcctatccttaaaataaatcaggcagcttttcaagctgcctgattttatagtatatgagaatatattctatcgaagaatattactcaattgtgatattgtcaatctggacatcatatactccaccatttccggttttgatagcaaacatatcttttccggctgtagtgttaacgtctgcaatacctgtaagggtaagctcaactagtctccattgtccgtttgtattgatagaaccgttgtaagagttagcactttctactcctaaagtagcaccagtagagaatgtacctaagttaaacacgtagaaacctccacctgctttatatacgttgaaagacagtgattttcctgttgcattacctttgatatacattgtaattctttttggtacagccggtattcctgtagcagcaacagatgtaaatacataatcattagctgtaggagtacctttgatctgaagtgaatttgtaccgttatatcctaaaccaacaccttgtgtagcgtaaggcttaagtccgaaaccgtttacacttgataagaaagtcgcccagttttcaaaatctgaaccagcaaaaaggtttacagcagaagctgaaggagcatctggttcacccggattgaatcttgggttcgggaagttaatatcatcaagagttctgatataagcctgatctgtgaaaatagttgcgttacttgaacttgtaaaacggctcaaaagaagaacgatatcaccacttttttcatatttaggagagatcggagatttcgcaaaagttgcatagttactgaaacgaagatccaatcttcctgcttttttatccgtaatataacggtcacctgtagctgactcgtcagcaaaagtttttgtcagttccggttcttcaaactgaacgtttttaatttttacaagctgattgatgtgagcaccatttttaagggcatcagcaatagaattaaactctaatggctttattgcagttactacagccttttgtccgtcacaaacccttgccatgtaattggatagtttattagggttgattctaccgataggataattaggatcaaaagaacctactttaatgttcccattaactccctgaacgatcaatcctttcaggttgattcttactaaagatccgataggataatcaagatactgatttccgccatcgatgtcaatttcaatcccttgtgtcgggttttcaggcttatcctgaaggaacatcattttatagatatttcctgattcatcgcttgaggaaacatatgcttcaacaatgtaatcttctttaatgatatcagcttcagttggttttgcttttgcaatggcagcaaggtcagtcagagggtgatttgccgctgcaaacttattggtacacttgatttccggcacctcataatcatcagtttttacacaagatgagaaggtcagcattgaaatagcactgaaaatcgccgctttaaaatatatatttttcattgttttcgatttttaatttaatttttttagaatctgaattgaaggttaacaaaataagatctaccctgattataccaatatttaggagcgaataccatatttccgctgtcataatcattagcataatcaatatagttaacgtttctggtctgttcaaatcctcctgtaatataatttctgttattaaggatattattgacagatgcagacaccagcacataatacttaccgatcatccacgatttccctgcattgacattgaagaagaatgctgaaggcagttttgtaggtgtaagaactcttgcaagttcttcatcatttacctgatcataaggtactcccggcgtattaggatttgtgtagaatctttctgttctggttacaggagacggatctaggaatgaatgtccgaaataattccatgttgctcctaaccaccagtatttagggctgctgtaacgaagacctagcgtatatgcctcctgaggagttccgccctgtctgtagtttttaagcgttgcttcccccatattggtataagatcttgaaacgatatttccgtttccgtcaagctctctgaaagttccaacagcatcagatgcaaaataaacggtagggttattagtataagtatactgtcctaagcttaataatccactggccgttaaagtaggagtaagttttacctgtgcaccaagctcaatacccatatttcttttgttggcacctgccagaacctgggtaatgaaagcaccatcctgaataggagcctgatctccgctttcagtaagatttgtcagtttaactccctgtgcaaagtatctttgtacacttgtttcgttttgtgtattaacaagataacctgtcagtctaagtttaataatcggagtggaaattacataactcagatcattggcatcaacaacaacatttttgattcccggcgttgtaacaccacttactcttgtattaaaataaatatcattcaggaaaggagactgtgaaaagtaagctccgttataaacaaggaagtttctaccattgattttataggtaacctgccctttgataccagcattccagaagttttgatctgcaccttttccataagaagattcatacagatagtgctggaacaatccttctctgctatttgtcgtatacccgaataatccggaaacaaacacatcaaactttcctgttgagaatttaaaagcaggatttattttgaattcctgtcttctgaaaatatagctgtatccgattttatcaccttctcttttggcaacatcagtatcgctttctcttgtattgaattttccccaaacacttccagcattcgtattggatgcaaacgggtccatattaagagcaaaatcagcacccaaaagatcatttacttctctgtactgttcagatctgtagttctggtaagataggtttaagataaaacgggaagtatcggtgaagttataagtataatgagtagatacattccataccttatcatcttttacatcatcaacgagataataagctgctcttcttccccctaataatgcattgtattctacgtttctgttggcattataaagattatcccagttgatctgtgtgtgtgactgatcatcattcgtccaccagtctctcgtaattccgatgttagcggcctgttccggagacggatctttataatttaaccagtaactcggcaaattacggtaataagttggagatgggttattcgctctgtaccagtctaatcgggaactgtattcttttccaaactgataagaaacagaagtccataattgagagtttttattaattttccagaaatcctgtaattggatcatcggctggaatcctctttttaccctttcatttcttttatctccattctgccatccccagtaagagttataatgaactcctctgaagtcgtatacttcctgagtacttggacttgaagagcttcttgcgtatttagacccaatggcatttaaagtcatcgtatggctatcgctgaatttcttctcaataccaatatacccactgtatgcatcataggcagtaccatcctggatcccttcctgtgcccatcttctggcgatcattcctgtaaatgcccatccgttcttattcatcccggaagagaatctgtaggataatctgtttctataatttctgttggtaagagagtatgtcagctggcttccttttctgtactcgctggcttttgtattcttataaaatactccggtagttcctccgaaagcatattctgaaggggcatggttagctgaaatttccgggtaacgggtaatttcgttcaatcctccccacgtactgaagtctacgtccccattatctgcagcggccatagaaaccccattgatcatattttcacctgttctgctatcaattcctctcggacggaaccagtatggtcctaaatcgaaacttgcaattctgttgaaaacatcttgtgaagactgtaataatcctacagtcgccgtttgctgtgcaccaccgctgtcactttctccggaatcttctacaatagctaatccctggtctgcaccattcaatgcagaataaagagtaattactccaagatcttttcttttctcatcactggttacatcaaattcaaacattttagtttcaaaattgggttttgtaaccataatctgataatgtccaggcatcaaatccgtaaattggaaatatccgattttgtctgcctttgcatcatttcctgctccttttaaatctacatttgcttgctcaacaggcttaccgtctgcatccttaagatacgcaaacactgttgtctgcgcataataatatgaagcaggcagcaaagtaaataaagagatcaatgatagttttttaatcatgagtatatttattttttaatacttttcttgttaattttcaacagtttaaaagttgggggcacaaatttaatcaaattttgtaattcagaacttttttaacattattttttcttaacattgcaatcttttaagaatcattataaaagagtgattcggattactgcttttaaatttacaaatatttaaaacgcagtgaattaaaaaaaggtaaatttgcaattaatagtataataaaactctaagagatgaagagattttcgagtctgtttgccctatttctttcaattgtggcattctcacaacaacagggaaaactgagaaaagtagctaccgttggttttttaaatgtggaaaacctttgggacactatccgctcagcagattatattgacggaaccaaagacattaaaaatcctgcttttcacagaagtatccctatggattctatccaatttctggaagcagaaaaatatgacgggccatggagtgatggagctttaaaagggaaaaaagcagtaagactacaaagtggctctgaagaatttactccaaaaagtgcaaaaaactacggaacaaaaatttataaagcaaagctggccaatgaagctaaagtaatttctgaaatgggagcgcagtataccaaaacagctcctgcagtagttggccttattgaggttgaaaacagacaggtaatccaggatcttgtcaatgaacctgctttaaaaaaatatgattatggaattattcactacaattcttatgattacagaggaattgacgttgcactgatctatcagaaacgaagattcactcccaccaattcattaaaaaaggagctggtcatttacggtgacaacggaaaaagagaatatacaagagatatccttgtggtaacaggatttttagataatgaaaaagtagctttcttcatgaatcactggccatcaagaagaggcggtgaagcaatttccttacctaaaagaaatgcagccgctgcattattaaaacaacaaatggacagcgtaagagcagccgacccaacaacaaagctttttgcgatgggtgactttaatgatgatcctgtaagtcccagtttaaaaaaccatctgaaggcgcaggctaatccaaaagatttaagtgaagaaacaccataccttaatctgatgtatcctttatataaaaaaggagttgcttctctggcttatcaggatgctcccaatctgtttgaccagattattgtttctaaaaacctaatttcagatcaggtaacaaaagaatattccgtatataagacagaaatctttgcaccggcgtatctggtgaataaagaaggtaattataaaggctatcctttcaaatcctggaacggagaccagtttacaggaggctacagtgaccactttccggcgtttgtagttctccagaaagaaccataaaaaagttaggcactcttattggagtgctttttttatacaaatatctcaatcatgaaaaatattattttattagtaatgattgcattgattccttttagctgtttttctcaggaaacaccaaagaaagacaaagagcagcatgagatgaagccttccaaaaatgaagacggagaatgggatcttacagtcattgatacgcagtttgattattttctgagtgctgtggcgaaacctattagccaatactcagaatcttatctgaagacaaaaaacacatttctggttaacgaatggaacagttattactattccagcagatatagaaatattattgaatcaggaatagattatgatccaaaagagaattacgggatcaagtttgaatataaattataccaggtttttgtatacgtcaactggaagtataaactaagactgaacggtttatccggaagcgatgcaataaggtaaattaatcctcaataaaaaaggtccggaaattccggaccttttttattttttataacagctgaaaattatttattgaataattcttctactttatcccagtttactacatcgaagaaagcagaaacatagtcaggtcttctgttctggtagtttaaataataagcatgttcccaaacgtctaatcctaaaaccggagttcctttaacatctgctacaggcattaacgggttatcctggttaggtgtagaagaaacagatacagaaccatcagcattttttaccaaccaagcccatcctgaaccgaatcttgttttagcagcttcagaaaaatcagttttgaatttatcaaaacctccatagttttcgatagcaacttttacatttcctacaggttctttgcttcctccaggtgttaaaatttcccagaataaagagtggttgaagtgacctcccccgttatttcttactgccggcttatcagttcctgtctggcagatttcttcaattgtttttcctgctagttcagtaccttcaattgctttatttaaattgtcaatgtatgcctggtggtgttttgtatggtggatttccatagttcttgcatcaatagttggctctaatgcatcatatgcatatcctaattttggtaattcaaatgacataatttttatttttaatgttatacccaaaaatagccaatatttaaggtattatcaaagattggggattactttaataaatctttaacattgatacattgatttagaatgaattaaattttggatcaatacgtttgaagttaaaaaaagcacgaaccaaaatcagtccgtgctttccaattaacaataattaaattaatttatttattcatagacatcaggaattcctcattattaagggttcctttaatgtttttatctacaaattccattgcttctacaggattcatctcagaaagatattttctaagaatccacattctctgtgaagttacttcatccagaagaagatcatctctacgggtgcttgatgctacaaggtcaatagcaggataaattcttctgttagcaatttttctgtccagctgaagttccatattacctgtacctttaaattcttcaaagattacttcatccattttggatcctgtatcaatcaatgcagtagcaataattgtcagagaccctccgccttcgatttttcttgctgctccgaagaatcttttcggtttatgaagagcattcgcatctaccccaccggaaagaactttacctgatgcaggtgttacggtgttgtatgctcttgccagtcttgtaatagagtccagtaagatgactacatcatgtccgcactcaaccattctttgtgcttttgcaagaacaaggttagctacttttacatgtttttcagcggcttcgtcaaatgtagaagcaattacttctgcattcacacttctttccatgtcagtaacctcttccggacgttcatcgatcagaagaaccatcatatatacttccggatgattcgctgcaattgaattggcaatgtctttaagcaacattgtcttacctgtcttaggctgtgcaacaatcattgctctctgaccttttccgataggtgcaaataaatctacaattcttgtggacactgtagaaccacttcctgcaaggttgaatttctcttcagggaaaagtggtgtcagatattcaaaagctacacggtctttgataaatgcaagatcacgtccgttaacttctgtaggtcttaataatgagaagtatttctccccttctttaggaagtcttacaattcctttcactgtatctccggttttcaaaccgaaatttctgatctgtgctgtagaaacatacacatcatcaggagaagagatataactgaaatctgaggaacgtaaaaatccgtagttatccggtagaatttccaaaaccccttcaatacttaccaatccatcgaaattaaattcttttttaggatcgttctgctcctctgccttttcagaatgtctgttctgattctgattctggttttggtgctgttggtgctggttttggtttttatgctggtttccactgttctgtggatggttttgtcctttttgaggtctgttagcctgtggttgttgagaattgttaggcttttcttctgcctgggcaggctcttgtgattctgtgtttttgggaacttctgttctttcctgggctgtttctgaactagctgtattggcagaaactctttttcttttcttttttgcctgggctgttgctgtgggttcttctgttactgcagcaacttcagcttttggttcttcctgttttacttcttcggaagccggcaccttttcttctgttttttcctctgcatcaggttctaccggagcttttgcatttgcttttggcttggctgccgtttttttcggggcagctttttttgccggggctttggcaggtttttctgccggagcctcttcagtagttatactggcggtttcagtggcgttgaaataatcttttgcaactttagggttagaagcctgaaagtcaagaatagcaaagatcttgtcattttcattgctgtttcttgcaactttaacgcctaaatcttttaagattttagtcagttccgttacggattttgaccttaacgtttctatgttaaacatatttaatgtaaaaatgtaattaattgtgagtaagaaaagtaagtccggtgacttttgttttcaagtacattgtataatgcaaatctacacttatttttgaattgtgcaaaatttatattatttttgccaagaatttaatattcaatgctacagagaatacaaactatatggactttattagcagttttggctgctgttttccttttcataacaggtcaggatgttgtcatttcagacagtattcctttacttaatatcggctgtatagtccttgttattattggagcattaagtattttcagtttcaaaaacagaaaaagacaaattttgctgaataccatcagcatcattataaacgctttgttgattggtgtattggcgtactggttactaaacttatccggaggaattcagtttcctgagaagggtattgagccgattttcccatttatggcggtgatctgtctgcttattgcaaacgtttacatccgcaaagatgagaggctcgtaaaatctgtagacagacttcgatagccttacaacgattttttgagtgagaacagcttcttttcaggagctgttttttatttttcatactttcttattaatttatgtaaattcattgcaactttttagtcagaaatacgacagatcatataacttttaataaaagacaatgaaaaagctaacgtatcttaccttatcactattctccatatttacttttgcacaggaagtttccagggaaagagtaaaaacagttctctccactcttgcctcagatgaaatgaaaggccgtgaaataggaacccaggaaaatgaaaatgcagctcattatatcgctaaactttttaaagaaaataacctggaatattgtacaggaaattcttatctggtgccatttgactacaatggaaaaactgtatacaacgtttgtggaatcaaaaaaggaaaatctgatcagtatcttgggttttcagggcatttcgaccatatcggaaccagtaacaaaaacggtgataatatttacaacggagcagacgatgatgccagcggaatcaccacactcgtaggtattgctgattattttaaaaataaaaagcctgaattttctatggtttttatggcattcaatggagaggaaaaagggatgctgggttcaagagctatttcaacagattctaatctggatcatatttataataaaatgaccgctcttttcaattttgaaatggtagctacagaatcccaatggggcaaaaatgcattatatatgacaggagacggattctctgatcttgatgagcttttcaataaaaatgccgtaaacggattaaaaattaatgctgatccttatgcaaaacagcagctgttttaccgttcggacaatgtaagttttgtaaaaaagaaaattatagcccattcattctctacggttgatatgacgaaagcttctcattatcaccacgaaaatgacgacatcaatattgttgattttgataatatgacacagatcatcaataattttggaaagacattggataaactgagtcctaaaaattttgctccaaaatataatgaccaggtgaaattttaaggaaaccactataaaaggaaccgctgaataagcggttttttttattagactgctttgctgttttatctcttgttccggtacgaaagtttcgtttatttattttaaaaataaagtttaacagcccttagctgtaacaaaaaaacgatttttggaacatatccattaaagtaaaacaggattaagaacgtcttatcttttaattttacgtaattttgctatccaattttttcattgaatgaacgaatataaaaaaatcttaaagttcgcgaggccgcatcaaaaatatatctacggaagtttatttttcaatatcctgtattctgtatttcagattgcttccctggggactattctaccagttctgggaatgctttttggcactataaaacctgaaaaatatgagaaagcaccagtatattccggtgatattgttgattttttctcttatgtaaaagaatattccaattattatgtacagacactggtgagcaattacggagcacttactgttcttgcctggctgtgtatcattactgcatttatgttctttttaagaaatgcattccgttatttcggttctttattactgatcaattaccgtgtaggagtaaccaaagacctgcgtggagcgatgtacagaaaaatactttctcttcctgtttcatttttcacagaaagcagaaagggagacatgatgtcccgtatgtccaatgacgtaggagaagtggaaggaaatattttaggaagcttgattgaactgataaatgcaccttttatgctgatcagtacattggttaccctatttttcctgagtccggaaatgactcttttctcgctattggttcttcctgtgatgggaacaatgattgcattgatcggaaaaagccttaagaaagactcacacgaagcacaaagcgaactgggaaccatcttctctattgtggatgaaacattgaaatcttcaaaggttattaaaatattcaatggggagaaaatcatgaataacagattcatgcattctatgaataaatggatctcaagttctatcaatttaggtaaaaagaaagaattggcatctccaatgagcgaattcttaggttctattaccttcctgattattgcatggtatggtgggaaacaaattattgttgagcagagtatttctccggcagatttccttgtatttttaggaatgttcttccagatccttcctcctgcaaaaagtttatctacttctatttccaatgtacagaagggagaagcttccctgaaaagagtattggaaatccttgaagcggatgtaaaaattgaagaaattgcggagcctgtttctattacaacacttcagaataatattgaattcaaggatattggattctattatgataaagcaaatcttattcttaaaaacttcaacttaaccattcccaaaggaaaaacggttgctttggtaggacaaagtggaagtggtaaaacaaccatcgcgaatctgttagcgagattctatgacgtttcggaaggtgaaatccttattgacgggacaaacattaaacatttaaaattacaggaataccgccagctgctgggaatggtaacacaggaatctgtattattcaacgattctgtatacaacaatatcctgatgggtaaacctgatgccacgaaagaagaggtaattgccgctgctaaaattgccaatgcagattcttttatttccaatctttctgaaggatatgataccaatatcggtgatgatggaaacaagctttccggaggccagaaacagcgggtctctatagcaagagctgtattgaaaaacccaccgattatgatccttgatgaagccacatctgccttagatacggaatctgaaagattcgtacaggatgcgctggagaaaatgatggaaaacaggacttctttagtgattgcccaccgtctttcgaccattcagaaagcagactggattgtggtgatggaaaaaggtgatatcgtggaacagggaacccaccacgacctgattgcaaaaagaggaatgtatcacaaacttgttgaacttcaaaacttcgactaatcttttaatcaaattaaaatgaaccctatacaagagtatttctacagaatcggagagcctgaaagaagtactcttttgtttttgcgcgataagatcctggcttctgatccgaaaaacattacagaaaccttcagtttcggacttccgtttatcaaatacaaaaagaaaatgctgtgttatttctactacagcaaaaaataccaaaaacattatctgagtttttatcatggtgacagacttgattatcctgaactgatccaagatggcagaaagaagttcaaaatccttctcattgatgcggcagaagacattcctgtagaatttatattaaacctgatacaggagattaaaaagcatataaaataaaaaactccggcacgaatcatcgtgccggagccatctttaaaaaacttttatcattgtgtgtttattccgttgaattcagcctgttttattgcccaggcaatcatattagcaaaaaggattgaattctgaacctgcattccacctgctgtatatccgtttccggcgtatccgtaagaagacttctgaaccgggaagtaccctcctgaacttggcgctacaaaaggctcgatagtattacttggatactgatttccatttgcattttcattacttaagaatccaccgtcaccaaaccatataaagtttaggctggtatttcttaatcctgaaattcctgttctggcagttgtactgttgattggctgcgcgtagctgtaaggaacaaatccacttgtcaaccctgaaatatttactgtggtagaagcatcttcaccccagtttttccctcttacgtctccaaaaggtccgttaaggatgggatcatcagaattggtaagagcatacacagaacctgcaccgcctccatatgatgctgaaatggtaggatctgagaatattcctctgaatagattctgtgcagtgcccgtatcatctgtcatcgcaatgacaactccttttttattaagataggaagcaatataacctgcatctgtagcattaggtgtatagttgtaaccaatgataacaatatccggtttattattaagagctgtctgaagagcagctgaagaaggtgagttccctaatgaggtatgcgtaaagccttcatatttaacaatacttgaagcagtagtaccgaaatttgtcggagaatccatcagacttcttgatggaccggtataggcgctataaccgtaagctgtttctaatccgatatgaagaaccgttttcttaggaataacaactactacatttacggaacatgttgtagacactccaccctggctgtccgaagtgattgtaattgttttcaccgaggtagaagttggaattccttttccgctcaatgtaatattctgatttccagtggcagtaaatgttcctgacccactgaaagaaattccgtcaacagtattagttgtaaaagtatagcttcccagtgctgctacattaactggaagagtaattgtattggaagctgttaaagctgtaccaaccttgtatactccgtttaccgttgcacttccgcaactcatggtataggttcctgcaggacttaatacattcactgtaacagcaggtgtacatgtaacatctgtcccgttggcatttagtcctacggtatccacctgtatcgcaataggcgttccctgtcccggaacttggatagtttgcgttcctgtattaagaaaaacacctgttccgtagaaattatatccatttgttgtagtacctgtaatcgtataatttccaactttagttacgtttacagacacacttaaataattggatgctgtaagctcttttgtctgaacataggttcccattgcttttgtactggcacagtcgaccgtaaaaacagctttgcctatttgtccgcagacacttttccattcattatcagcaagactccagtaattaatacagtcctcagtaatgttataaattgtcaaaccatcatccttggcagtattaattacaatagcatttctctgggtttcagtaagccttggaataagaactcctttgttattatttcctgaaacaacatccaaaacggaatttgaattgggtgtggtagtattgatcccaacggcaccgttattagtctgtgaaaaaatttttccaaaaacaaagagcattgcaatcagcaagactttgatccggggcagtgtaaattttgtgtccatcattgtatatttataattgtttaatgattaaaattttcaactaagtcatttaaccgtcacaaaattatcacccacagacaattacagatcaattcacgctacgcaatactactcacgcgtagtaaaactcacaaaacattaataattacaatcacaaaaaaagcctaaataaaaaacagaatctttcaacaaatgctaaccataaattcaaaaacacaaacaaaaaacaatttaaaaaccattattacccatttattttaaacaataaaacagaagaattaactaaacgtaattccggttataatttaaaaatagttttccatttggtgattgtattccggcttatcttaaaatgatggctgagctgaagattgctaacctcattctttttctgatatctgagaatttttaaaatagattctttgtcataagatcgcagcctttgattattgaacccgactgtaaattccggttcaccaaaaatcagctgattaaatttcagaatatcaatagcagaatgtaaggtttccagcttaagcctgatagctgtatcaattaatttttctggaaacttttctttgagaatatcagtgtaaatctgtttgtaatcaggtatcatgttatatttttttcaaccatttatataaagttgtcttcggaattttatacctatccaccacttcgctggctgtcattgttccaagttctattttttcaaggatgaaatctttcacttcctgtgtgtagatgcttttccggaaaaccattgtatttccgtttttgccggttgtgttatcaattctcgcctgtggggcatataaaattagatgaccggtataaaatctgaagaaatcaaattttaaaagcttacaccatttcagcagaacatcggtatccatactttttgcctgatacatcatttctatttcatcatctgtcctgtttaaaaaccgggaaattctttctattgaaatctgatgctcttccactttgcatctgattagatttccgatatgaatgttcttaatattcattacaatatttttatttaaaaatattgactagaaagacaaaaaatatcatcagacactactcaacactacgtataagtaacaaaaatcagaatttattaaattttaataagaaagctgttgatattgatctcagaagagatgttcagcttttttcttatcctgtattttttgctctctacagcacgaatactgttgttggtacactgtgctattttcttggtatcaaaatcaagcttcatcaaagcacagaaatacagttcagaatgaataaggttgggatttatttttaatatatccgggataaaatgaggaaaaaatacctggaatttttcaaaaaacaccggagagttattttctgccagacttaagatttcctggatattttcttcagaaagatggttaatcaacatctggtgtttcatcagttccgaatttgtttttaccagatccttgatggtagaatccttcactttcctgtcggtaatcaagccatggataaggccatccttctgggtaataaaaacgatatccatcagaaaagaggctatggaaaataaaatattcaacagctttattgttttaaaatcctctttttctatgaatctgctttttggcaggaaatcaaaatcaaaatacaggcaggcaataaaattaatactgatgatgaatgtaataaaaaagattgtaagggagtcctgtttgtatttcagaaagaacggaacagcaaacagaagacaaaagtaaaaatattctacacctgcatttttgtaagtataaatatgaaaaaaacttacgataaatgtgagtaagacaaatatcccgataatgaaaggttttaaaacctttctgaaccgtttggtttttcctttgatggccatgaggagcagccagaagaaggtaataatggtaagaaatatggagatcagcatatccccaaaaaaagtaataataaaaatggagtaaaacaggaatatgaaaaacaataaaagcaaataccggttaataagatgaagataactactttcaaaatcatcatccatcttctcagcttcgtcgttaatcatcttaaagaaaaacttataaatcatcttgttgtttttttatgctctcacaagcttaagttggcatttgtactcctgaaagtataaattttccaatattaacagcctttcatgcaaaatagaaatctacaaaacgaaatgtatcagtctttttcagcattaaaaagaagatgattaaggtgtttttctagctacaatttactaaaattcgatattaaaattatcaaatgaaataccatttttgacaataaattaacaatcatttacctccaatcacttaaaaagcatgagcttgtgtttttaagcatgcaaaattattgttccttacggaaaagtataactcttcccatacgcaataatactcatgcgtaattaaactcaaacaacaaaatattacctttatacctcaaataaaaaagagagctttaaaagctctcttttgattttttatctacgataaggattttaattttctttcagtttggcaatcacatccaaacctccttttgtaatatctccgatcttacagataatttcagtatccagaggcagaaaaacatccattctggacccaaatttaataaatccgaactcatgtccggcttttgctttatctccttcattacaatagaagacaatccttctggccacgtatcctgcaatctgtctgaaaaccactttatgattggtcagagtctggattgctaccgtagttctttcattctctgtagaagacttttcatgccatgctaccagatattttccgggatggtattttttgtaaatcacttctcccgaaaccggatatctgcagatgtggacattcaatggagacatgaaaatggaaacctggattgcttttccttttataaactcatcttcttccacttctttgatcattaccacctttccgtccaccggagcaattacgttttctctgtggtcaagaatggtacggtccggaactctgaaaaaccagaagactaaactgtaaataaccaacaaaggcataatgatcagcagggaccatattttaaggaaataaatcgctaaagctcccagaatgataaaaagtatggtagcaacggttatcgttccttttgattctctatgtaatttcatgagactaaataaatttttctaaaataaagtacaaatatacgacaggaacgcagataataaaactatccagtctgtctaaaactcctccatgccccggaatgatgtttccactatctttcaccccgaagtttctcttcaactgactttctacaagatcccctaatggagcaaaggctgcaaccagaaatccgacgatcatccagtttcctctcaattcaggctgataatgttcaataaagtaagataaaaccagtgtcaagacaactcctcctgcatatccttcccatgtttttttgggagagattttaggagccattttatgtttaccgaagaatttccctaccagataggcaaaagtatcactgctccagatcagaataaacaggaacagaacctcgagagaaaaatgatcactataactggagaacttaggcaagcctaaagcaaaactgaacggcagagtcacgtaaatgaccgtaaaaataagtttcccgctgtcaaagtataattcgttaggatatttaaataaagtcaccacagcaatcccaatcagagcgagcgccagtatttcactaagcctgaaatcaaaaaagaaatcgtggttgaaatatcttttggagaacatataaaaaatgaagatgaccagtggatataccacccacttttcatacccgtttccaaatttcatgattttgacacattcccaggtccctacgatcagaagtaagctcattaggccatgataaagatattgctgtttgatcaaaccaggagcaatactgttcagcaattgcgctcctaagggagtagaacaaagaataatgatggctacataaacaatacctgatacggttctttgaatgagatttttgtccaaaatttaaaatttagaagtggttgcttaatcttcaagcagcaataaaaacagttttgtactggaattggaagaactgtccattttagactggcttccgctgatggaagtaaggttcttgatatttccgtttctttttatttttcccatagcatcattcaggttgtttacaatctgagaaacattggcaatgatgataattttatcaggaagcctggaagaatgatagtgaaggatattattatgagaaagcatgattctgccgtcataggcaatgaggtactcacaggtaatgaatgcggcatcattagactgctgcagttctgaagtataagaagtcttcacaacgtttagaaagttctgaagttctttatcccagcagaataaattgtggatgccttctattttgataatttgatttaaagtttgtagagcctccgcttcatctgcacaataattaaaaaatccccccgaatgcgtaaataattgcgcaaacttatagtcaagatccgcatttttcagcgaatccccaagcttctccaggctctgtttttcctcttcttcaggctggttggtaagtttgcttacaatcctcttgaataaattcaacttaatctatttttagtcaactttatacaaaaatagaaaataaattacaatagtattcaaaatatctctttaaatatgaaaaaacctggcaattttacagttgccaggtttttgataattctattttttaagagtcttaaagctgcgtcgggctttcaggagcctgaatttcgctttcttcttctttttctttgatctgaggtgctacctctgctattggctgatctttttcaggaatagtgttggtaacaggcttctctgtcaattccggatcccatgctctctttccgaaaatttcttcaagatcttcgcggaagattacttctttttcaagaagtttattcgctaaagcatccagcttatctttattatctgcaaggattcttacagctctgtcatattgattttcgataatcgacttgatctctgcatcaatttttgtagctgtttcctcagaataaggctttccgaaattatattcagactggcctgaactgtcatagtaagaaatattaccgatattcgggcttaatccatagatcgttaccatagcctgagctctcttcgttactgtttcaagatcagaaagtgctcctgtggaaatattattgaatattacctgctctgcagctcttcctcccagtgttgcacacatttcgtccagcatctgctcagtagtggtaagctgtctttcttcaggaagataccatgctgctcctaatgaacgtcctctcggaacaatcgttacttttaaaagtggagatgcatgttctaccagccaggaaattgttgcatgtcctgcttcgtggtaagctactcttcttttttcagaaggcttgatggctttgtttttcttctcaagacctccgatgattctgtctacagcatcaaggaaatcctgttttgtaactgaagtatgattatttcttgctgcgataagcgctgcttcgttacaaacgtttgcaatgtccgccccactgaatccaggggtttgcttagcaaggaattctctgtctacattatcatcaagtttgatctttttcaaatgaacatcaaagatctgtcttctttcgtgaagttccggaagatctacgaaaatagaacggtcaaaacgtcctgctctcatcaaagctttatcaaggatatctgctctgttggttgcagccattacgataacatttgtatcggttccgaaaccatccatttcagtaagaagctggttcaatgtattttctctttcgtcatttccgcctgagaaattattttttcctcttgcacgtccgatagcatcaatctcatcaatgaagatgatcgcaggagatttggctttagcctgagcaaaaaggtctctaacccttgaagctcctaccccaacaaacatttcaacgaaatcagaacctgaaagtgagaaaaacggaactttagcttcccctgcaacagcttttgccaataaggttttaccggttcccggaggccctaccaacaggactcctttaggaattttacctcccagtttagtatatttttcagagtttttaaggaaatccacaacctcctgaacttcttctttcgctccttccaatcctgcaacatctttgaatgtcacctgaattctttctttttcgtcaaaaagtttcgctttggattttccgatagagaaaatttgtccaccgggacctccgccaccgcccatctttctgaaaagaaggaaatagaatagtcctaaaattgaaatccagaccagtgcaggaactaaaatatccattaaggcacttttacctgttccgtaatctttagttgttttgattgccgggttggtcgctttgatctgttcaaatttttgaaggaaaagctgaaggtctccatattttacagaaaaatctgctttaggagccatatctaacgccgaaaaagggttgttttcttttccggctttggaaaccattgccgattttgcttcttttgtcaggaaaacatcagctttctctatgtctttgtatataattatattctggactttccccgcctgcatttctctaaagaaaccatcttcatcaatagattttgcactgtcacctccaaggaaattggagccaaagaatagcaaaagagctatgattgcaataggaaagaaccagttgaatcctttattattcatttaaactttttaaaatttttattattcattttcaattctggtaatgactgcgtcaccccaaagctcttctatatcgtagtactcacgtacctgtttctggaatatatgaaccaccactgaaacgtaatctaccagtacccacatcgcattttcagcaccttctacgtgccaaggtctgtcgtgcagttcgtttcttacttttttctcaacacttcctgccaatgcagccacctgtgtatttgagtttccactacatattacgaatgtttctgctacggagttttcgatgttggaaagatcaaagatcataatatcttcaccttttacgtcctggatagcttcaacgattttatctattaatgcttgtttttctgctgttttattcattaaaaaaatactataatctgcaaatttattgttttttctttactttaaccttacttttaccctcttaatgtcttaaagttttcttaaatgagccaactcttctacctgaaagaatgttcttctactaatgacgaaatatcaaagtttttactttacgaaaattcagattttacaggacttcatacttttaatcagactaaaggccgtggtcagtatggaaatacctggactcagactgccggaaaaaacctggcgtatacgctggcagtgaatactcagaacatcttgtgctctgactttatattcaattactataccgcaatgataatccgggatttccttgccaaattgtctgactcagaggtaaaaatcaaatggccgaatgatattatccttaaaggtaaaaaaatcgttggaattttaatagaaaagaaaaaatttaatcaaaataattatttcatcataggagccggaatcaatattctgcaggaaaattttgatgaaatatccaacgcaggatcactcctgacgcaaacaggaaaagaatttgaccttgaagtccttgcccaaaaccttcatgaattcctgtctgaaaaactgaaaaacattccatctgatcaggaaatactggacggattcaataccaaccttttcaggaaagatcagatatcagtctttgaaattgaaaaagagcgacaaaatggcatcatccgaaaagcagacgaaaaaggtgaactctggattgagctggaagacgggatgcattccttttatcacaaggaagtaaaattactttactgattggctcttttgatataaaggtaaagagtaagcggaaggaatacaagattgggcagccacattgctaatgccggagacaaacttttattttccgaaactacctttaaggcttcaaatgaaaatacaaaaataaaggctaatgaaatccctatcgccaggttaattcccaatccacctcttttcttttgcgaggacagggaaagggccaggaacgttagaatgatgattgatacaggcattgaagttctttgatgaagctcattcaggtaagaattgagattgctgtttcctctttccttttctctttcaataaattttaaaagttccggagtggttttattctgccccaaaagctcgttcgggaaaagctcttccggggaatgcccatagtttttccttaattctattccgttattaagcttttcagaattgtctttattgattgttttttccaaataattatttaagacaaactgctttttgtctttatcccaatatacttcactggctttcagctcgtaagtcattttcctgtctttatcatatttctgatagacaaaacttgatcctcttttttctcttttattccaggaatcaacgaagatatattcggttttacttagctgtgaagatgccggagcggttcctaagattttttctttattggctgcattataggtataagcttccagctcatttttcttgatattagcccagggaagtaccatatgatataccaccagggcaatcagaccaataaaaatagaagtgagaagataaggttttgaaaacctgtgaaagctggctccactactgatgatggcaacaatttcggtattatttgccattctggaggtaaaataaatcaccgaaataaaaaccaggatggaaagaaaggtcaccaccagattaataatccagaagggatagaaatgaatcaggaaatacatcagatccagtttcggatcaatggctttggcattttctatccttggaattttctgctgtacatcaattaccaggacaactatagacaacaatacaagcatgaaactgaaagttccaaggtatttttttatgatatatctgtctacaattttaagcatatttttttatagtctttgtctgagaaccggtactacagagtttttccattcatagaagtcacctgcaatgatatgttctctggctacttttaccagatccagatagaatgcaagattatgaattgaagcaatctgttttgccagatattctttagatacaaacaggtgacgaagatacgcttttgaatattcacgatctacaaagctggtcccgaattcgtccaaaggagaaaaatcacgcttccatttttcatttttaagattcatcaccccttgccatgtgaaaagcattgcatttcttgcatttcttgttggcattacgcaatccatcatatcaatccccagccctatagattcaaggatattccaaggagttcccactcccatcaggtatcttggtttttctttaggaagaatgtctgttacttcatctgtgattctgtacatttcttcttcaggctctccaacggaaagtcctccgatagcatttccttctgctcctgcttcggaaattacttctgcagagatttttctaaggtcagaataggtagatccctgaacaatcgggaaaagtctttgcttgtgtccgtataattcaggattattgttggtccattcaatacatcttttcagccatcggtgggtaagctccatagatgattttgcctggttataatcgcacggataaggagtacattcatcgaaagccatgaaaatatcggctccgatctgtctttgaatctccattgatctctccggggaaaacatgtgataacttccatcgatatgagacttgaatctcgccccttcttccgtcatctttctgttactggccagtgaaaatacctgaaaacctcctgaatcggtaagaataggaaggtcccagttcatgaatttatgtaaaccacccgcatcctgcatcgtctccataccgggacgaaggtaaaggtgataagtatttcccagaatgatctgggctttaatgtcttcttttaattctctctgatgaactgtttttacacttgctacagttcccacaggcataaaaataggcgtctgtatcttcccgtgatctgtggtaatttcccctgctcttgcttttccttcagaggttttttctatattaaaaaatttcatctctatacttttttaatgcactgttttatcagtgattccttgcggacagaaacctgtatgctcttttaccttactaaaggcattacagcaccattctgttttattttatcctttacgtatttatctgctttgggatcttttttcagtaatatttcctgtgcatcattagcaatcccatccatttcttctttaattacatagtatttgaaactgtctacaaaatcatcaggctttaccttatatgatttcaggacagctcttgtacctgcttccatatttttgtcaggatatacatagatagcctgatcattgatcgcaagatcagcaattatttctgccatcatacctttatcaatcaggtttttaggcttatcaatataatcgccacacgaaaacagccccagcaaaacgaaaataaggatcagctttttcatcagtttcatagtctgttgatgattgatttccattttaagttcaatactccgaaaacggcctcatggataattccgccgttcattttgctctctcctaaaattctgttggtaaatataatgggaacttctacaattctgaagccttttttaaatgctctgaatttcatttctatctgaaacccgtaaccttttaattttacattatccaaccctatttcttccaatacttttcttgaaaagcagacaaatcctgctgtcgtatcatgaattggcagtcccagcacaaaccttacatattttgatgcaaagtaagaaagcaatactcttcccataggccagttcaccacatttaccccttttgagtagcgggaaccgacggccatatctgcatttaaacaggcttcgaaaagtctcggcaggtcattcggattatgtgaaaaatcggcatccatttcaaaaatatagtcatatttattttcaatagcccatttaaacccatgaatatatgcttttcccaaaccatctttcacatgcctcactgacagatgaagataatgcggatatttcttctgcaattcctttacaacctctgctgttccgtccggagaagtatcatctactactaaaatatgaaagtcatcttccaaagcaaaaaccgcggaaataatattttcaatattttccttttcgttataggttgggatgatgacgagttttttcatttcagtttgcaaagatagtttatttaacctttttattttatacaaaataatctataattttgcaaaaatatttctcggggattaagcggatgaaacagaaacttttattcaacagatctgaacaatacgtaaaatcgatgagagcaaatattttaactgcagattcatggatcaggtgataggaaaatctatgccgcactgtgtaatccgaagttaaataataaataaaaaacttaaattttgccatcatcacaacaacacttcatcaatcacgtaagaatacctgagaataatgattgggtaatcttcatccttgtgggctgtatctttttgtatgtttttatgatgaacgtcatagaaagggatgccagcctcaaagattttctgcttcagaaatattttgatgcaagtaataaccttcccagctggatgattacatcctgtgtaaccactcttaccctttctgtattaatctcacaatatgttcctgttgtaccgaaatttattgcggatcttcagcttttaggatatcagcttaataaattcgggtatactttgctggttgtgatgtttttttatttaataaaatccacattagggtttttattttatcaaagtatcggggatggaaaaaaatggactattttttattttacctccacaaaattttatttcattctttcttttttactgataattctttgtgtagcccactattacttcccgatagacagaaataaaatgtttttatattatttctgcttcttttcttttgtattcattttcaaggtttttttctatttatttcacaagaacaagattcttccggagaaatggtattataaatttttgtatatttgcaccctccaaattgcaccattattattgctttggaagttgttatttttttaataaaagtcaatgatgagaataaagtctatattggtttctcaaccagcgcctagtgagtcttctccatatctggatatagcgaagaaggaaaaaataaagattgatttccgtccatttatccacgtcgaaggggttgacaataaagagctcagaacacagaaaatagatctgacgcagtataccggtattatttttaccagtaaaaatgcgattgaccattacttcagactcgcagaggaattgcgttttgccgttccggatacaatgagatacatctgccagtcggaagcaattgccaactatcttcaaaagcatattgtgtacagaaaaagaaaaatcagctttggggagaaaaatttctcagacctgcttcctcttttcaaaaaattccctactgaaaaatatctgttgccatcttcagatgttttaagtccggatattgtaaaaaccatggatgcatctaatgtagactggacaagagcaatcatgtaccgtaccgtatgcagcgaccttacagatatcaacgtcaaagattatgacatgttgattttcttcagtccacagggaatcaaatcactgcaacaaaatttccctgacttcaagcaggaagaaaccaaaatcggagtttttggaaacacgactttggcagcggcggaagaagcaggattaaaagtagatttaatggcgcctacgaaggaaactccttccatgacaatggccctggaaaagtatattaaagcacttcataaatagtctttactataaaaatacaatcaaccatcttttcaataaagggaagatggtttttttttacctaaatttgaacaaaaattaatattgaattgatttatacttaaattacttagtttcagaagaaaaaagtatagaattccaattcgataaaaaaataaaataccccggatgaaagctccacaggcaaaaaaaattgaaaaaatactagaaacccacggcgataaaagaattgataattatttctggctgaatgaaagagaaaaccctgaagttatcaaatacattgaggaagaaaatgcctacgcagaatttatcatgaaagatactgaagctcttcaggaagagcttttcgaagaaatgaaggcacgctataaaaaagatgatgaatctctgccttatttctttaatgaatactggtatattgtgcgttatgaagaaggcaaggaatatcctatcttctgcagaaagtataaaagtcttgaaaatgaagaggaaattgtacttgatgttaatatactggcagaaggagaaaacttctttgaagtaggaagtgtagccgtaagtcccaataacgaacttgcttctttttcatcagataatgtgggaaggagaatttacacactgaatttcaaaaacttaaaaaccggagaaattcttcctgatacaattccaaatactacaggaaaagctgtctgggctaatgacaaccagcatattttttatatcagaaaagataagaatcttcgtgcatttcaggtatacagacatcaattggggacagattcagcggaagatgttctgatctttcacgaagaggatgaaacgtttgatgtaaatgtgtttaagacaaaatccttacaatatatttttattgcaagctcaagtactatttctgatgagcaccgctttattccttctgacgatgtatttgcagaatggacggtgatccagccaagaatagacgaccttgaatattcagtagaacattatgaagatgagttttatatcatcaccaacgcggatgacgccatcaatttcaagattgtaaaaacaaaaattgataattgtggtatggaaaactgggtagatgtcattccacaccgtgcagaagttttgctggaaggttttgaaatctttaaagattatcttgttcttgaagaaagagaaaaaggattgcttcagatcaaaatcattgatgagaccacacaggaatctcattatctgcctttttctgatcctacatacacggcttatatcggtgtcaatctggaattcgatacagaaattttacgttacggttatacttctcttacccagccaagctccacttatgagtataacatgaaggataagactacaaaactgctaaagcagcaggaagtcctgggcggaaaatttgttcctgaaaattatgtttcggaaagaatatgggcagattcaagggatggtaaaacaaaaattcctatttctttagtgtatcataaaaataccaaaaaatcagctgacactcctcttcttctgtatggatacggaagttatggacataccgtggacgcaagcttctcaaatgtaagattatcgattcttgatcggggatttatttatgctattgctcatatccgcggtggagaatatctgggaagagaatggtatgaagacggaaaaatgctgttcaagaaaaatacattcttcgattttattgatgcaggaaaatatctgatcagggaaaattatacttcttcaagacatatgtatgcgatgggaggaagcgcaggaggactgctggtaggtgctgtggtcaattatgagcctcagttatttaacggaattgtagcacaggttccttttgtagatgttgttaccaccatgctggatgatactattcctttgacaaccggagaatatgacgaatggggaaatcctaatgacaaagaatactatcattatatgaaagagtactctccttatgataatgtagaagcaaaagattacccaaatatgctaatcacgacgggattccatgactctcaggtgcagtattgggaaccggcaaaatggaccgcaaaactgagagagctaaaaacagatgataatattttaatttttaaaacggacatgagctccgggcacggaggggcaagcggaagatttgaatccctgaaagaagatgcgttggaatatgcatttctgttgaaaataaatgataattcataaaagataattgatatgaatacagacaacaactacaatcaaatgcttgcacaaaagaccaaatctttaaccattgctatcattaatgagttgtctgaaatttcatattctgataaaatatcaaatataagcaaacaagtttttagatctgtttcatcaacagccagtaactatagagcaatgtgcagagccagatctatcaaagaaaagtattctaaaatctgcattgttgtagaagaagctgatgaaactttattctggcttgagctaatagatgagctccatttacttaaaaaagaaaaattaggtattcttattaacgaagccactgaaattttaaaagtaacttctgcttataaaaagaaattaagtgaagaattaaaacgttaaatcatcaattattaatcatcatttatcaattatatgaacgagtccgaatattggaaaaaaatagaacagttcttcgaagacaactttcagacagagaagaaccctcccattgaaacccttttatttctaatagggttacaggagctgggaagcggtcagcaaaaatatacaaaagacgacaaagtaaacctgattcacattgctgtgtgcaggctgcttgagccttttggatattataaattcacccattatgaagacggatggccgcagtttgataaactggaagaacttccggaattaaagccaaatgagcagaccctgctgatgaaaaaggctattattcagtattttcaggaggaagagctcttgtaaaagcaggaagcgtgaagatggaagcaggaagttaatccctgttgataaattaaaagagggttttccaatggaaaaccctcttttttataaataagtatttttacatcttcaaattcatccaatcaattcttccagctggttcaatcccatggtaaatccctgttcaaaacccatatccagcatctttttcattacttcctcagactggtagtgaatattaatggttactttggttccctcttccactcctgtaaagccgatcagccattttgattttggaaaatcttcgttgacattgcctttctcatcacagaaagcactcatccagtcaagacttctgtgctctgtaatttctccgtattcagaacgggaatatcccttttctccgttaggccctaccatggcgtaaaaccagatccctccttctctgaagtcctgacttactgtctcacacctccagggtttaggtccccaccattgatccaataactctgccttcgtaaaatgattccataccgttgaaacatcagccttataaattttcatgacataagtactgagcgcatcaaaatctttgttgaaaataatattagattccatacataataatttttattaaagttaggactttatttattgaaaggacttttcatatgacaagtaaaggataattcataaataattgttaaaaaacactcttttaagaaaaaaaagacaattttttggctcgttttttgtttacgtagtcttaaaacaattaattttaacattcatctttccaaaacatatataattaaataatgaataacaaattcatcccaataatttcggtgtttatgacaatctcactgattgtctttgtgacgctccaattttattggttgaaaggctattacggcgtactggaacaggatttttcaaataaagtgtatgcggttttggaaagtacttcaaaaagtattgaagagattgaagctgacaaatacctgaatcaggattacaaagatttcagaaaaaatattattgccaacagtaagcagccatccttaactacgattcagcaggtggaagactccggcacccagagacaaatcatctactccaaaaatattattgaaaaaacgcagcttccgatttctcaaaagggagattctattaagctgacaacattatatacagacgaggcagcctacaaaataaagagagatacgaccaatcgcgaacttcttaccacggatattaaccaggaaattgaaaccggtgattattccatgaaggagtttgtaaaggtatacggaaataatcttcccattaccaaaagagttgattcgaaaacgcttgattccgttattgcgaaagagcttaaaataagaggaattacagctaaattcggatacggagttcttgaccgtaacaacaagcttacaagtatagcaaacaaagcttacaaagagaaaaaagacagcaatacctacagcttccctttatttgcagataagaaaaataccttatacagccttgcattggtattccctaaaaaagaatattccctggcgatgaacaactggccaatgctgctcggaacattcctttctcttcttaccattcttgggatttatattatttccatcaattatatgatgaggcagaagaagcttgctgaagtaaaaaccgacttcatcaacaatatgtcccatgagtttaaaacaccattggcaaccatttctgtcgcaacagattcattggctaatgacaaaattgctaccaatccggataaggtgaaatattattccgaactgatcaaacaggagaatctgaggatgaaaaagcaggtggaaaatgtgcttaatatgtctaagcttgaaagaaatgaagtagaacttttcctaaaagaaaccaatgttagggagcttatcaaaaaaactacagaatctttcaatctgattgtacagcaaagaaacggaacccttacacaggagttcaatgccactcattataattttaaaatagacgaattccatatctcaaacatgctggtcaacttactggataatgccaataaatattctcctgaagcaccggaaatacatgtgaaaacaagaaatgaaggacactggtatgtgattgaaatttctgataaaggaatgggaatggatactcagaataaaaccaaaattttcgagaaattcttcagggaagaaaccggaaatatacacaacgtaaagggacagggattaggactttcctacgttaaaaaaattgtagaactacacaaaggacagattatcgtggactcccataaaggaaaaggaagtacgtttacgatcaagctgccaatgagctagaaagataaatgacagatgataagcgataaatgataaaaatctcttttacatcaattatcaacgatcattcatcaattataaaaagtaaaaccaaatatcaaaatatagaagatagagtgagaaagttcattcttaattgttaatttttaattattaaaattatgagcaacagaatattattagtagaggacgatcagagtttcggggcggtgcttaaagattatttgaccatcaataattttgaagtaactcttgccactgacggggagcagggacttaaagaatttacagaaaatgaattcgacatctgcatatttgacgtaatgatgcctaaaaaagacgggttttcattagcggaagacgtaaaaaagattgataaaaatacaccgatcatattccttaccgcaagaaatatgagagaagatatcttaaagggataccagttaggcgctgatgattatatcacaaaacctttcgatactgagcttcttttatacaaaatcaaggcaatccttcagagaagttccactttggaaaatgaagaacaggagcagttcaagatcagcaatatcttctttgattctatgctgagacagctgaaagtaggtgataaggaatacaagctttctcctaaagaaaatgaattattgaagcttctttgcattcacagaaatgatttcatgccgagagatcttgctttaagaaagatctggaaaaaagaaaattattttacggcaagaagtatggacgtatatattgcaaaacttcgtaagctgttaaaagatgacgagggattggaaatcatcaatgttcatggagaaggatttagacttttggtaaaaaattaatccaaaaatcaaattataagtataaaattagcaaaacaattgaaaatgttttgctaattttgttttcatacccatggatatgaagaatacatttataggtttgatcgccgtatcactattagctgcatcctgtaaaaaggatgaaagagctacttatttaaaagaagaagctaacgccggacaaccgaacgtagcctttaataccacatcaaaaacagcgctgatggatcaggcaggcattcagtctaacccaacccccgctcctatggctacagctccggggatgaatcctccacacggacagccgggacaccgatgcgatattcctgtgggacaacctttgaacggacaacctgctgcagctgctccttcaacacaaaatgtaaatgtgaacggaggcaacaccatacagattgacccgaatgctttatcacctggaaaaattacccttgataacaacggaaagcaagtaaaaacggctccgggaatgaatcctccccacgggcagcccggacatcgatgtgatattcctgtagggcaaccattaaacagcaagcctgctccggctcctctacccgctcaaaatgcagtacagacaactccggccccggctcctgcacctgctgcacagaatctcgcaatgggagaaaaaccaaaattaaatcctgcccatggtaaaccgtggcacagctgttctctgaaagttggtgatcctttgccataaatttcttatttttgcagacatgaagctgtttcacctacttgcaatagtattttgtctgggaatctttctggttcccaaggataatttctatgcgcagggaatgcaggaaacatgctgtaaagcagagtcttccaagaaaatggactgctgtaaaaatcattcttcaaaagaggaaagcaaacatgataaaacaaaatcatgtaatgatgactgttgctcatcatgtgttgcctgctacacttttattgaaacccctttctcaaaaaatctacgtttggaactgtcttattacaaagccaataagaatcctcagtttcaatattcagacccttatctctcagaccgtttaaaagaaatctggcagccgcccaagataggttaattaaaatatccagggttcattatgtcgtatagtgaactgttttttaattaatttaaacttttaaacaaaatgaaattatatatttccaggttgatacttggtgcattattcttatttacacaattgatatctgctcaaacactttcaaaaaatcagttcaaggtaaaagggaactgtgaaatgtgcaaaacaagaattgagagtgccgctaaaaaagcaggtgccaaaacagcagtttactcgattgatctgcaaacattaacattagaaacagacaaggtatctgctgatgatattttaaaaaaagtagcagaagccggccatgataatgagaaattcaaagcttctgatacaacatacgaagggcttcctggatgttgccattatgatagagatctgcagccttcacaggcagaaactcatcatgaacatcattcagactctaagatttccagtaaaaaagaaaatgaattctatgtaagaggaaactgtgcgtcatgtaaagccagaattgaaaaagcagcaagagaagccggtgccgatactgctgaatgggatgcagagaaacaaacagttattttaaactttgatccgttaaaaacctcatcagataaaattttaaaggctattgctgatgctggtcacgacaatgaaaaatataaagcttcggatgctgtttacaacgcacttccggcatgttgtctgtacgacagggattttacttttggtgaacctaatccaaaagcacattacgaagaagaaacaaagcatgaagatcataaaaatcatgaaacctcatcagctaaagaagatcattcccagcatgaaaaaagtattggtggaattgtcgtcaccggttctaaggcggcaacagctttaagtaagaaagaagccgggcttgtttttaatattgataaaaaagagctgttaaaggcagcctgctgtaatctgtcagagagtttcgaaaccaatgcaacagtagatgtttctttcagcaatgccgttacaggaacaaaacagctgaaaatgcttggtctggatcagaaatataccagcttaacaaaagagcaattgccagaaatcagaggcttggcttctgcctatggtctaaattttatcccggggagatggattgaaagcatccagcttaccaagggaggaagtactgtgacaaacggatatgaaagtatcacaggacagatcaatactgaacttttgaagaatgcaaagacgccggaaacatccctgaatcttttttccgatttcaatggaagagctgaaatcaatattaccaatgtttctcctatcaacgataaatggtcacagacattcctcctgcacggaaacggaactttcggaaatacggatatgaatcatgacggctttctggacagaccgaaaggaacgcagatcaacgcagcgtatttgctgaattataacgatcttgaaaagtcggggttcgggtctcacttcggaattaactttatcagagatgaaagaacggcaggagaaattggttttgataaaaaactgggccaggacaaacagcctttttatggagtaggcatcgatatttcaagatttcaggtctggaataagacaggatatatttttaaaggaaaaccttatcaaagtatcggctggatgaatcagtacgtttatcatcagcaggacagcttttttggattgagaaactattccggacagcagcatacctattattccaatttaatctttgaaagcatcattggaaataccaaccataagtataaagcaggagcaagtttcttatatgacggttataaagaaacgtatttactgaacgatctgagaagaaacgaaattgtaccgggtatttttgccgaatatactttaacaggtttaaaatatactttggtagcaggttccagagtagattttcataatctggcaggaactcagtttacgccaagacttaatttcaaatatgacttcacgcctcagacaattttaagactttctgcgggaagaggtttcagaacagcaaatgtatttgcggaaagccagcagtattttgcatcaaacagggctatcaatattttatctaacggaggaaatatttatggattaaagcctgaaattgcatggaactacggagcaagtttacagcaggaatttaagttattcggaaggaaatcaagcattattgcggacttcttcagaacagacttccaggatcaggtattggtagatctggatcaatctcctcagcagctgacattctataatctggatgggaaatcttttgcgaattcatttcagacccaatgggacttcatgcctgtaaaaaatcttgaggtaagactggcttataaatattatgatgtacaggcagattatatcggtggaagaagagaagttccttttatggcgaaacacagaggatttgtgaacttggcgtattcaaccaataagaatgataacggcgggttctggagctttgatactactttaaactgggtgggaaaacaaagacttccggatacatcaacgaatccggcagagtttcagctgccagcctattctgaatcttacgctgtgctgaatgctcaaatttcaagaaatttcaataaaaagatcagagcatacctgggaggagaaaacctgacttcttattatcagaaaaatgcgattgtagattttaagaatcctttcggaagttattttgacggcggaatggtatacgctcctattatgaaggcaaacttctatgtgggactggatgtgacgttttaaaggctggaagcttggagaatgaagctgggagtaatgctagtcggtaatgttcttattttgagacaaattactggaaggtattctctgactaaaacaaaaccttataggtctttgagacctataaggtttatttttttgctactagcttatagatatataaataatgaaggagaataaaaacttctgatcacttccagaaacttccttcttccagcttcaagcttcctgaccccaaaaaaaaacagcttcaaaattgaagctgttttttgtattttatcttccaaagtcatcctgaactcttacaatatcatcttcgtcagaaggattggatgcatcggtatgttgccagatttcagcgacaattccccaacctgcaagaccgattaatctgtgtctttctccttgctgaagtttcacctgatcttttggaccatattctcctaattctccttcttcatcggtattacttcttttgatgcctacagttccttccactacctgccagatttcggctcttctgtggtggtactgccagcttaatcttgcttcaggggcaacaataagaattttcgggcttagcttccctcctattctaaggctgtctacatcaattccgtcaaaatactggttggcgaagtcctgtgcctgtgtttcatcaatcacaaagaaacctccccatggccttgtatcatcttttgcagcgatcgtaaaaccctgtgtctgcagcatattctctactctttcgaatatttcttttttttctgtactcatacagctatatttttaattttaaaattatttatttgattcttcttttgacattgaatacggaaagtctttttcctgtgaacctctttctttattgggtttactatccattttaaagtctaaaacagctcctttcatcagttctttatgacttagccagtttttggaataaggctgctgatttacattcaatgattttacatataagttttcagcagtattttccggagcttttatttcaattttcttaccattttccaaatggatggtagcttctttaaacaaaggtgctcctaatacatactgatctgttgcaggtgttaccgggtaaaatccaagggctgagaaaatataccaggcagaagtttgcccgttatcttcgtctccgcaatatccgtccggtgtagcatgatataatttattcatcacctgtctcgcccaatattgggttttgtaaggcgctcctgcataattgtacagatagatcatgtgctgaataggctggtttccgtgggcatactgccccatattcatgatctgcatttctctgatctcgtggatcacacctccataataactgtcatcaaaaaccggaggcaatgaaaatacctcatctaatttggcttcaaatttcttttttccacccatcagctctgccagaccttcgatatcctgaaaaaccgaccaggtgtaatgccagctgtttccttcggtgaaagcatctccccatttgaaaggattgaaaggtttctggaaattaccgtctttatttttcccacgcatcaagcctgtctccttgtcgaatacatttttataattataagctcttttcttatagatatcaatttcagaagcgggtttccctaatgcttttcctaactggtaaatagaaaaatcatcatatgcgtactctaatgttctggctgcattttcattgatatttacatcgtaagggacataacccagttcattataatactttacccctgcacgtcctacagcttctataggtccttcattatctgctccatgttttacagcctgccaaagcgcttcaacatcatacccgcgaagtcctttgatataagcatctgccactacggatgcggaattgtttccaatcataatatcggaatatcccgggctgctccactccggcaagaatcctccttctttgtaagcattggccaatccttcctgcatttctacattgatgcttgggtaaacaaggttcaggaaagggtacaaagcacggaaagtatcccagaaaccggttcctgcaaacattcttccgtcaacaattttaccattataagggctccaatgttttattttgttttgagcatcaatttcatataacttttgcgggaagaataaagttctgtataaagaggaataaaaggttctcatctgctgatctgttcctccttttacgtctatttttcctaatgttttgttccagatatttttagcatcggttttcacctgctcaaagcttctggtaccgatttctcttttaagattcagttctgcctgttcaaagctgataaatgaagaggctacttttgcataaaccgtttctttatttttaagcttaaaacctactactgctccggtatgatcactggtaatttctaattgatcattcaccagtttatcatctttccaggtttttgtgagttcaaagtctttatcaaactgaatgacaaagtagtttctaaaattctcatatttccccgtagaatatctcgttgtgtatcccaggatttttctttctttcggtaaaattttgatataagagcctttgttcagggcatccacaactacataagcactatctgttttgggaaaatcaaatttaaaataagaagctctttctgtaggggtaaattctgttgtaacattgatgtcagccagataaacactataaaagtatggagtagccacctcagctttatgactgaaccagcttgctctttcgtcttctttaaatttcacttttccaactcccggcatgatggcaaatgcgccataatcattcatccatggagatggctggtgggtctgtttaaatccttttattttatctgcatcgtaggtatatgcccatccgtcacccattttaccggtctgtggcgtccagatattcattccccatggaagtcctacagcaggataggtatttccattggataatgaaggtttggattgtgttcccatcaaaggattcacataatctacgggagatacattctgacctaaagcccaggcctgtaatagcagtaagcaagtggaaaatataaacttcattgtatcttttcgtttgttaatttataaaagcttttttaatgcatagctggcagctccaagaatggccgcatcttcaaatatggctgaaattttaacctgcaagttaatattattctttgttaaattctgaataaatcgttgttcaaaatgaggataagccttggcaatatttcctcctataactaaaacctccggtttgtaatgatccacatatttcacaataaattctgagaaagagtctgcgtattcatcaaacattcttttctgtatttccgctggtttattcagaaggtcttttgttcctgaaatttcttcaccagtaagttctttataacgattcacgaaccagcgcgtcgccagatattcttcactgatagagtctttaaaaggagaatcccacaagtcttcatcggtagctaattctccgttatagaaagttgttcccaatcctgttccaagagtgactccaaatatcctgttgaatccctgagcacaccctccgaatacttcaccttccataaaggctgccgcatcgtttacaaaatgaatctgtttctgagaaatagccagtctcttcgccagttcttccttaatatttacctgatagatatcgataaattttccatgctgcataagggatatcccattttcataatcgaaaggtcccggcattgcaataccgatcaggagatcttcttttaccagatcatgagccactttatgaatggctgaaacccatgcttcaaaaataacttctttattttcgaaagcatctacatgttctcttacataagtggaagaaataatttcacgtttttccggatctacctgagccagcgtaatgtgcgaccctccaatatcaattcctactatattctgcattattttttatttttaatttcctgtgactgaaaaaacagacaaacagaggcatcctcctgtctgtctgctttgtatttcagactttatattttcaattctgataactacatcattatctgaattttacttcacgattactttacccgttgatagtactttattgtttgaggatgtaattttgtaaatataagtaccgctgattaaatcctgcgtattcactgcattattattttgattaatattctgttttttgaataattttcctgaaatatcatacaaggctatctcagttgccgaattatcactaatagcaaagtgaatgtcatttcctctttttacaggattcggatacagtgtgctgttctcttttgcagattcaagatcttttaccgcaagagatgaagtacaggcaacgtctgttctccagttcgcatctgtcatattgatcagggttgcaaaatgggtatttgccgtagcatccaaagctcccattccactgccttcatccattttccaattggcttcaagccccgtggaattgggaggaacattacagctgttacttaaaatttcctgtggggtcagtgctcgtttccaaactctgaattcatcaaggaagccgttgagtgtacgggaattgtcatagtttcttcccagataaagaattccgtttgctgtaaagtttccggttacagcaaaggtcgcatcaagattaccgttgacataaattttcatggttgcaccatcataagtggctgctatatgataccatgtattggtgttgaatgctgtattcgtattcaatttcacctgtgatgaaccgaagctcaaaatgaattgaagcttattattcgcgaggtttccgtctccgaaacgaagcatcgcagagttattatctcctacttccactcccaatactgatgaaatgtaagggaaagctgttttgaaagcatttacttttacccagccttcaaatgtcactgcatttccgctcaggttaaattgtcctgcattaagatagtgcgtgcttccgttaaaagaaagtgatcttgctccgggacttgtaaccggtgcgaagccactattaaatgatccttctcctgaataggtacttgcagttcctcccgcacatgaagcctgtactttccatacatagtttgtattaggcgttaaattctgtaatgagtaggagttggtggtgatattcggaatttcagaccatgatgttgctgaagctgttttgtattgcaatgtatatgaagtagcatttcctgcatcccatgacagttgtgccgtattaccaaggaaacctccggaagttaatcctgatggtgtagtgcaaccacttccggagttaaaccttggtgcaaaaatataagtacttgttaatgtcggtgagcaattggactgaattctccagtcataatctgtattcagggtaagattattgatgacaatattatttcctgaataattgctggctacattcgtccatactgttgagttgaccggtttgtaatcaatattataagattgagaagcattggaaatccagttcagttttgctgaagttcctgttacattggaaacatcaagtcccaatggcggatcacaggtttgcccctgagaccatgaatatagctgaccgcttaagagcgtattttcgttgtaaaggatattggaacctgtgctcagataactggctacattagttcccggcaaatcataccacataaatactccatattggtcattcttggtgctggtcgctaagcttgccaatgttgttgcagatgtagaacctggattcgagttttggatccatgttgctgcagcagaaattttagatttatcaagaggtggaacaaccggagcattgtaagtgctgtacatcgcattccatgtataattgatataatttcctgctaaatctccgttataactctgccttgtggtagccggaccgtagtaataaaaggttatcagcttatccggcattgcggctttcaattcctgcaaaagcattacaaaagaactgttattaggctgtcctgttccgttatttccgtatcctgcatattcatcatcaaggtccaccccatccagtccgtaggtataaacagtatgagccacctgcattgcgaaatcttttgccgctgcacggtcaggaaaattggagattcctgctccctggtggtttcctaaaagatccagcaatacttttattcctttttgttgtaaaggttttacgtaggtattaacgtcgttcaggactttggtaacgttgttattgtttgagatataagctctgtttttggaaacatcataattgatattggctgcaaagataatcgcaacatcaaaaagctgtctgttcgtattctgcaaggtatatgaacctgcattcagcatattattgttgttcacttccacatagcagactcccaaaggatcaagctgctgtgctttgagcaatggagcagattgaagcatgagtgccattaagggaataaaaaaggatttttttctcatagtatatcaattttatagtagaaaaaatcattgggccgaagcccaatgacctggttattattttacaattagtttttctgactgtttcaggtttccgtcatgagattcaaactgaacaatgtagtttcctgctgaaattctgttcaattcatattgattgtttcctgagttcagtgattgtgtgtctacaattcttccgttataatcataaaccgttaattttcctttactatattcatccggaacagaaactgtaagtgatgaagatttgcttaccggattaggatataatttgatttgatttttaccgtttacctgcccttcacttattgccttttggctcgaagcatttcttgccaatagtgaacttcccgttgcacacggcagatctgttccccaattagaagagtctacgcctgtcaacgttaaagtcactccgtttcctgaagtatcctgaacggtagaaccacttccttcgttaaacttccagtaagcagccagtgaagtagccggaacagatacattacacatattctgactgatttccgtttggcttagtgcacgtttccatactcttacctcatctatttttccattgaagttccttgacgtgttgtataaatatcccacattgaatgctcctgttgaatttacacttccggtttgagctttagtggcatccagaacaccattgatatagattttcatattggctccatcatacgttgcggccacatgataccatgtattggcatttaaggctgttacagaagccagtttttgctgtacattattgatacttactacaaactgaagtttattattggccagactggcgtctcctaatcgtaagaatgcagaattgctgtcacttacttccgttcccatgattgaggaaatgtatggcgatgcagatttgaatgatgaaggtttgatccagccttcaaaagacaatgctgaaccgcttagattaatacttccggcagctcctgattctgtacttccatccagagataaggcataagatcctgtaggagtggttcctgaggcactggtaaatcttggtgcaaacatataggcacttttcacgctgcaattggttctgattctccaatcataatcggtattggctgttaatccggaaatcgttacagaagtagagctcgttgccgttaccgcattcgtccacgtggttgaagaagcgggtttataatcaacatcataggtattggttcctacggctgaccaattcagttttgcgcttgttcctgtaaggttgctagtgtacagtccgataggggcatcacagtttgtaccctgtgtccaggactgtaaagtaccgcttaaaacagttggttctccgtacaatgtctgagttcctgctgaaagctgtgctgtttcattggttccatgcaaatcataccacatgaatacaccgtagccgccatttttggtttgggtagccaggctggtggtggtagaattggaagtatttcccatccaaaccgctgcaggagaaatttgtgctttggtgagcggaggtacattgggagcggagaaggttccatacatcgcattccaactgtagttaacattatctcctactctggctccgttccaggaaagtcttgaagctgcggggccataatagtagaatgaaataatcttattcggtaataaagctctgagttcctgaacaagcattacaaaagagctgtcattaggctgtcctgttccgttatttccatattctgagtattcatcatcaaaatcaattccatcaagaccataggtattcactgtattggcaagctgtaatgcaaagtcttttgcggcttcacgggtaggaaaattacagattcctgctccctgatggttccccaaaatcgtcagaactactttcattcctttctgctgaaggggctttatgtaggtatctgcattggtaagaactttggtaacattattattggaatagagataggctcttccacggctgatatcataattaatattggccgcaaagatattcacaacattaaacaggtagctgttcgatgtctgcagtttgtacgctcctgcattcaggaggttgttgttattcacttccacatagcatattccggtaggattaagctgttgtgcgttgatcagagaacctgactgaagcatcatggcaatcagtgcggtaaagatggatttttttttcattgtataatttttttaaggtgttttggtgtctgaatttgatatagcattcccctgatcccttctttttggagaaggaatctcagataaatatgccatataaagtggtgtgctatgtcagtagctccgggttttcgttaaaggttttccataacaattctccaaataaagtattggcccatgcaaaccattctctggtgaactttttggcatcgtctttatggaaggattcatgcataaagcctgtcccgccgtgcgttttctgtagagtatcaatacaccatctgatctcacttttatctttggtagtgagtgccttcatgatgatactcattggccagatcatatctaatcctatatgtggccctcctattccttccgccagcttacctttgaagaagaatgggttgttttctgaccacacaaattttcttgtattcagataaacagggtcgtcagctttcaccgcatccagataaggcagtcccagtaagcttggacagttcgcatcatccatcaggttatagcttccgaagccatttacttcaaaggcatagatttttccaaattcaggatgattgtaaattccatattttttgatggctgcatctacctcatcagcaaggctgttcaactgctgagccaacgttttttcatttttaatctgagcaaccatttccgcagcctgacgtaagcttaccaccgcaaataagttggaagggatcaggaatccgtaaatggtagcatcatcacttggacggaacatagagctgatcaaccccacaggttttgttgggtaaccatatcctcccataggaacgccgtctgttgcccaagccgttgtacgctcgaatttgtaaggtccaaggtcatgttttctctgctgttctgtaaaggtctgcagggtaagctgaattcctttcagccagttcgcatcaaaaggttttgtatctcctgttgttttccagaagtgataggccagacgtataggatagcaaagcgaatcaatttcccattttctttcatgagtacccggcttcatatcggtatggtcatattctttccatttgctgatcttttggtcatcgttgtaaaaagcgttcgcataaggatctttcaggatgaaagtagtctgcttgtggatgactcccgagatcaacttgtgtagcttttcatctttcttagagaactgcaggtaaggaaaaacctgtgccgagctatcacgaagccacatggcatcaatgtccccggtgatgacgtaagtatccggagctccattggtttctgtatagtaaacagtagtatctaatgtatttgggaagcagttttcaaaaagccagctcagctccttgttttttactttcttcttaaacgctgcaatagcactttctacggactcgctggtaaaatgtcttttatctttaggaacacggacaacaggaaaatcgtccagtactaaatttttggcaaaaacattttgggtaaacagcaatccggctcctgccagtgcacttgttttaataaaatttctcctttccattgatacttttatttcgtttattgtatgattcttattttaccggtttacttcccattacgaatctcagttcgccaccgttcatgatgtcgctgtggttcagctcccagcttttgtattcttttccgttcaggaacattttctgaacatagatattcttgtcagagatcttgtcagcgattacagtaaaagttttcccattttctaattttaaagaagctttcgggaattgtggggctccgatggcataaacaggtttcccaggtgttacaggatagaatcctaatgatgagaagatataccatgctgacatttgaccgcagtcttcattattcacaattccatcaggttttgctgcatacatattgtcacggatgtattttaccattttctgagtcttataaggacttcctgcatagttgtacaggtacggaacatgatgtcccggttcatccccaaatcccaaagatccaatgaatcctgagatatctacgtgctgctctccttccatgtgaagtgcttctgtgaaggttttatccagcttttcttcaaatccttttttcccgccatacaaattcatcatttcatcaatctggtgcggaacaaagaaatcatacgcccagatattcccggaaacccagtgtggctgaagttttttccagtcattaagaacaaaatccgctaagaattttccgtctttttgtcttggccagaagtgattattttctttgttaaaggtattcaggaagttcatagaacgttttctgtaaacttctgcttcatcttttttacctaatttttctgccagctgttgaatacaccagtcatcataggcatattccagtgttgctgaaactgaagcaccgttttctgatggtgtgtatcctaatctgatataatcattaagacctccgccaccgtcgctgctgctcattttatccgttaaagaagcatctttcattgcagcaaatgctttttcggcatcaatgccgggaaccccttttgaaatcgcatcccagattaccgaagcactgtgatagcccagcatacagaagttatcatatccgcaaagctcccagatcggcatatggtctttacggtctgtatatctgcttattaatgaattggcaaattcttttgtatgcttctgatccataatggtaagcagcggatgcgttgctctgaatccgtcccagtaagaatatgtactgtaattcgtaaaccatttcgtattcatgttttcctgagcggcaacataatctccattcacgtccatataaaggttgggtgcaatgaaggtatggtaaacgcctgtgtagaaaatttttctctggctatccgttcctcctatcacctggaaccttccgataagatctcgccaggttttttgtgccgtttccttcgctttggcaaagtcaacatttgttgcttctgtatcaaagttttcctgtgcattttctgtgcttaccggagataaagatacttttacctcaatgctttcctgatcttctgttgaaaatcttacaaacgctttagcatctttggcaagggcaattttttcatcatttttgatttttccgtcagcatacacaccgtaagacttaaacggtttggaaaactccatcacaaagtaagcaaaccgtttacctccccagccattgctgtagcagtatcctttgattttattattgccttccacactcactaaagtatggtagatatttccgaagattttattggtaggatctataatgatattggcttcgctgctcttcgggaaagtatatttgtgaaagcctactcttggagaagcagtgagctctgctttaattccatagctgtccagcattacagagtaatatccgggagacgctacttctttatcatgggtaaattttgaacggtaaccagtttccgggttttcttctgatccgggaaccatttttatctgtcctacggtaggcattaccagaatatctccaagatctgcccatcctgttccgctcaagtggttatgactgaatcccatgatggtcttactgctgtaatggtatccggaacaccagtcccagtcgccgcttttagtattctgatccggacttaactgaatcatcccgaatggtgtggttgccccgggaaatgtatgtccatgacctcctgttcctatgaaaggatctacccaggataaaacatcatttttattttgctgggcattagctacagaaatcaaggtggtaaaaaagcagattaacagttcttttttcatgataagagaggtatcggaatttttttgttttaaagttggtttaaaaataggaaaaccattatacaattcccagaaaacaaaggaaaattaaaatgattaacctatttttcctaaacttatattactgtattaaattgaattctttttcataaaatctataatttctgagatatatccaaaagcaatagcaaccacagtatcagcagcaccgtaatataccgttactttatctccttctgtcaatgcggcgcaagggaaaaccacattgggtacatctcctgtcagttcatacaattctgccggcgccaacagataaggtttcgtcctgtacaataccttcgtaggatcttcaagatcaagcaaagccgctcccattgaatatctgaatcctctgcacgtattgatcactccatgatagaaaagcagccatccttcttctgttttgataggaaccggtccacctccgatttttgtacactgccatgcactgtcttcaaaaggcgttactttcatcacgcaacggtgttctccccagtatttcatatcagggctgtagctgatataaatatctccgaaaggtgtatgcccgttatcactcggacggctcagcatggcatatttaccattgattttttcagggaacaaaactccgtttctgttgaatggaagaaaggcattttcacactggaaaaattctttaaaatcaaaagtatacccgatgccgatggttggaccgttgtatccgttacaccatgtgatccagtaacggtcttcaataaaggttacgcggggatcatatttgtaatcggattcaatcatatccgtatttcctgcctgcatttcaataggatcatggttgatgtcccaattgattccgtctttactgaagccggcaaaaatattcatctgcacggccttgttatcacaacggaatactccggcaaatccatcttcaaaaggaattaccgcactgttgaatatactgttggatgttggtatcgcgtatctgttaatgatcgggttttcggaaaacctccacataatatcactgcaaccttccgggcgatcctgccaagggatcattactgattgagctgtcataaagtttttaactttttatttaaaatttgtttattaattgtgttcttgttctttctgattttcaggataagggaaaggaacaaatagggtgaccaaaaatgcgggaatggtagcaatcaacacccagataaagaacattttatagcctatccagtcactgatcattccgctgaacattccgggaatcatgacaccaaggttcataattcctgttgcaaatgcataatgcgctgttttgtgttttccgggagcaatctgctgcatcatatagagcattaaccctacaaagccaaatccatatccgaaatattccactactacagcaattcctacaggtaaaagatcggccggctgataataagccagtaaagcatataccacaaacggaatattaaatgcacagcacagccatatcagagatcttttcagtccacgggctgagataaaatatcctgccagtacagagcctaagataaatgctgcagaaccataagttccatacacaagccctatatctgatgtggataatcctaatcctcctgatgatcttggggctttaaaaaataatggggcgattttgatcgcgaatccttctgcaaaacggtacagaataatgaaaagcacagaccatacaatattttttttggtaaagaaagaggtaatgacttccaataattctctacggacatttccggctgttttttcttttttctgctcttctttattttcgttcggcagaatgaaatagtgataaatggctaatgcaaaaaacagtaaggcataaatcgccataatgatcatccaggcattggtaattccttttgttttttccaaaacgccggcaaaataaacgagcgctccactgctgataattttagcaagattataaaaagcaccctgccagccaatatatcttgcctgttctttattggtcaaaaagccaatatacgttccatctgctacaacatcatgggtcgctccgcaaaatgccactactgcaaaaagggcaatactgtatttgaaaaagtcgtgcatcggcagacttaaagctatcagagcaaacagaattcctatggcaaactgggtaaaaacaacaaagaactttttagttttataaatctccagaaaagggctccaaagcggcttcaatgtccatgcaaacagaataagcgctgtccagaatgtgatctgcgaatccgaaacacccatatctttatacatgattcctgaaaccgcattaatggttacaaagggaactcccattgcaaaatataatgtggatatccagagaattggctggatccgacgggttccggaattgttttttcccatatttaaaagtaagattctaaagaaaaagagaacatctcaaaagattcattcaggcttaaaaaacgaaactataaatttttcggaggttctactctatcctcccgcctcaatgtttgtttcagaaaaaaaactgattttgagatgtctctttattaatgagtgattctgaatatttttatttcttatcccaccaaagcttggttccgccggtatcagggccgttcagcatttgagcagcctgctggtaattatacaatgatgttttggtatcaatagtgaaaggaattcttctgatcattgcctctgtactgatggctcctccactatcattttttcttaccttgaaaagaaccggatatcctgttcttctctgctctgcccaagcttccggtccgtttggataaagggaaagccacttctgggtaataattctttctaattttctttcgttagtatcactgttattccatgcaatggtgatggtacttaactgtggatttccaacaggcacgttattatccggatttttcggatcaatataaggagcttcagtagaagttgtatcagcaaggtaagcggcaacgcttgcactttttccccattccccgaaagactgctgaaccccagtagtatagttggtttgaatatcacctgctcctgcatatcctctcaaagcagcttctgccttcaggaaccatgtctctgcagcggtgaataacttcattttaccatcggtaccggaaaaataatctccgttggcagattttgcctgtggctgtgagaaccctccgtatgttgatttaccatttaataaatcaattccctgacggattcctatatattttccctgtaagcttggatcagatgccggaatagcataagcaggaagccttgggtcattatacccgttcatataagccatcaatggtgcaccaattaagcaatctccccatgaatagataataaaactcaattctgattgtccaacgctgattaaagcattatccgcattatcagtaatcaatcctgcagatgaagctaatgcctcttcagcatattgcttagattttgccggatctgcataactcattctcatcgctaatctcagctttagtgaattcgcaagcttggcccattgagaaatatttccattaaatacaagatctgcttttttcaatgcagccttatcaccttcattttggttagctggcatattctgcaccttttgaaggtctataatagcagcactaagatcattaataaaatgcaggtaagcctcctgttgagagtcaaaatcagtgacaccgtttgcattaggtgtctcatatttgctgtacactaccggaccatggctatctgatactctggccgctgtgattacttttaatattttctttaccgcaaatgtagctgtaaagtctacgtcaggataaaagtttttagctgcattatctatgatgatggaataattgaaaatatcctgttgtctggcaataattctgttgttccaaccatccatcatgaaatatgtcaaattgttcttccctccattaaaaggagttgctgtgctgaacataccactgaacatatctgcgcttaaattaggatataactgatagtctgactgtaatcctctttgaatagattttaaaggattaacaaccgcattataatcagcataaaaaatctcgggatttccaagtttctcctggttatattgatcaagatcaccgcatcctgaagctgtcatcagaactaccgcacctaataccagtattttaatattttttaatttcattttcgttaaattagaagttagcctttaatgatagtccgatagatcgtgtaattggaagtccaaatgaatcaactcctaccccacctggtgtatttccggatacttgttccggatcgaatggagcttttttataaaagaagaataaattggttccaacaagacttactgtagcatttctcatatatttggaattaatatcaaagctatatgaaattgatgcctgacgtagacgaactgttgttgcgctatacagataagcttcatcaattcctgtcccgataccaccggcaccacctgttcttttataataagcttttgcatcagtaactccattataagcctgtccagcattaggagtgcctggagcatatacagcatttggaatagatactccgccggcgtctcttgcatcagcagtagcctggctcactccgtataaatcatttgctttctccgtaagagacaatactttgcctccaaatttaccatcgataaggaaagatattcccagtttaccaatattaaaagagttattaaaacccagaataaacttaggattcgggttgcccaaatactgaggatctcctgtagtacccagaggaacaccattttcatctaccaagattcgcccctgatcatctcttttgaatttaactccgtagagatctccaaatgatccacctaacctcagttttgtaaagtctcctcctcctgttaatgcaaacagctgactttctgatatgggcagacttgatggaaataattctacaatcgtattcttattcgctgaagcattcaatgtagttgtccagccgaatttttcgccaccaaagattttgtatgataatgaagcttcaaagcctgtgttacgtattttcccggcattaatataatatgaacctgacggaattcctccaaagtttgaccctatagtagtttctaacaactgattagttgcattggaattataataagtaatgtcaaaatttaatctgttattgagcattctcaactcagttcctgcctcaaaagttttattaagctccggtcgcggaataaggtctggacggctggtaacaaatgaactttttggatatacaatagttcctgcatctactccatacgaatatgcattgtaatatgccaccattgcattagaaatattggcaggtaatcctaaccctacagttgcataagaacctctcaccttccagaaattaattacttccggaagtttaaaaatagaagataagatcgcattagctcctacagactcataatcaaatccgcttcttcctgttaatgccaaagtagaatcccagtcatttctaaaggtcatatctacataaaacatatttttatatcctacggaagcacttgcaaataccgatcgtacttgtttttttaaattccaatagatattgtggtatccatctcccggacttctttctacgttccattgaaggttgtttaatgcgaacaaattaggattagacagatatgcgttatcaacctgtgttactttattactggttgtattcacacttcctccaagcgtaaaatctaaagaaatagattcgcttaattttgggctaccaacaagcaaaacatcaccgtaggtagaagaattttcataaacatttttaagcattcttccattttgtccacctgctaataaacttggtgctgagtatgcagaaatatcacgctggctgtctgaaatattccagctgtaattacctcttactctcgctgtcagccatggattaatttcataagataatgtaacagcactgtatgcatttttatttttaaccgtaaccgggtttctgtttaaaatccaatatgggttttgggtttccggatttcctttgaaacttccgtccggtttcacttcccaccagttttgtgcaggtaaaagccttttcttatcaaggtaagagtagttatccggtccgtattgatcaaaatctactcctcttggtaaccagtacaagcttgtcaaaggtgagaaagaagctcccggtgtttgtctgtttttactgtcctgcaaagaacctataaagttggcatccaatgtcaatttatcatccaggaacttacttgagtttctgaaagaaatattatattgatcaaaataagacatcggaattatccccttgtttgtcgtatttccaacggaaaaataattggttgatttttcatttcccgattggaaagaaaggctgtttacccatgttgttccggtttgcagaaagtctttaagatagtccttcgatgctccttttgctccccagctctcaatgttatcgcctggagattgattaggcacagagggatcataagacagataactgtgctgcagttttggaagactataagctctgtctactgttaaacttgtactgtaagaaatagaactcttgcctaatttcccttttcttgttgtgatcaggatggcaccgtttccccccgcagatccatacaatgcagaagcagaagctcctttcagaaagttgatgctttcaatatcatcgggattaatggaacttagcacgtcgcccggatccggcatattggaatactgacttatatctgcagatttccctgtgccattgatgattggaattccatcaattacatatagtggctgactgtttgatacagacttattccctctcataatcacccttacggagcttcctacaccattggttctgttaatctgtacgttggaaacttttccattgatcgaatttaatagattgggagttttcacttctgtaagctcatccccgccaatctgctgactggaatacgtcaaagagcgggcctgtctttttatccccaaagaggtgaccacgacctcctcaatactggttgtcttcgtagtgtcggctgattttttctcctgtgcattcgcagtaagtgaaaaaacgaacagaacgggtataactgcttttctcataaggtatagattcgttagatttaattgagaatcagtgacatcactttatttttcaatacaaaaaaaattattgttttttcagcaaaattttttcgtttatgtattaaattatttaaagttttgttaagatttaattcacattcacaaatctaaattttgtatccagtctgatataatactattttatcataaaacgatattattttttcagtatttttattttaacacaactaacagattaaatatcaatacaataaactactttatcaacaatcagaaaaataggatttatcttagttttcgccaaaataaagccggatacgaatacccggtttccattacgttttatgctgaattaattactatctaaaagcaaattccaaaaatcattcgatttttttcactcctttaaattgttctttaaattcagttggtgttgtctttttgatggacttaaataccttattgaaattggcaatattattaaaacctgcttcaaaagcaatttcgaaaacagtaagatttttctccatcagccagcgtgcagcatagctgatccttatttcattcagataattgacaaaggttttccctgttctttttttgataaacctgttgaatgtaacattactcatattcaccaatgacgctactttgtccagtgttattttattttcaaaattcttgtgaacaaagtcatgtataatcttcatcttgtcattatcatcaaaagtttcaagctcaatactgtatgatgaaagaagcgttttattttctgcaacagcaagttcattcagaattttcatgatctctatgaaagattcaaaactgttcatcttcgacaggttgagaaacgagtcttttagtttttcagctgtttcctcagaaaaaagaatacctctgatagagtccttcatcagattgttgatgggtttcagaatatttttctgcatcatggactgattaaagaaatcctgattgaactgtatggtgatttcgtgggtttttctgtttttacaccggtagtttgcccagcaatgcggtaaattaggtcctacaagaaccaattccagattaccaatttctccggtatgatctcctatcatcctgcgataaccctttcctttataaacaaaattaatttcaatctcaggatggtaatgatagggaaagtcaaaagaggctttaatcctgtcaaatacgagaaagctatcctcaggagatagtggagttatttctctcagaatgttttctaatttgctcatataggcagttttgaaaaaaggggttacgaatagggatcacagtacaaatctttgtaaaaatgataaaataatatcaatgtaaaaactaattttcgatttattttgttccaaattctgtagatcagatatcataaatttgggttttcagtaatttaatatcgttcaaatcctgcatttttgtatctttaaactaaagttaaagtatgccgcaaccgcttatttttgaagatcattataaaagactcggactggaggtattttcagagggaagcctgaaggatttcagcggggatcggttcagaacagatattaaaatattttttattcctgtcggatatgaacttacggtcgattttaaccattacaaaacccaaaaaccttccctgttttttctaaccaaccagcatctgagcatacaaaaagggaaagaggtatcaattctccttttttataaccgcgatttttactgcatccagattcatgataaagaagtggcttgtgacgggctactctttcataatgtatttgaaattccttttgtggagcttgaccattctgaaacggctcttataaaatccctgtttcagaatattcaggatgaacttgaatggaaggattcctcagcagaggaaatgataagaacctatgtaaaacagattatcatccgggctacgcggaaatggaaaaaacaaaatttagataatgatactttaagaattcctggcagcgagcttgatattttcagggatttcagcaggcttcttgaaattcatttcagggaaaagcataacgtcgctgattatgcagaactgcttcatatggctccgaaaactttaacccataaatttaaacatctaaatctcgaatctcccaatcagtttatcatcaacagaattttactggaagcaaaacgattgcttttttatacagacaagcctgtaaaagaaattgcctacgacctgggatatgaagatccggcttatttcaaccgccttttcaccaacaaaacaggaaatacaccagccaattttaaaaaaaattacacttcgggaaaaaagtacaatatttaagtcattttatctattgaaagatccttatcgtagacatacctttgtaacatcaaaatcaaacaatattaaaaataaaaaacaaacattatgagacgtaacgcaacagccgtttggaacggtactatcaaagaaggaaagggacacttaactactcagagtacaactttaaaccagactcaatattctttcaacagccgttttgcagatggtgtagggacgaatcctgaagaattgctggcagcagcccatgcaggatgtttcactatgaaattagatgcagagctttcacaagccggatataaccctgaagaattaaaaacaacttctgtcatcactttagatcctaacattggaaagattacaaaatctgaactgacattaaccgctaaagtaccgggaatctcagaagaggaattccagaaatttgctaaaattgctgaagagggatgtcctgtaagtgccgcattcaactttgaaattacattgaacgctactttggaaaactaatccaggttttcattcaacatcataaggaacgggctaaagcccgttttttatttaaaacaggaatccattgactttgaccaaaacctataagccacatatttatctgaataaactttccatataaaatataccaaatggtatatttttgtatatttgcatcatatttaaacatttataatgtcgaaggcagaaaaaacaaaacagcatatcattgagaaaacagcaactctttttaataccaagggttacatttccacatcgctgtcagacattacccaggcaaccggactgacgaaaggcagtatttacggaaattttgaaaataaagatgaagtggccattgaggtttataaatataatgccggagtattgagtaaaacgctcagccgttcctttggtgatgaattccccacgtctctggataaacttcatgcatttgtagatttctacagaaaaaactggaagtttgtctttgcgaacggaggatgtcctttgatgaatgctgcaacagaagcagatgattcctttccagccttaagagcccaggtaaaaaggtcttttgagcagtggatgataaaaatatcagatacaattacagcgggacaaagtaaaggggaaattgataaaaagatcagtgctgaacagtatgcttctcttttcattatgcttattgaaggcggcattctgctgtcaaaaacaatgggtgatcaaagttatctcaaccatgctttagataaagttgcccaaatgattgatcatgaactcaacattcttccatcataaataataccatatggaaacaaaaaaagtggctattgtaggatacaacagaattccttttgccagaatgaataccgcttattcggaacaggggaaccaggatctccttcttgcttctctgaacggattgatagaccgttatcgtcttaagggaaagcgactcggagaagttgccggcggtgctgtaattaaacacatttctgaaagcaacctcatcagagaaaccgtgatgaatacaacgctggatcctgcaactcctgcatgtgatcttcaacaggcatgcgacactggaattgaggcagccatttatattggaaataaaattgccctgggccagatagactgtgggattgcatgtggtgtggaagccatgagcaatattccttttgaatcttcaccccgtttgagaaaagccctgctaaaggctaacaaagaaaagtcagcattcggaaaattaaaacaattactgagcccgaaactgaaagactggatgcctattccctataaaggacaggaacccaagacaggccttgttatgggtgagcatacagaaattactgcaaaatattacaatatatcgagacaggaacaggatgaattagcattaaaaagccatcagaatatggcaaaagcttatgatgaagggttctttgatgatatggtcactccagctttcggtctggataaagataataacctaagacgtgacagcagtattgaaaagctttcacagctgaaacccgctttcgacaagcagaacggaactttaacggccggaaattcaactccatttacagatggagcttcagcagttttgctggccagtgaggaatgggcaaaagccaatgatcttcctgttttagcttatatcagcttttcagagcttgcgggaatagaatatgttgaaaataagcaggatttgcttctggcgccggtttttgcagcagagagaatgctgaaaaaagcaggtatgaatctttctgatttcgattattatgaaattcatgaagcatttgccgcacaggttttagctaccataaagatttgggaaaataatgagcttgccaaaaaattcggactggagaaagccctaggaaaaatagacagaagtaaactgaatgtaaaaggaggaagtcttgcagccgcacatccttttgccgcaacaggtggaagaattattgcaactctggcaaaattacttcatgaaaaaggcagcggaaaagggtttatatccatctgtgccgcccgtggacagggagtaacgatgattttagaaaaataaaaacgtaagtatggatagattagcacaattaaaacaattcatcggaaaagaatttgaccagtcaccctctccttttatgaaatggcttaatcctgttgttatttctgctgaagaaggtcagctggagtttcaatataccgtaagaccggaatggctgaaccctgtcggaaaccttcacggtggagttaccgctgctattgtagatgatatcattggtgccaccatgttttctttaaatgaaaattctttcattaccactataaataatgtcatcgattatttttcaactgcaaaagaaaatgataatattgtagccgaaactaaaatcattaaaagaggtaagcaattcgtcaatgcacaatgcgaaatatggaacgcagacaaaacaagattaatcgcaagaggaacctcaaatttattcaaaatcaataactaagtatgaagagagttgtcattacaggtctgggcgcagtgacgcctttgggaaataatgtcgaagaattttggcaaaacagtattaaaggagtcagtggtgcaggactcattacccatttcgatacagaaaaatttaaagtacattttgcctgtgaggtaaaaggctttgatccaaaagtatatctgaaccataacgaaatcaaaagaagcgatctgtttacgcaatatgcaatgtatgcttctgcggaagcgattcaggattccggactggaacttgaaaaaatggatccgttcgataccggagttatctggggaacaggacagggtggaatgtggactttcgaaaaagaagtgatggattttgctgctggtgatggtacaccacgttttaatccgttctttgtaccaaagttcattgccaatatggcatcaggaatgatttctatgaaatatggccttcagggaatcaattatactacggtatctgcctgtgcaacaggaaatacggcattaatggatgctttcaattatatccgtctcgggaaagcaaaagttatcatcagtggtggttctgaggcagctattacaccggcttctatcggaggattttctattatgaaggccatgtctacaagaaatgatgattttgcaacagccagccgtccatacgatacagacagagacggatttgtaatgggtgaaggtgccggagcattggtacttgaagaatatgagcatgctgttgccagaggagcaaaaatttatgccgaattagccggtgcagccatgactgcggatgcttaccatatgacagcaccacatcctgacggcgttggagctattaaagcaatgcagctggcagtgaaagaagcaggagccaatatggaagatatcgattacattaatccgcacgctacgtctacaccgattggagatacaattgaattaacagctatcaacaaagcatttaaaggaagcaagaaccttgatatcagtgccacaaagtcaatgaccgggcatttgctgggtgctgccggtgcggtagaagccatcctttcaatcaaagcgattcagaatgggattattccaccaacgatcaatcttcacaatattgatgagagtattcctaaggatatcaatattgtatttggtgaggcgaaagaaaagaatattaattttgcattgagcaatgcctttggattcggaggacataatgcgactgtagtatttaagaaattcagctaatctgattaaataattattcaaaatccctgtatgaaaaccatgcagggattcttttatagtttaaaacttaaaaaagcagccatttttggctgcttcaaacataacgaattatatattcccttagaaagagattgacttgaaattattgagcatccgggataaaaaaatcatccgcattttcagcaatcggaatatagagtctttcccactctttgcttttcaccatatcccagctgtgaccggttcctttaagatcttcagccagaagaaccactcccggtttaatcataaaagtagaaccatctgttactttaaatcgtatattgcctttgatggtaatcacatattgtcgtctgggtgcgggatgagcatttttttcccactcttctgttttattgctcatccagaaagttgtggtattcatatgtttaagagtaggaattttccctttctcaaaagtgcatgacccgtcaggattattaattaatcttatggcaggaataaactcagtggaggtttccgcagtgacgctcacatgattgttctttttatgttgtgcattcataaatcctacagtagttactactaaagcaaggctaaagcccttaatgatgtttttcattataaatttaatttttttatttttaattataaacagtatcgtaaaccagcattctctcaaaaaatggtttatattgctgaaccaatgccagatgttcgggaagtttcccatacgcttcaagctcctccagactatcgaattccatagaagcattataggtaaacgtgctgtctaaaacgcttctagggctggaagcagcaggttttccataacggagattcttctgataaggaagctttttaaggcctttaaaaaaattttcaaattcttttacttcagactcggaaagatcttttctgagccagaacaacaaataatggaagtacatttttttcttttttataggattaaacatgggtaaagcagaggcaaacatatttcctgaaatcagcagcaaagcagaagcctgaactgagcggaataaaaattttcttctttccattgttatgtattttaattaaaatctattctgtatttaaggacaaactgccattttctatcagaaactacggcattatttgatggatcattggtataaacgggtctgttctgagcgtcaaaggttaagcgcgaggacattccgttcaacaaaagggaaattccggcatcatagatcactgcattatcatgaaggcctttcagatctgaaagctgtattcctacagcaggctgaagctgaaggcttttcttttctttatccagataaggcagggttcctcccagttgtacataatatgtattcccggttccgataacaggcattgcatttcctgctccattcagactcgcctgggtaacatctgcagaagtcgcaggattattggtgcccacatatcggatataattgggtccatagtcgttatgcatcgccattccataagcacttattgacgttcctttttccttgttcagtggtgcgtcataaaacaaatctaccgcaaagcttttcatatcatcattcactgtatttttaccggaatccagatgccataatgcattgtgaatataatcaaacccggctcccagactcagtacattcttcttccctacataagttcctgaattaaaaggagtggaaatattttccttgtctaaaaaagcatatctgaaatatccggagaagtcttttccaggcgagttcttactaaaggaagctacattcagtttcggatcagaagttgccatggtataaggatctgccactaccagacggtaatcaaatcttccgagctgtcctttaatataggcactcaattcccttacggtataatctgttgttcccgcattggaggttgcgtaagctggaaggtcgtataacagcgtattcaaaggtcctgtagtaaatcttgaaagaccacgccatgtagaacgtcctgccccaaaagcaattttatcattaaacgcatattcagcataagcatccaaaaggtcaaaatagttactcccttttgcattgacatttacgttggtagttccaccctgcaatacaaacatcagcttttctgttggcttataagtcatttttacacgaacccttctaagcgaaaggtcagacaggtctgattttgcttcgttattgacaaggcttccagggttaagctgggtatatctggcccacaattctgcatatccgctaaaggaaatatatcttgagtgatcttcattgaaataatgagtcaatccgggattattaaaatcattttttttctgggcttctaatttccccataagtcctaataaggaaaacaacgcaattgctgtcttgaaagaggtagtcttcatatttttctattcttatcttttgttgatttcaacgggacaaaattagattgctaaaagcccgacaggtattagaaatctattagaaaccttatagaaaactattaaaagggggaatgttttctgataaaagaaaaatataaaatacctttgtacagtgctttgggaataaatgaaagtcaggcttttaaaatcaaaaaaacgtttgaaaaaccaacacccctattcatcgtatttctttatgaaaattttaattgtagaagataactcacgtgtttcaagtcttttgaaaagagggctggaaagccaggaatatcaggtgtatatttcggaagatgcagaagatgcgattatcctgctgaataaaataacatttgatctggccattacggatattatgctcccgaaaatgagtggtattgatctgtgcaaactgatcaaacagcaatatcctgacctccccattatcatgcttaccgctctgggaacgattgatgaaaaaattgaaggatttgacgccggagcagatgactatatggtgaaaccttttgagattagagagctctatgtgagaatcaaagccattctgcagagaagatcaattaaaaataaagaagcctatctgaacgatctggaatattatgatctgaagattgataagaaatttaacagggttttcagaaatggagcggaaatagaactaactcccaaagaatttaaacttctggtattcctggttaacaatgccgaaagaattcttacccgcgaagaaattgcagaaaatgtatggggaaatcattttgacacaggaacgaattatattgatgtttatattgcttatctgcggaaaaagattgataaaaattttgatcataaactgattcacactaaacccggagtaggatttatttttgcttcacaactatgaaaatagcaaccagaacagcactcatttattccattcttacggcgggtattctttttttgtttgcctatgttctttattttgtctccgaaaaaaacagagaagatgagtttaacgaccgcctgggatataaagtcatctggcggtcagagtttatctttgatgtcagaatcagtgatgaaaaaatccgcgagcttcacaagcgtaaccaaaaactattgaatgaagcagatatcagtgtttataacagtaaaaaagaactcacctttactgatgttcctcctcttaaaagcaatgacaaatatctggataaaattatccggtctaataaaaacagaatattctggcagcagggcgaccgccagtatattgctattcagttccaatcaaacggagaaaaatattatatcattggaagcgcagtagacgtcacaggaaaagctcatatttcggagtttaaaaaagatattattatcatttacatcagttcgattgtcattatttttattataggatttcttttttcctattatacgcttaaacctttaaaggatattattctccagatccgcgatatttcagagcacaatctgaataaacggctggatattccaaaagcaaaagatgagatttatgaactgacggaaacttttaattctaccttcaacaggctcgaaaaatccttcaacaaccataaacaattcgtcaccacgatctcacatgagttccggactcctctttctacgctcattgcagaactggagcttgccaaggaacttaatgtaaccttggatgattataagctttctattgacaatgcccttcaggatgccaatgacgcttcggagttatcatctgctttgttggattttgccagagcgagctacgatgtatcacagatcagttttaccaatctgcgcctggatgagatattggctgaagcaaagcttgcattgctgcagaaaaatgtcagctataaaatcggaattaattatatgggtaatgcttcagatgatgatgaaaacaattatgatttttatggcaatccttacctgctgcaggtcgctttctcgaatctgatggaaaatgcctgtaaatactcagcagacaaaagctgtcatattgaaatagaaaccaacccggaacatataaaaatccgatttatagatcacggtattggcatttcagaaaaggatctttcaaaaatctttgatcttttttacaggggttctaacaagaatttcgaaaaaggaaacggaatcggcctttccattgtaaaaagaattgtcgaaatacatgaaggcaacctgatgattgattctgaagtatcaaaaggaagtgtatttaccgtaaaatttctctctgagtcgtcctaaaataggttgacataaattaaacaatatttaatccggagagatattttatttcttcggattttttatgcactttatctggagtttgcatattaaggcttagatgtggtcttttag

SEQ ID NO: 10 - DNA, 367889 bp, Chryseobacterium sp.
tctacttgagaaactattcttaatttaaaggctatactgtagtctttttgtgtgcgcttttctctttttaatacttgatctttcataaataagtcgattagttgtcaacttatttcaggacgagacactccaaaaaataaaagcagccaaaaactgactgcttttttattttatgctttcaaccattctgaagaagaaagatagttctgatcgggataatagatgaagaggcagtttcgtcctttaatggtattaatgatagactgcgtcagctctcttggtacggcagggcatccccagcttcttccgattcttttgtgcatggctgcaaatgcatcacttacataatctgctccatgaagtacaattgctcttctgtaggcagcatcattaaagcctttgtccattcccaataatttcaaagaatatccgttatctccctgataggttgcatctgtgatataaaatccgaggctgctctgcagcgaactttccctgttagaaaaattcgtcgcaaattcttcacctgtgttttttccgtgtgccaccaatgagttaaacagaactttcttgtcttcaagatcaattacccaaagtcttttcatgttagaagacatagaaaaatcgcagatagtcaataaatgcgagtcctgggtaagcaatcctgctttttttaaattttcatagccagtcaatgcttttgagaacacttcataattcagctcatgttcagggtcaaatgcgattgattggtatagtgcttctgatgaagatatggctgttgtgcccttctcagatttcgtgtcagctgcttttacagttttcgttgttttgacattctcacttttcaccgccactcttggagaaatgtagaatgaagtcgtcaccatgtaaacaaggcccagtacgctataaaatcctttcattcaataatatataaatccaaattagtggggcaaaattataaaaacataattaccagggggttataactctaaaaagtttaacgctatttaagaaactttaacgtcctgattttgtgaattaaagtggttatttttgagaatccggaacaaattccaaactaatagaattcatacaatatcttaatcctgtaggctttggaccgtcatcaaagacatgcccaagatgggaatcacatcttttgcaaagtacttctaccctgtccattccataagactggtctcttttgtaatagacgccctccttatctgcttcaaagaaactgggccagccgcagctgctggaaaattttgaggtagaacggaacagatgatttccacatacagcacaataatactctcctatctcatcaaattcgttatattttccggtgaaagctctttcggtagcagcttcccttgcgattgcatataattccggagtaaggatttttttccattcttcattggaaacattaagttttgtggtatcagttctggagtagtatggattgttttttgcttctgtattttccataagagtttttttaatgggttcatatttctgcgtacatgcctgcagaaagaataataagatgagtgaaactaaaaatttcattacaaattttatggtttaaccgcaaaagttttgaagcttaaaagcttttttaaagattaaacggtttcataaccaaatttagtaaatttgagaatatgaatgacgaagcaaaaagaaaacagctcagaaaatataaagcgtttgccacaggattatttgtcctgatggccgttattttcattgttaccactattttacagaagtctgacaactcccattgggtcggctatgtacgggcttttgccgaagcagcaatggtgggtgcgctggccgattggtttgcagtaaccgcgctgttccgtcatcctctggggcttccgattcctcataccaaccttattgaaaacagcaaacaaagattaggagacaatctgggaagttttgtagtgagtaattttctttccccacagaacatccgtccttatattcaaaaactcaaagtatccaatttcgccggtgaatggcttggaaaagagaaaaatcaggaaatattactgagaaacctgtccgatattgtactggatattcttaataaactggacgattctacagtgagccagtttatcagcaaaaaggtatcggaaatgacagatgatattaagcttaataaggtggtcggaaacgggattcactatattcttgaaaaaaatgatcaccagaggatcatcaccaatctttccaaacagatcaaagaatatatccttgaaaacgatgaaatgattaaagaccgcgtgaagaaaggcagctactccttcattccttcttttgtagataataaaattgcggataaaattgccgacgggctttctgattttttcaaagagatagaagaagatcctcagcatgaagtaaggtcattgattacccagaaaattcatgaattctctgttgatctgaaagaagatcctaagtgggatgaggaattcaaaaccattaaaagcggtctcctgaaaaatgataaactggatgaatattccaatgacatctgggtttctatcaaaaaaacgctgatcaaagaacttcaggaagaaaattctgcattgaagaactacctttcaaaaaacctgaatgagtttgctcaaaacttaaagacagatgaaaaccttcagaataaaattgaccattgggttcgtgtgacggcttataaatacattctgaaaaacacacatcagttcggaaacctcatcagtactactgtcggtaactggcagggaaaagaactcagtgaaaaactggagctggaagtaggaaaagaccttcagtttatccgggtcaacggaacccttgtaggcggtctggtaggactgatcatctataccattgctcactttttcatttaaataaaatagattctcagaaccattattttgtcattctgacaaagaagaactttaccagtcaatactctggattcttcactacattccacaattaagtccgctgacctcaatctgtgttaagaataacacttttattttaccttggtaatctgccagctctttttagaagctcctgattaatatcgttgatcaattggggaccttcataaataaatccggtgtacagctgtactaatgtagctcctgcatccagcttttccatagcatctttagcagagtgaatccctcctactccaataattggaaatgctctgttgcttttatcagaaaggtatttgatcattttcgtacttctctcacggataggttttccgctcagtcctccgtttccgatctgttctaaaacttccggagaagttttcagaccttcccggttcactgatgtattggaaactacgataccatcaatcttcgtttcagcaatcagctcaatgatttcgtctaactgattgttattaagatccggggcaattttcaggagtataggcttctgtacagcttttgattggtttatttttttcacttctgtaatcagctctctcagatagtctacatcttccagtttcgcgtgacttcctacattcggacagcttacattcagtacaaaatagtctacataaggatgaagaccttcaaaacaatccagataatcctgggtatagttttcagggcttgtatccgtattttttccgatgtttccaccgataattatttttcctttattggatttcagtttttcaatagcggcttcaagaccatcattattgaatcccattctgttgataattccgccatcctcaatgagacggaacaatctttttctgggatttccggcctgcgctctcggggttacggttccgatttccacaaatccgaaacctaaatctgccagttcattgaacaatactgcatttttatcgaaaccggcagccagtcctacgggatttttaaatttcaatccgaaaacttctctttccagacgtttgtcttcaacaggtttcgggaagaataatttagtgagaaatccaaaattcttaagtaccgaaaaggtaaagtgatgaacatcttcgggatcaaatttaaaaagaataggacgaatgagcgatttgtacattgaaaaaaagttttacaaaattactcattttaaaattaatgctcgatagatgtaagatattatatcgaaatggctcatctatagtatctataaactggaaaaacaactatatatgcaacataacgctgcgaccgcaaagaaagatgaccatcctgaaaacattttggttcgcaaaggcgttccactaagcaaattacaagctatcagcctttgcggaatgaagtgcccttgcgatcggaaataaaaatcattaattaaactttgtgaacattgcgttaaagcaataggaaacagagaaatatctccatcatccttggcaaggtttaaaaccttgccaaggctattaatctaagaataggcactcagatcgaatttcaggatgtctcctacccttttgaactcttcatctatagtggcatttaccgtaattctttcgttggaaacaggatgattaaaaatcaactgatgggcgtgaagtgtcattttgttgatttcaaaagtctgaagccacaacttattctgtttattgcaaccgtgtttcctgcagcctaaaatcggatgcagaatatgtttaaaatgctttctcagctgatgaaatctccccgtttcaggaatagcttctaccaaagagtatcttgaagtctgatgttttaaaaaaggtaagtctatttcagaagtctgcaaacggcgatagcttgtaactgcattttgcctgacttcattttcattaattaaatcataatcaatagtttcctcttcttttgtccagccacgtagaatggccagatatttcttctctacttcgcgtgacgaaaactgctcgctcatgattctgagagtatctttatctaaagtaaacaacagaacaccggatgttttcctatctaaccgatgtacaggatacactttttgcccaatctgtttcttcagctcctgaatagcatacgtatcggcttctcctgcataaaaagatttatgaaccagtagtccgctgggtttattgatggcaataagatgttcgtcgcgataaagaatttctaacatggggcaaaagtaaagattttcgactgatatatatgctgccgtatttgtaaacctgttaggtttaaacattcctttattaatagccccgatcaaagagaaaatcccacagtgaggaggcggagcgaagcagagccgccgagcgaggaattgcaacggagagcgggttcacggctccttaaaaattaaattgtaaatatttgtctgtttattaatgctttttttattgaatctcatgattttggatccaaattgctatttttgcatttcagacgttaaaaaaattatggcaaagcaagaagatgttttcaagaaagtgatttctcacgctaaagagtatggttttattttcccatcgagtgagatctatgatggtttatccgctgtttatgattatggacagaacggtgccgaactaaaaaataatatcaaacaatactggtggaaagctatggtacagcttaacgaaaatattgtgggtattgattcggcaattttgatgcacccgacaacatggaaggcatccggccacgtagacgctttcaacgatccattgattgacaataaagattccaagaaacgtttcagagcagacgttctggtagaagattactgtgctaaaattgaagataaagagaataaagagatagaaaaggctgcgaagagattcggtgatgctttcgataaagatcagtttgttgctacaaatccaaaagttctggaatacagggcaaaaagagaggctattctttcaagactggcaaagtctctggaaaatgaagatcttgctgatgtaaaagctttgattgaagagcttgagattgcagacccagatactggttctaaaaactggacggaagtgagacaattcaacctgatgttcggaactaagctgggagcttctgcagacaacgctatggacctttaccttagacctgaaacagctcagggtatcttcgttaacttcttaaacgtacaaaaaacttcacgtcataagcttcctttcggtattgcacagattggtaaggcattcagaaatgagattgtggcaagacagtttatcttcagaatgcgtgaattcgaacagatggaaatgcagttctttgtagctccgggaacagaacttgaattctatgaacagtggaagcagaaacgtctgaactggcacagagctttaggtttgggagacgaaaactacagattccacgatcatgagaagcttgctcactatgcgaatgctgctgctgatattgaatttaatttcccattcggatttaaagaactggaaggtatccactcaagaacggatttcgacttaaaggcacatgaagagttctcaggaagaaagcttcagttctttgaccctgaaagaaatgaaaactatgttccttacgtagtagaaacatctgtaggtttggacagattattcctttctattttctctcattgtttaagagacgaagtattggaagacggttcagaaagaactgttttatctttacctcctgcattggcgccaattaaagctgctattcttccattgatgaagaaagacggtttggcagaatatgcagaaaagatcttcaatgacctgaaatatgatttcaacttattctacgaagaaaaagatgcgatcggaaaacgttacagaagacaggatgccatcggtactccatactgtatcacggttgatcacgactctcttactgatcacactgtaaccatcagggacagagatacaatgcagcaggaaagagttcctgtttcagagttaagaagaatcattgatgagaagacgaacttcagaaatttactttctcagttatagtttaaaagccctgttttcagggcttttattttttattatcatatctgttaatttattatttttatccctcaaattttaaccatgaaaaaaataacactaatgatgtttgggctgatccaaacctttgcattttcccagactcaggacctgacggcacttgctgcaggcgatcatgtgggaatgaatgctctattcgatgataaagacaatctctacggttacgtttctctatattcttacggaaaatccggtgacaagactaaaaagttcgagtatgtaattctggacaaaaacctcaaccctgttgccaataaagaatttgaaggagacatcacagcagcttcttatttgggatatgttgatttcaaagggcagattatcctaaagccatccatgatggattattcccttgtaaaaagcaaagaaatatttactccggtttctatggtgatcgatccaaaaacaaactctattaccagaaagatctattatgattatcttgaaaacggtactttcaaagagatcaacgagccgaaaagctggaaagaacagcgtaaggaaaaccgtgacgagaagaaagaaaaaggctacaactatgtttctgccgttggagaactgaaagaaggcggttatttcgctattgaatacaaagattacggaaagtatgagaacagcaacagcctgatgaagtttgatgagaataaaaaggaagtctggagatacaaatacaatacagacggaagcaaaaaaattcacacttctttatctgttcttgaaagagatgagaactatatgtactgcatcatgaaaaaggtcaatgacaagcagaaaacattcagtctgatggttctggatatgaaaacaggaaaagaaaaatccaacaaacccgttacaggattatctgatgaaacgatagacaatattgaatccttctactccaattacagaaaacttgataatgataaaacttttgaggataaagtagtgctgttaggaagaaattatgatgattcccaatctgtaggatttgcaagaatgatcctcaataaatctgacttttccgttgatacgaaaaccatcaattatgagcccaatatctctgcttttcttcccaaagtggacaaatatggaatggtggaaagcggttatatgcttcagaccaaagacatgtattttatgaatgatggaagtgtaggtattttatcagaaaaatataagcctgcaggccagtacaacgcaccgaaaaccaccgatcttgtttacatctataccgataaggatttcaaggtgaaaaatgttcaggtctttgaaaaggaaaaatcaaagtgggtaaacagtgattatctgttttcacaatacctcaacgggggtaaagatgtggtatttttctaccgtgactatcaaaaagatgaagtaacgaaacagaaaagatggaatctgtttatcaatactattattgacggaaaattcaaacaggagattatcccgatttctgaaaaagacaattatgccgtaactccgtatgtaggaaaagaaggctatattctgcttcgtgagtataacgaaaaggaaaaattcaataagatccgtctggagaaattaaattactaaaataataagaaccctgatgtttcgtcagggttctttctttttatgttttggctaaagcccgtttctattgatattacaatcacttaaaataaaaatcaatttacttttgctatagtctcgtttgtctgataatagtctgctatattctttatttcttcaagacttaaattccacataaagttcagaaactgctggtagctttcgctttgatttttaggttctatcctgtcaagataccggttcaggttataattttttctcgcctcgtatattttggcaaagcattttcccagccagcttttataatatttttcctcctcttcatcctgcaaaaactgcatggcagcataaatccctaatccataatcttctgaatggaaataattgggtaaaatctccatccttgctgttttctgtaatgcgacaaacagatcagtgggtttttcagaagcagcgggtgttttcagttcagcaaatgttcttttaagcatttctattcttctggaaacttcagggtgtgatgccagggaatctttattcagcttttctttataaaagttgtagttatacagtgagaagtcttcctttttcatccatttttcattgaatgcctgcttgggaagattgaaaagttttttgtaggtttccacctttaattcccttggagagatggtatcaaaatcctgtaatctctgaagagcatttacaaattcggcttttttaaaatcactgtttctaaaaataacatatcccaaagaatccgcctgcatttcactttgtctcctctccactcctttcttataaactgtatttttaaaaatatcaaaagctttctgattctggatctggcttctgcttgtggtagtggattttatattctcaaccacgattttatcctgcttatcctgttcaatgatttttaaaaaggttttcagggaatgttcttctattttgtgcccgagttcatgggaaattaccgcagcaatctgctcctcattattcagccagctgtacaatcccatattgataacaaacgttccgtcagcaaggcaataagcattgggggtattgtcttttgcaatcagaatcttcagatcttgtggaattttagggttattctttttcagacgctgaatcatagattgtatactggcttcaaattcagatttgaaaatgaaatccttattcttcacctgtttttcaaagtcggttccgaattctttatagatcttggatagttctgagcctgttttcccggaatattgcgccctcaatctctttacagtagcttcattattcccttcaaaatgctttaaaaatgcttttctctgtatataatctgcagtatctatcggcttatacatttggggcattcccataatcgaaaatagaaagcaacccaatacaaaaagttttctggtcatagttttcatcaataagaacaaaaataacttatttgtggattcattttaaattttgtagtcaaattattctaaatttgttaaagacccattcatgaaaaaatgagaatactgaagtatatgataggcggagctgtagcaggtgcagcggctgcttattttctgggatatgattatttatttagtggtatttcaaaaacctatcttaaaggaagatcaagtgcacatatagatgacggaaatcttttcccaggtaatcctgttgctaccgtggaacccaaactctgggaagaagatcctgactataataaaactgaactacctaaacatttagttgaaaacttaaaacattcccggacagcagcttttgtggtgatcaggaatgggaaaatccttcatgaacaatattggagcggctacaatcagctatcacaaaccaattctttttcgatggccaaagcagtgacggtaatgcttttgggaaaggctctggaagaaagcattattccggatattgacaaaagactttcagatttttatccggaatttaaaaataaaacattcggaagccaggttacgcttaaaaacttagcgcaaatggaagccggactggattgggatgaaaattacaacaatccctttcttcccaatgccaaggcttattatgggaaaagtcttgtaaaagcagtattctcaagaaaatttaaagaagaaccaggaaccagatttgagtaccagagcggttctacgcagcttcttggctttgctctccgaaaagcactgaatcaaccattggcaagctacttatcagagaaattctgggttcctttagggatggaacaaaatgccaaatggagcacagatgattacggcatggaaaaaacctattgctgcattcattccaatgcaagagattttgccaaacttgggcagctgttcctggataatgggaaagccggtaatcatcaaatccttaatgcagacttcattgaaaagatgagaactcctacagcaaagtctgaaaacatttatggaatgggactttggattaatcatgacaatccggttaaacattattatttcctgggactacaggggcaatatattattatggtaccggatcataagatggttattgtaaaaaccggaagctatgctaacaatcctaagaatgacagaggaaggcctgatcaggtaaaattccttgtgaacgaaattgtacaattattccagtaaatgctatggagaaatacagcccgaaaatagatatctatattgaaaaatcacaggattttgccaagcctgttctgcattatatccgtgaaacggttcatgaattctgccctgatgctgaagaaaccatgaaatggagctttcctcattttatctataaaggaaaaaacctgtgtgcaatggcttccttcaagcagcactgtacttttggattctggctggaaaaggaaatgaaaactatgcaggagatgactcaggatattgagaaaaattcaatgttcagcttgggaaaaattacaagaattgaagacctcccatccaaacctcagctgaaaaaggctattaaagaagcgatggaacttacggatatgggagttaccatgaagaaagcagctccttctaaaacagaaatggaggtccctgattattttcagtcagctctcaattcgcagccaaaagcgctggaagtttttgaaaaagcttcaccatccttcagaaaggaatatatttcctggatcacggaagccaaaacagaagccaccagaaataaaagaatggagcaggctctggaatggattgccgaaggtaagggaagaaactggaagtatgaaagaaagtaaatttgatcacaccaaattattctgaattttcagaattcctgaaggtaagcaacaagctcagtatatgatatattttgtccttccttcaatatttttccggtttcagattcctcaataatgatatcaaaatgcccggtttgagaaaaatcaaatgttgaaatatagatgacaacatttcctttttgcagtcctaaagcttcagtatctgcgtcccaatagtcaacaagtttatatccataaaagtcttcccgggaaagctcatctaataaataactgaaatgttttattttccattcaaaaaaataggaaaaaggaaaaataagcagaatttttgaaataaaataattcctaatgaaatctgaaattggcttccggtaatgtattctttttcaggaacgcttcatattccggggacagctttgcacgtccaaaggtgttctctccactcatgcttcccagacgaactttgtccttcccaaatttccggttcatggcatccattgctttcattacgggaagatgctgattttgtatatcttcttcaaaaaggctgatctgtctctgatcttctggtacaaagtcattcaccatcactcctgcccttttataatgaaatccttctctgtaaatagcttcaaaaagctcattaaccactctcccaatcagaatggatgaattcgtaggattggaaagaatccttgtcatagcatttttatactcaggcagatcttttctgaaacggttggtctgcacaaaaacagtaatcattttacagcaggtattctgctttctcagcctttctgagcaatacattccaaaagtttctacccgttctcttacttcttctttattcgtaagcatctgcataaaacttcgggtaactgctattgattttttaggggaagggttgtccagttccagctggcgaattcccttcagctcattgatcattcttactccgtgaattcccatgatcttccgaacccacatttcaggtttctgaagaagatcccaggctttatacactccgctgtcattcattttggcggcaagtcttctcccgattccccatacatctcctatattaagccattttaaagctttttttatcttttcaggagtatctaaaatataaactccgttaaaattctccgggaactcttttacaatcctgttggccactttacacaaagtcttggtaggtgcaattcctatacttacagggatattttccttctctctgatctcttctttaattttaaggcagtattcatagatatcaatatacttaaatcctgttaaatcaagaaaaagctcatcaatactataaacttcatgatcaagaacgtaggatttagcaatattgataacctgctggcttttataattatataattcaaattttgcagaaaagctttttacatcatgcttctgaaaaagctctttgtacttgaatgcaggagctgccataggaattcccaggtcttttgcctccttacttctggatacaacacatccatcgttgttggagagaaccacaacgggtctgccttcaagatcaggatccaaagtcctttcacaggaaacaaaaaaattgttacagtctaccagagcatacatgacaattgtatcgtaaatatctgtacaaaattatagtttttaaagaataaaataatcttttaatccataattaacatcatatttaacaccctgaaaaacaaatggatatttttttttaaatacgacatgttttgtcgcataagcactttaattttgttttcaaaaacttattctttaaacagcattgttcgaataaatcatttaacttctttgttattgttttgaactaaaatttaaataaaacacgtcaagtttcgtcgctttcgtgctatacttttgtcctgtaacaaaataagaaatatggacaaagtaaccttagaacgaattcagaaacttcacccgttggtaagagatgaagtaaagcaaattatccaggaatgtgacgaagcactgaccggcagagccaagatacggatcactcagggattaagatcttttgaagagcaggaaaaactttatgcaataggaagaattacttcaggaaaaaaggtaaccaatgctaaagcagggcaaagcatccacaattatggtcttgctgtagacatctgcctgatgattgacggaaaaacagcgagctgggatactgtaaaagactgggataatgataaagttgcagactggtacgaatgtgtaaagatttttgcccgttacggctgggactggggcggaaactggaagacgtttaaagaccttccccattttgaaaaaaagaatattccatctaaaaaaggaactgtaaaaacaagctggagaacgcttttaaaaatgcagagagataagcagggttatgttattttataactctcatcgatttaagattaaaaaagcctatcaaaacataaccccctgttttacaatactattttttaccaaaaataattaaaaatatttataatacgacaagttctggcgcttcctccatctatatttgctttataagaaaaacaccaaaagcatccttataataagcttaaaaccaatagacattttttcggaaatctattggttttacttgtctaaagttgctaaatgtttcttctaaaaaatgaaaaaataacatgaaaaagacaaccattctttctttggacggaggcggaataagaggaatcatcacctgtattattctgcgttacatagaagaacagctccagtattatgataagcccactgcaaagctcggggactattttgatctggtagcaggcagcagcaccggaggtctgattgcttctattattctatgtcccgacgaaacccgaaaagcaaaatattctatccagaaaggattggaattgtatgcggaaaagggcggcgatatcttccaggtttccttttgggaaaaactggttaatccattcggattattgaatgaaaaaattccacaggaatcacttgaaaggaatttaaatgacttttttggaaatttagaattaaaagaactaataaaaccatgtttaataacaagttatgatatagagaacagaagagcaaagcttttcaactcatggaaagccaatctcagcacagataatttttacgtgaaagatgtctgcagggcaacctcggctgctcctacctacttctgccccgttcagattaaatctatgtatggacagatcttcagcctgatagatggtggtatgtttgctaataatccagcgctatgtgcttatgcagaagccagaaaaattccttttgcagaagtgttaaaaaaccatcagaaagccaatcatccgggagtaaatgatatgataattgtttccatcggaacaggaatagaagcaagaccttactcttttaaaaaactgcagaaagctggaaaaataggttgggtaaatcctattattgatatcttgatgtctgccaatgcagaaacggtagattatcagctgggacaaatgtttcagacgttgggattcagaaatcaaaaaaactattaccgtttgaacccctcattgaaaaatgcttctccggcaatggacaatgtaagaagatcgaatatcgagaatcttatacaagcaggattaagctatattgatgataacagagatactctgaaccagattgttcagaaactcattaaaaataaaatataagctttttaccttataacaaccctatataagctttaaagattatattttaaaattagaaaatcttttttaaatacgtcaagttttgtcgtttcgccccgctacctttggagtatcaaaaaggacgcaaaacaaacatccataaaaactttaaaaagcctttgaattcaacatttccctatgctgaacagcctgaaatatgttcaaaatataaccaacacccaattacacaaaacatggaaacaccagatcacaaaacagataccctcttcgatgaagacctttataccatagaatggagcgatatcgaaaatgctgagatggattatgaaaactatctcaatgacattgaaaacttcttcagagaagattttgaagaaggaatacttgaagaagatattttttaagtaaaaatttaaaacacgacaagttctgacgctgtccgacattacctttataatctacgaacagcaatctcattaatcatttccaacacctttgaattcaccattcacaaaatgctggacagccagaactatgtctgaaaattatagcaattataagcctgttataccaaaatacaggacatataatcaatttattaaccaacaaatcacacaacgttttatgaaaacaaaagaagaactaaaaaaatatttcgaaaacggagatatcccggtacaggaagaattctgggagtggcaggagtcatactggcataaagatgaaatgattcccttaaaccaaattgccaatgttgatgccgtaagtgtcggaggtctgctggacaatataaaaacaggaggggtcagagattgggttctgggctcttacaaagccggagaagttgtcagacatcttaatattttatggaaagctaaaatagatattacaagtgcagttcccggtaataatgctaattgggagatttattttccgtttcctaaatcaccgggtatattcacatcacattccaccactttaacaattgatactgttactaacacagttacattaattggtacctcaacaaataaacttattacaaatcaaggcgtatttaatgttagggcacagaccgttgatacctcggcaaatccaacatattatgcaattgtctataatacatcaagtacaaatgcaagagcggttacagtctatgataatgctgcaagacctttgggaattaatgattatgttttgttttatgtactcaatctaaattcgatcttacaggatgtttttggagctaaaggatatacgctaatcaataccacagaaacaaccacttaccccataaaacctgtagcgactgctgacgttttatataataaaacatttttaacctggcatgaatccagaacatcagatgaaaaattctggcttagtaaagccatcttagatgctgaattttataatgtaaaagacagtgcggtggttacattatacggactaggaaaaaatgttacaactaccaactcatatcttggttttatctatgcagaaagaggtaagtctgcactgttcttatatgcagacgaatttaataatgctttttctgccccttatgatcctgtactacactcaggagttaaaacctattttctcagatcaggaaccaaaagggaatccaatacaacgatatatggaaaagtaacaattgactggtctcaggttcctaatcagaaaagagtggttgaaagtaactcaggcgttaccaataatagtaacctaagcaggacgctgtataaaaaatcagaagtctttaataatcctttgggatttataaagtttgcaaagtcccgtagtttcaatgattattattctgctcctgcattagacagttatgcaggtccggatggatctggcattccaaaaaagccctatgaggattgcagagaatggtcattaaaatgggatgaacttgtcacaaatgtccctcccggatattcaattagtaaggaaacgcttacaactgatgtccctacggataccaatgctgaaggaaaactgccaatttatggatatacttttttacctggtaaactaaccgctggagaccctaccggaaataatgcccagacgttgccacgaattgttttaaattgttcaatccatggttttgaaaaaacaccttcatttgttgcttatgaactcatgaaacaagttctgacgaattggaaatctcatccgtttttagaatacctaagatttaatgttgaatttgttattattccgtttgccaatccgcacggatggaatgccggatccggtgcaggaacacgcaagaatttgaactcagtagatttaaacagaaattttccaaccttttgggcaggtggaggttctactcccgcagattctacatatcccggtcaggcagcattatcagaaattgagtctcaggcaatatataggtacatgcaggaaaaaatcactccaaacacaataatgggtatagattttcacaatttccatggtaccccccagacagatccgaaaaattacaatatggcatggattgtaaatcttggttctgaattaggccaaagttcagccaatattttaatgaaagaactgtcagcaaaatataaggcgaaatctttactaattccacaatctgatgattattgtatcggacagtcaaataactataacggcccgggctttagtggttctgctatgaaatctttgggagctctttatgcttcaacatttgaagtctgtcagaacttccgattcaatcccgcttttaaaagccacgacagtgatgctattacttttggtttggaaacatttaccaactatttaagaatttttcttgctgagcatttggaagaatacaacagaacaaaataggaaatagtttctgtatacggtgatttaggctttggaaatgctggcattccgtaaacctaaaacttatataaccctataataactcatttacgttaactcttgagtaaacaaaaaaataaacaaaaaatgccaacaaatattacatcaacaaaatccgcatttaccgtcggaaaatccttcataggagaaggaattattaattataaacaaataaacactatgaacacaaacaacccatcacaaacacttttcagattcgtaagcttaagaagcccgcaattacccgatgaagataaacaaagcaaaaaattcattacaattccggattctttaaaaagcgacaatacattttatgtacctgtagcctcaggaacaaggcccaagcaggaattgttaaaagaaagagctgctgtttttgcccaaaatgcgaattttattgctgatatggacgcattgaaacaaacctatggcattgtgtatgattacgcactttggcttgcaaaaaataaaaacacttgttcttataatcaatttaatgagaaaaagaatcaggtaaaactttcctcttcttatgcatttcctgaccttatcaatttatggaacaacttaatttatcagatagccacccataaagacttttatgttaaagaaggactcatgcaggttttattggcagctcatacccttactcttgaaaattcagctccaggagaagatgaatacaaagatctattatccgcaagagttgtaattcccagagaactgatgctggatactccggatgccaaccctattggcattacttcaaaaatggaggaaaaagaatcgggagaagttacatcaccatcctcttacatggaaaagcagcaaaatatccaggaagcccaggctcttcttaagagatatgaagtgttaaccaaagagatgtctcttatcgagaacagctataaaaaagaatatacacgagaatataaggccagtgaagaaaaacataacgaatccaaccaatccatccttgacgaatattatgtccgcgtagaagaagcaaggagaaaatattgtgagatcagaaatcctgagttgccatatgatcctgaagacccttgtaacaaaccagaagaaattccgtatccgaagcttccgaaatttgaattctccttccgccctgaagttgatgcgagaactcttgtaagtggattgaaacccgacagtattgatacaatattatcccttttagaatatgatttttcagagacgggtaaagaaaggattgatgactcatcactaattgatagtttgctggcaggaagaaatacgttcaatgaattaaaagacattatttccaatgctacagagagcgctaataaagttattctggataatatcatggataattcggaaagctatacaagcattggtggagtcattcttcctgtctcaagagtagaaacgattccttttacctatcagttatgtccgaggcatactttaagaaatacatgcctggacttatctatcgatgttcctgatgcttcctggaatgtagcaagtatgagctatactttctataccaatgcaggacctatttccgggacctattttgaaaaaagtcgtgttggtaataagattttcttaagtaaattattaggaagcgcaacaacagacggtgtatacatttctcaaacagagaactttacaatggatgttaaaatcacctttaccaatggtaaggtaacgactttcttcccaagaattatttcaatgaagtcctgctacacctcatcttttgagtttgtaaatgaaattaaagatcctgtgcaggaacctgatgattcttatatcccttccggatttggatttaagcaaatcggtattgctgactatcttaaagttgaacagaccacccatgcttatgtagaaggagaagtggctcatattgaaaacgtaatggcccgtgagtaccgtgaaaaagcaaccagaaggctaagaagaagcgaaaacactactactacatcttcagatactgaaagagaaaaacttacggacactactactgcaaccagatttgaaatgcagactgagattgccaaaatgttgcaggaatccagagatgccaatgtacaggcacattttgatgcaacatgggaaatgacagggggaggatctatcagtacaggaattgccggtgggtatgccactcattcttccaaagaagaaagtacaagacaagcccttacccaagctcaggatattacagcaagagcattagacagagtggtcacaaaagttcatgaggaaagaattgaaaagatcattgaagagttcgaagagaataacaaacacggctttgacaataccaaaggagataagcatgttgtaggtgttttccgttgggtagacaaacttatgaaaaatcagatctataattatggcaagcgtctgatgttcgaatttatgattcctcaacctgccaaactgcatacgttgggaataacattggacaattcagcaacgaagagcgatcttgtaaaacctgaagacccaagaaaagctagctatctgccattagaaaactattcatctttaggtaacgaagcggcattaaaatattggataagtaaatacaatgccgaaattgatgagagacctgcagaatcctttgctataagtaaatcattcagtggacgcgatggaaacttcggaggaaaagatgatgacaaggttcagattgtaaacggaaacggagaagttgaagttccggaaggttatttattaaaaactgttgattatactttccaaacctatccacacggctttaaaggtgctcaccaggctttcatgaccattggaggacaaggtacttactggatctcttcacctaacagtacacaggtaagtggaacaacaacaaccctgaatatcaaaaataaactggaatttagttttgctacaggagaaagcccaattatgcaaggtactctgaaactgaatttagagcttactccggaagcaagaaatgcatggcttcagaaaacattcaaagccattattgacagctatgaaaaggctttagcaatttacgaacagaaaatagcggaagaaaaagctaccggtatccagattaaaggatccaatccaggattctatcgtcagatcgagaatacggtactccgtaaaaactgtatctcctatatgatcaacagatcagccaattctacccatggctatggtatggcagggctaactaccggaagcacctttacagattatgaaacagacctgtcatcaacactggataaatatacagccttccttaagtttatggaacaggccttcgaatgggaaaacctttcttattatctgtatccttactattgggctaataaaacagaatggactaatctttaccaggctgaagatgtagatccgttattcagagcattcctgcaaagtggtatggcaagagttgttgctactgtacgtccgggatttgaagatgctgttcagttctatatggcaacaggtaaaatctggaatggaggcgaagttccagttattggagattctctttatctatctattgtagatgaaatgaaacaacctaaaggcataaaacaaggaaaggcatggattaccagacttccaactccattaaatattcttcaggctgaaagcatcggcttaaaagtagcgcatgctttaccatttagtgctgaagatcctaatgagtttgaagtaccgggagaggtgattacggaaagtaactttgtgaaggataattctttaatgggaaacaaatccagcataaaacagatccaattctctcttaaagaattagatagtacagcctcgtataataccattggagacctagaccaagcaggcgagtttcctagaacttacgaatgtatgggacaaagcattgaggttgtaagagacgcaacatgggcaaaaacagattctctagtgaagatttatggagctttggcttccggactttcaggaatagatggcattgaagcttttgccaataccgaaaatggagttaccatccgagtggacatagataaaatcaaaaatttcaaatttgtaaaacctccgtatactgatgccatggataccataacttttaccacagacgggctaacttatttaaaatttggcaacgacaattttgtaggttctgcaaacagactttttgacaaagatgataaactaattggtacccaagaatatgctgaaaagctttctctatcaagatttctaatctaattctctaaaaacaagaaccatgagtcgagtaaaactcgaggctatttggcagcacgaaaaagtgctgccttatatcctcacaaccttaaaggacaagattgatgatattactgctgtagaaaagatatttcttttcggaagcagaggtaggataccatttgataaatgggacacgctggaaggaaaagactgggatgttttggtacaggctaaatgcaaacttaaaaatgcccacgcactccttgataaagattactatctggatcttctcgtgttggatgaagaaacaattcagaagcattattacaacaataagcttacgatggtttttccggaaaatgtactagatgatttcataactaaaactcaatagcatggcaaagattaaagatattatcgaatttctgaggctgaaccgaagaaatgaagaagcaaacaaaacacctgtcactccgaattatgttatattggaatcccttgatacccataaggagtatactgttagcaaagatgattttgaaaactttgataaatatataaggctggtaaatgtattgaatgattataaagccaactatatttatattcttgaaaccaatgctaataaaacattttacataaaaaatgcaagtagcaaatttgttgatattattactcatcaagtaaacaatgccgttactgaaaatagtcttaaacaatatgaaattgactttggttctaatttttatttttatgatacttctcaaaataatgtcgtgatctcagtcacacaattagctgaaattaaaatttttagtgacaccattaaatacattcctaatgaagagcccataaaaagcttccagaatgacgattatgcttacaattatgacagtcatgaaagtatctcacactctattttaaaaagaattgccgttgcagcatcatctcgttataccccttccggaatatatagctctgatcggatggtaaaacttacaaagtctgaagaaaacggaaaaatgtttctgattccggatattaaacatgataccttaaagggaaaatattttttacaatatcagttttggaaacccaaacaggatagtgaacaaaaaataaagcccttttatgctcctatcggagatgttgcaatgactttagagtttaactatattggagcttttctctcttttcttaatgaaactattttcagccagccaaattttaattattcatctgaaaacgatggaaaaagagaagaattcaaggaacagtttaaaaatattgttattgttcctttagaaaattatgcccttagagatactgacaaatattatcgggaaattattgaggttttttattatctgcacgaagatgtagcttccaccattaatcctaatataatctggaaactcatcaataaagcaattgaaaatgatgggcttactaatttttctattaacgaagaagatctatttataaaacttctggaaactcttttagcaacagaaggcagagaagaaaaattccttattcggttaaatgaaactatttctgttaaaaataccacaactgttttagaatatctatatgacagactgaatggagaaaatggggtcaagtttgtaaacctcatcaacaaagcttggagaaaaacgagatttgcaaagcctgatatcgaaaaaaatcctgaatttgcttcaacagatggtcctttaatgtttccttatgaatcagaaaagtggttgggcttatattttagcaatgctaaggtcagctttgaaaataattcaaaaaaagaacgtcttttaaacgtcacagttactactgaccaatataaaaaagttaccaaaataactcctaagggtgatacttatgaaactcgcgaaaaaataaaagaacatttttggtatcacccgttttatcctgtttatttaaaaaatgttgagaaacaagactcagaattgaaattagattccattgttcctgcctttgtactaaaagcaaacgaagataagcagttctggagcaatgtaattacgagtgcggagtatgcattggatgtggcaacaaccttatctggtattggtaatattacaaaattcaggtatcttacaagagttacccaactggcagaagtcatagagggaacaaatgccatttccaaagtagcaaaagccgcaaatattttacgctatgtgaaaggagcggcaggagtggtagaacttactagtggaagtataaatctgatgataaagattactggggccaaagataccgagtttggggaaagcctgagtaaggtacttttttacctagaacttataacattggctggcgaacttaccacttctatgaaaatggggctaaaaaaaagtgctaaagaagcaatagaagaatcgaatggtgctatgcgtgtaaaacaccctgagctttttgcagaactttatcgaattgcaggattgaaaaaagtataccaacatgtggacgattttatgaagacccggcctaagttccatgacctaaatttgataaaccaattgtggaaagaaaaaattgtcacaaaacttatttttccaactaaccttagaaaactttactttaaatatctggatgaatttccagagttgaagaaaggatttaaccaagctgagtttaaaactactattttcaatcaaggggaaaaagtgaaagaagtggtagagttttctttatctggaaaacgagaaaagttattgtctgcttttggagatcctcctaatttgccggaaaatacaattgatattctgagcgattatgagaattttgaaacattcgtaaaaggagcagaggactttggaggaatcccaagaaattatgacagtgaaataaaatatattttcaattttcttaaaaatcatattgataaaggagatgaatttattattgaaacccgaaatattttcaaaacctgcggaagctgtcgaagagaatttgtgatgttggaagattatcttaaattgcaaggtaagaaagttaaaattatcgtaatgagtgatgagacaattgaaggaggaagaatgttaagagataaattaaaaatcaaatagctatgacaatagaatatatgacaacagtgaaagataatctaaaaattaataattttattaatagaggattttcagaagaaaaaattcaaaagatagaatcagaatataataaaggaaataaatttccaaaagcatttagagagtttttatacttagctggggattttaataattttggattcgatgatatcgaaggtatattaaaactccaggaattagctaaagaagaattggaaattacaggagcaaaaattgaaagaccttttttcgtatttcaccaactatctggttgtgaatattttacattcatttatttagatgaaaatacagctgatcctaaaacctacatttgttcaccttattataaatctactccgggggaagagtttattaagtataatggttttacatttacagcattagtaaacgaaagtattcatcgagtaaagaataacattccgttttaatagtatccgcctcaataagaggcggttttattgactagttattcgagaaattatggcctatgcacctcttgagaaagagaaatctgggcaattgcaaattattataaagttggttatttttatcctgatcattatatgatttatacagatttaaaaggtctatttagttggggataattattttaaaatgaataatatttttattaaaggtattgaaaatcttattaaagacaatatgaaaccgacaaaagaacaaatcatacaaataggattaaaagtagttgatgatgtctttaaagaagcttataatttgcaaacggcttcagcaacaaaagataaagtaaaagtatattcattaggcaatgatggatattatgaacatgacggatggcattttagtgtgaatagtaaagaaaaatatgataatgaatataaatctttttttatatactttttagatagtggtgttcctcttcacatgacctcttttttaggagatgacaaaccgaggtttgtttatgctataaaagataaaaataataaatacactgttgttgatgaagatacatatttcaaacatcaaaattttgactttaaaaattttgtaaggaagaatttttaacacacttccaataagttttatataacaaaacttatctacaagattaaacatgacatattttgttgtatcaatcgcatatatttgtctcataaagctttaccataaacgcatcactgtagcaacataaaaatagagaaagattttatttgacaaaatatgccttaatcgtgaaaagattaaaaagttctccagctactattcatagctggagaactttcttttaatttcaaattctctattctaataaacttcccacaaaattaaaaacacgtcaagttttgtcgttttcccagcctacttttgaagcataagtaaagacccagcaaataaccattaaaatcttaaaaactcttagaattcagcatttacaacatactgtacagccacaactatgtctgaaaatctaagccttgaaacatagtcagctttaaaaactgagcctttctaacttaacctatttaatacaaaaatcaccaaatttttattatgaaaacaaaagaagaattaaaactatgctttgaaaacggagacatacccacacaagagcatttctggtcatggctggattcctattggcataaaaacgatttgattccaataaaccaaattcaaaacagtgataaaattatacagcaaaacagcagtttcaatgattatatgaatccaaccctggaagttggagcactggccatttcaggctctgttggatttcctacaggttcaactataagaggaaggacggattcttttttagatatcgtctatgccaaccaaattgaacttctgggtgatatgttattgcaaactattttctattataccgatacgaatgtttttatttcaaaacaggatataaatgcaaaaacatttacgccaaccatccctgtaacagcaaagaaatggaaagtttccctgcatcatattgacaaaacgcaaacagttacccagcccgaattaaatgcaattaagatgaattgctactcatctaagtcaatcacatttaatgatattgtagaaaatgcaaaagcttccataaaagtcatatcagaatacaataatttagaaattaatttaggagagaatattcctacagaaatcggcaggatagccgtaaataatggcttcaattctacctctgatacagggataagaacagctttaattcctatagtttccggtaaatatttgattagccagaaatcaggatataaaatttcccgtgttgttttctataaggatggaatattcgctaaccagaatgttacgaccaatgacttttcagtagataatttgacctctaatcaggtgagactcgtttttgaaaagaatactccaacagacatcgttaccgagcaggaccgtcttgatttcacatatattttaaagaatgtcagtgtcagtaagtatgatcagttattaaatgaaagtaaaaaaagcaagccacttccatctactatttatacgatcaatgaacaggttgccatcctaaataccaatgatacggacatcaattttgatttagctaaccgtaagatcatcatttccggaggagcaatcattgacacgggaaacacaactgtgggaagaattagcctgcccatttcaactgcgggtatagatatgccttctgctataacggccggtgttgtattgtataataaaacaaacaatacaatcattgttcaaaaccagacatctgctcctttattaaaccatttggttttatttacttaccggtatagcggtgccttcactagtttttacgtcaccggcctgaaaaattattctgtaaacggagttccagtatctcaaaaggacattcgacaaatgaataaatttgcagtcgacaatttcggaattaaatattggagtgctccggtttatcctgccttcaatcctttaactcttacaacagatgttctttacccaatgtatgatcgtgtaatagcacccttctcaaataatgtcactaaaacagttataggccagacagaaggtcctacaccttatgatattttgcggattgatatttcattgaacagaaaaacgccgccaacacaaaggcgcagaaaacctcgcatattcgtatgtgctggtacccatggaggcgaaaagttgagtgtttacacaacctatttattttttaaactgttgcttgaaaatcctaataaggatgagatgatagatgctttacgcactaactatgactggacattgattcctttggttaatccatatgcgttgaatgttggaaatgtaggtggcacagaatcggtaagatggaatcataacggcgtggatattaacagaaattttgattatcgctgggcagaatatgcagacggtggtgctggctcacaatcctataaaggaattgcaccatttagcgaaaaagaatcacaattggtaagggatacttttaatgctattaaaacagacaccgtattatttattgactgtcacaattttggatcaggagtaaatattgattatcgtgctgcctggtttgcatcatcatttaatactgttcagaatgccatctattcattatgtgacagattagatgctgaaataaggaaacgatatagttatttagccgataaagatctgcttgctttttcagatattgatggcagctctccgatgtctcaggcctggatggggaatcagcaggtagtagcaatgacaatggaaactgatcagagtgattactacaatccaacagatccaacatcctttaacagtaatgtcattacaagaagcatagaaacctacgtaaatgcattttattcgatgggtaaatatgctgttgatttttataacaacagaatgtattagccgatataatatcaatacataagtttaacgttcaaaaactaatacccattaatatgaatatcggaagcatcccagcttgattcttagcaatactatgtgataaatttccaacaaaaaaataaaacacgacacgttttgtcgcatgaaccgcatatatttgtcttataaaactttaccatgaatcgcagcgctgctgcaccctaaaaatagagaaatgaagaaagatttttatctgacaagatatgccttaattattaaaagattagaaagttctccagctacttattcccagctggaggactatcttttaaactcttttgaattccaggatgcaggaatcaagagctactctatccgtacgctgcaaagggatatccgggagatttcagatcttttcaacctctccattcataacaaaaagaagggtgacaaccggtattatatcgagagccgcccgattatggaagtggatgaatacaatcagaaacttcttgagtccttccaggtgagcaatgccctgaaccttcacccggatttttcagattttatcttttttgaaagccgcaaaccaaccggtgtggaacatttttatgacctgttctttgcgatccggaataaaagagtagtgacttttgagcactacaattacaagaacaaactgatgacctccagaaaagtgcatcctttggctttaaaagaatctaaagaccgttggtaccttattgccatcgatacaaaagataaagttttaaaatcgttcgggcttgacaggatcaattatcttgatgtggctaaaaatcagttcagagagaaatacaaatacaatttcagagaacattttaaaaatgcattcggtgtcatgaatctggcagaacagaagccacagaatatcgtattgaaatgcagccgtcatcagggagaatatatcagaagtttcccacttcatcaatctcagaaagagaccagagaaaccccggaggaaatttattttgagttcttccttcatcctacttatgactttatgcaggagattctttcttatggaaaagaagtaaccgttctggaaccgaaaaccttagttgaagagattcgcaatcatttacaggaatctttgaaccgttatcttgaaagctgatcataaaggacatatttcatattttttgttatatttacataaatatacccttattgaaaactttattcattggcatcagctgttttatttctaccttttttctggcacaacagaaggaagagttcaggcttgtaaagagctattataaccagcacagaaacatgttgaacaaagaattcaaaaagaaatttgatgcagagtccaatgccgtaaaaaaagcagagattaaaggtgattttctttttttcatgaaaaaaatggacagcattgaaaataatgcgatgatcggagctttattaaaagtcagaaatctggaagaccttcagaccatcagaaatcctgaacgtaaaccctcatctgaagacttttcaagtgctgaaaagattgcagattacccgggcgggattaattctttaaggcaggaagtcgccaatctgctgtatgttgacggggtatattctaaagaaaaaactataaagacggatgtggattttattgttgaaaaagatggaacagtcagcaatgttcatgcccagggtgacaatttcaccttcaacaggcaggcagaaattgccttatattctctggcagaaaaattttctccggccatgataaaaggagatcctacaacttatcgttttaaacttcctttaactttaacgataacagattaaatgtttaccgacgaatattacatgaaaatggctctgcaggaagcagaaaccgctttagaaaaagatgaggtccctataggatgtgtagtggtttccaacaaccgcattattgcaagagcccataatctcactgaaacactgaacgatgtgactgcccatgcagaaatgcaggctataacttcagcagctaactttcttggaggaaaatatttaaaagactgtacattgtatgtcaccatggagccatgtgtcatgtgttcaggagcgctttcctggtctcagatttccaaggtagtcattggagcgcgtgatgaacagagaggttttatcaataaacatctttctcttcatccgaaaacagaagttatcacaggcattatggaagcagaatgctcttctattgttaaagaattctttaaaagtaaaagataatttaaaaacacaaagccggagaataattaaatattcccggctttttatcttataatttatcctgttaagatttcttctattcttttacaatacaatatctcaccagatcaaaatattctccatcctttttcacctcctgtacgagaacagcctcctgctccattcctattttctccataattcttccggaagcaggattgtgagggaaatgagtagcaaagattttatgaaaattcaattcattaaatccaaaatcgatcagggcttttgcagcctctgttacatatcctttattccagtaaggaattcctatccagtagcctaattccgctttatcatcatcgcggtcatggagaccgatcgctccgatgatttgtccttctttattcctgattccgaaagtatatccggtatcattatcaaaagcttccttggacatttccagccacatccgggcatcattttccatgtagggataagggatattagaagtaagatcagaaaaaattctgtgctgaaggtattcaacgataaaaggaatatccttctcctccagttgtgatagaataagcctttctgtctgtataatcggaaattttttcatattttaaaattaaggttgaggtgaagactaaggtattacccggattcaacctgaaccttaatcttttatttataaatctttcccaaggaaataaagtcctttcagggtgtgaagcctgtccatcacatgaattttatctgtcaaaggtttatagatatgagagactcctcccgttgcgactacgaagcaatcatcatttacttcttcattgatacggctcacaaatccttctaccattcccaggaagccatataccattccgctttgcatacaggttacggtgtccaaacccagaacagatttgggctttttcagttcgatatccggaagctgtgcagtttggttgatcagcgaattcagagacgtaacaattccaggagcaataattacccccagagtttctccgttttccgctacacaacttgccgtaagagcagtcccgaaatcgataataatctttttcttaccaggatataaattatgagcggcaacaaggtttgcatagatatccgtacccatttgtttggatttagcctgcactcctgaaggtgtattcctgtcaacaattacagggttggtcccgtggatttttttaattcctgagctcatgactttggtaagctgaggtactactgacccgataataactttatcaatttctttcggttcaattttatacgtctgataaagcatcagcatctgtacatacagctcatctgccgttctgtaaggctttgtattgattacccacgaaatatcacaattatcaccattgaaaagtccaaatctgatattgctgttccctacgttgattacgattgaattcattgacatatttttcagaagaaattcattatatataattgaaattcctgcttgattttgagggcttaaatttaatcattttaaaaaaaagaacctgccattatccaactaaattacaatgacacacttattttttctttctccggaacaattcagtatatttaaaacacaatattattattctgactatctcatgaaaaaattgatccttgttactttactatgcttcggtatctgtatttttgcgcaatccggcaactcaatggcaagcattttacaaaaaataaagagtcagtcaaaaattgatcctcaggataaggtagtttatgatctgatggatgaattttatcaaaaaaatcttcaggctgacaatgatgaagtaactcccgaacttacacacagaattcaaaaagcagtttctgatcccaataccaaaaatatacacctgctttatcttcttctgatgtatcagcagcatatcagccagactgtcgcagaaggaaaaaatgcaaatcctgaatttcagattgaaaccatgaatctccttgaaagcgaaactaaggaagtatatggaaagcttccggcaatcatctacatttttaaagcggaggccttagacagcggctcccagaaagaaaaagcaaaaattacggttgcaaacggtttaaaagaatatccggactctattcctttaaaagtttatagttatttaaacactaaagatgagactttgaggcaggatctcatccaaaatcatcccaatcactggatggtacagcaattcggaataaaataaaaaaaccacagaggaatctgtggttttttctttgtatatgcttatcgttatttcacctctacaaaattattttccatattcacatctgcaattctctggctgaaatcaattccgagaacagatagctgagatttggtataaggaatagtaagggtatattctttctgagtccatggccagtaaggcattgttttaaactcgccatacacatctttttctttccatgtatgggtcatattcattgggatctgataggtaacaattttcttatccgttgtcatcactccgaaatcaatcggcattggcacctgaccattattaaccagagtaatcgtagttgactttgcatcgtacttaacatccttaattccgtaatcgatggtttttgttgtattgatccagtaattgtggaaccatttcagatccatcccggaaactttttgcgcaatatgaaggaaatccctgtctgaaggatgcttcatactccactggtcataatattgctttagggtttcggcaagattctgctctcccataatgtatccaagctgcaccagatataattcaccttttacataagaggcataggtataagctgtaccgttatcatggtgatcacccaaccatacagccggttcttcgattccttttttgataaagtttctgtaagcatcaagtgttttagcaaatggattggggagatcttcagggaatagctgatacatggtataaccttctgcataactggtgaaaccttcatccatccacgggcgtacagattcgttagtagcaagcatttgctgataccatgagtgggatccttcgtgagccattaaacccattaaatctttaatgcttttagcttcccctaaaatcatggtacacatcccatactccattccgccgtctcctccctggataaatgcataagtaggatatacatattttccgaagtgggaattcataatcttgaaatacttcgtgatataaggctgtgcctcaccccatgcttttgttttatcatttttctgataaaccagatatactttcggaccttccggaacattgaagctttccacaaaataatctctgtcagcactccatgcaaaatcaagaatattttttgctgtccatttccagaccgcttttttgtctttttctgtttttattttggcattggcatcgtagccttttacttctgttggattttccagaattcctcctgctcctatgacataatctttattgattttaatggtaacatcaaaatcggagaacggtgcatgaaattctcttcccagataatcaaaagttgcccagccgtcataatcgtattctgcaattttcggataccattgtgtcatcgtcatgtcaactccttctttgttgtttcttccgcttcttctgatctgctggggaatcacggaatcccaatccattgtaaacgttgtggtagaattcggtttgatgggttcagccagatacactttcataatggtttcctgaacttcaaatttcaggtctttcccattctgcttaatccagtgaatgttctgagctccttcctgatctttcggaatggacgccagtcttgaaatgccatctttctgcagtcttgaatctccattttttccctgggaagccaccctctgatccatcatggaattaggtttgaaagcattccagtataagtggaaataaaccacattcagctcatccggtgaattattggtatattctatcgtttgttttccctggtaggtaaatttttcagcattgacatctatatccatcttgtacttcgcagcctgctgataataagctccttgctgagcctgaaattgtgaaatgataaacgcaaaaatgattgcagccgattttctcatttaaaattttattttttctaaaggtaggtaatttaaataagaacctcaaataggagttattttgagattttattctgtttattatggttttagatgaattttaatcagagttgttaaaatagaaattcataaagatgaagtgacttatttttactaactacacatgacacggattttcctaaactattatgagtcgttttttgatacggtgagcattgatgtgcctattggttcttcaacatttttttgattaaagtaatctgtcccaggtgatagtagctatgctcgatcattccatcaatgtttctccggtaagttccgtatttttcatcaacaaaaacctcatcaagtttagaatcaggcatctgttccagcaatgctgcaaacttttcagcatctttccatagcttgttcaacaaatcttcccattgttgctgagattctatgggaggaagatcaaaactgaatttatctttgatttcaagatcaccaccttcaaaaacattgataattcctgcaatataataatcaatatgaaaagtaagcattgcgatcgtattcagagaatcaatttttgccactgcctgttcccagcttacatctgaaagctgatctttaaaattggtattggcgatccagagaccatccagcaaaacctctctgaatctttttgataattgtgatactgaactcatgggtacaatattatttatgtttcctaaagataagtttttatttaaacacaaatctcaccaatgaaaacctctattttaaatccaataaaatagtgcaatttgtgcaaaaaatttgtgatattcgtgtttaactaattacaaaaaacctcaaatgcaaaatacatctgaggttaatattatactattgaattacaattatttcttcgtggaaacttctttttttccgcttcttaaaatcttttcaaggattcttagagtaatcagataggttggcttcactcctgtaagcccaagaccacccgaagataatgtacttcctgtttccagcgggttatctgatgcgtaataagcatagcacacgaacagatccggtgaaatatgatgtctgatcttggaagctacctggatggctttctgataatgtgctccttccatttcaagaccaattgccttccatgaagtgttcataaagtaagaaagaatatccttgttctgaagggaagttcccagaacagtaatcattggcccttcgaaagctttcaattcatcatcgatgaaatcttccagttttaaagcattttcaaaaggataattgtctgcagtcccttcaaaaatatgagaagtagggatcataatatctcctttcgctccggtaagaatacctgcttttcccatgatggaaacagattttacatgcatcatgtatacttctcctttatgttcaaaaggtctcagcaattcatccatcacctcgaaagcctgttctccgaaagcataatcaaaaaccattacaacatcatctcctgagaacttaatgtctgcaaacggggtattcttcagatctgttttgctgaggtctatgatctgaacgtcaatattacttccactcttgtccgcaatatgaatcatgccttcctccaaagcatattttaaaactttatcacgaagttctttcttgtttgaaatttcttcatacagtttataatcaacttcatgatgctgtttctttttaagtgcatgattcgcatacagcatattttttactgaatgcatattggcagaaataatgtgcaggggacgcatgtgaaggttattttcaaataaaacctctttcaccttgttagcccatttctctccaaaataatggtgtcccactctctcttttaatatagagctgaaataaatttctctttctctgcttccttttgcatcctcaagacttacctttcctaagttgtaaataattttgaaaagacggtcaggattatgatcatcaccaaaagtattgtaggctcttaatgtttcatcaaaagatcttcctattaaagaagaaagatgaataagcgccacttctttttcttttctgctgaatttcttttcccccttcaccacttcttcaataattttgaaggcacgtgtcggtttccagttttcatcctgaatgaatgccaggttacggattttatcagcttctataaacaggaatgtcaggtgggtaagaatgtcataaatttcagaacggcccaaaagaacctcaatattcatctggtgttcgtctattctataacagtttcttcttcttttctttggaacaataggttcgaaacttcctttatcaaacccttcatcagatgtaagatgaataaaagcacattcttcaattccttccggaagcctgtctaaaacatacatcaaaccgtccaattccaatttgctcggaatattcatggttccgtaaatttccggattgatggttttcaacaaacttctgatactctctcctgaaactcctcccggcttgaaaaatcctctataaaataagtgtctcatagagatgtatagtctttcaatagcctctgttgtttctcttgctctagaatttgtcataaaataaatttcacacaaatatacaaaatctttacccactttattttaactgtcttttaacaagtattttaatcattcagtatgattgtttattgcataataaatagtatatttactctgtattctataaaacaggcttaaaatctcattttttaaacattaaatcaccaaacacccctgttaaaaacaccaaacatttgtttaaattatataaattttcagaataccccttaaatttttagggttaaaatgttttcaattcattttttttgtaaatttgccctgtaaaaaatcaacccatttatgtcaaccttaagattcaaagcgttagaaaccctaccatttaaggatttcagaagagataactctgttgaagttcctgtaaaattatcagaattattctgccagaatgttttctcagaagaaacaatgagagaatatttaacgaaagaagcattccagtctattatggatgctgtaaaaaaagggactaaaatccagagacacattgcagatcaggtagctgtagcaatgaaagactgggcaatgagcaaaggagtaactcactatactcactggtttcagcctttgacagggacaaccgcagaaaagcacgattctttcttcacccctatcgaaggaggaagagctattgaaagattcagcggaaatttattgatccagcaggagccggacgcctcttctttcccgaacggaggaatcagaaatacgttcgaggcaagaggttatactgcatgggaccctacttctccggctttcatcatgggaactacattgtgtatcccatctatcttcatctcttatacaggagaaactttagattataaagcaccccttttaagagctttgaacgctgtagacgaagctgcgaccaacgtaatgcagtatttcgacaaaaatgtaacaaaagtaactcctactttaggttgggagcaggaatatttccttgtagattcagcattataccaatcccgtccggaccttgtattaacaggtaagacattattaggacattctcctgcaaaaggacagcagctggatgatcactatttcggttcaattcctacaagagtaatgaacttcatgaaggagctggaaatcgaatgtatgaaattaggtattcctgtaactacaagacacaacgaggtagctccaaaccaatttgagctggctccaatgtttgaggaagtaaacgttgccgtagaccacaactctttgttgatggatatcatggcaagaattgctcacagacaccacttccacattttattccacgaaaaaccattcgcaggagtaaacggaagcggaaagcacaacaactggtctttagctacagatacaggtgaaaacttattaagcccgggaaaaaatcctaagaaaaacttacaattcctgactttctttgttaacactattaaagcagttcatgagtatgctgatcttttaagagcaagtatcgcatctgcaagcaacgaccacagattaggtgctaacgaagctccgccggcaattatctccgtattcatcggaagccagctgttcagcgttttggaagagcttgaaaaagtaaccaacggaaaattatctccggaagaaaaaacagaattaaaattaaatgtagtaggaaagattcctgaaattttattagacaatactgatagaaacagaacttctccatttgcatttacaggaaataaatttgagatcagagcggtaggttcttctgcaaactgtgcagagtctatgacggtaatgaatactatcgcagcaaaacaattgaacgatttcaagaaagaagttgatgctttaattgaaaccggacttaagaaagacgaagccatctttaatgtattgagagagtacatcaagcagtgtaaaaacattatgtttgaaggtgacggatattctgacgactgggcaaaagaagctaagaaaagaggattaaacaaccttaagacaactcctgaagctttaaaacaggaaatggataagaaattcctggacctttatgaagaaatgggaattttcacccacagagaagttgaggcaagaaatgaaattaagttagaaaaatattctactgttattgatatcgaagcaagagtattaagtgatattgcaagaaaccacatcattccttctgcattaaactatcagaacagattaattgaaaacgtaaaaggtcttaaagaaatctttggagataaagaattcaaatcactggctaaagaacaaatgagtttaattacaagcatttctgaaaatgtttctaaaattaagcttggtgttgaagatcttatcaaagccagagaagcagccaaaagcatatcagacagccaaaaacaggcagaaagctattgtaataaagtaaaaccattatttgataccatcagagaagcttctgatgcattggaaatgatggttgacgatgagctttggccgatgacaaaatacagagaaatgttgtttacaaaataacacctgtaaagttccatattagtttaaattccccgttttccggggaattttttatttaacctaaaacattcatagacaaagacttctacaacttcaaatttgatacagaatttaattttacctttgttttcgttatgaaaatcctgatcgtagaagacaaccatgaacttgcccagagcatgaaatattatcttgaaggcgagaactatatctgtgaatgttcccatcattacaatgaagccctggaaaaactcagctttaattcgtacgattgcattttgttggatattatgctgcctgacggaaacggattaaacattctgaattacattaaaaccgaaaaaatcagcagtggaattcttattatttctgcaaaaaatgcattagatgataagatcaacggactggaacggggtgctgatgattatattacaaaacctttccatttaccggaactccatgccagattaagagccgtttaccgtagaaaaaaaatggaaggctacagtgaagttaagttcaatgagatcattttaaatacagacacttacgaagttattattaacgagacaagattggaagttacccagaaagaatttgaacttttgctgtactttcttgtcaacaaaaaccgtgtattatcaaaacaatcaattgccaatcatctctggggtgattatacggataatttatccaattttgattttgtttatcagcatgttaaaaatctcagaaaaaaaattggtgctgcacagggaaaagattatattgaaacgatctacggattaggctacaagttcaatgctttaaaatatagtggctcatgaatttattgaataaaatatcagtctggtttatcgccattgtattgctggttacccccgtaagcatgtacatatcatataccggtatcaaaaaaagactggataatgttgagatagaaaggttaaaaactgtcaacaattacgttatcaatcagctccggaaaggagaaaccccggcaaaaacctcacaggggctgcctattaccgtaagtttattccagggtaaaaacattccttcagaaccacaagtcatacacacctgccttgaagatcagggagtttccagaaatgaatgtaaaatccagatcaattcttttgcagacatcggcagtaaaatttataaaatttcttcatacggctacatcacagctacaaaagaaataatgggcggaatgctcattgccctgttctggaagcttttattaatcacagctgttgtttttattacagcacggatcctgtctaaatttatattaaagccttttcaccatgcaattgacaggcttcagaaattcaatattcagaaaaaagaaaggcttgaccttttacccaccagcacaaaagagtttaaaaaattaaatgagtttctgaaaacaatgacagacaaggccctggaggattatgcttccgtcaaagagttttccgaaaatgcctcgcatgaagttcagactcctttagccatcattcaaagtaaaattgagctgctggcagaaacagacatcaatgaaaatcaagcggttttattaacggacattcaaaattccatcgataaattaagcagaataaaccgctcactaattcttcttaccaaactgaataacaatgaatttctcactaacgaagaattgaagttctgtcgtgtggaaagagaagcactgtgcatgtattccgatcatttagcgttaaaaaatattactttacacagaaactgtgaaaagaatgtttatattaagatccaccctactttagcagaaattctgttaagcaatcttctttcaaatgccattcgtcataatcttgaagggggaaaaattgaaataaatttaaccaggaattactttcagatcaataataccggtcttcctcctcatgttcccacacaggaactatttaaaaggttcaagaaaagcaatcagtcacaggaaagcattggcctgggactttccattgtgaaacaaatctgtgaggtaaatgattttgctgttcattatgattttgcagacggatggcacagcataacggtatattttgacggtaacaaactacacggaacttcaatttccgaaaaaacaccagatgaaaatgaaattctgtttgaatccgtagagcagatagtaaattttgctaaataattaccatcaacattaatttttcaacttcaaatttgcttcaaaatgtattttttactttgaaaaaagaaaatacgttagatgctttcaagaatttttattctcgccttatcatccgtttttttgttcaacacagcaaaagcacagaaggtcctcacgctgcaatctgcgctggaaactgctgttcacaattacggaactattaaagccaaagaatcttaccggttatcatcgcaggaatcgatagagctggcaaaacggcaatacctgcctaacctgaatatcagcctgcagcaggattatggaaccgtcaacggacaaaacggtccactgtatggattcggaggctacggagtagcttcatccggacttcccctccctgatcaaaactggaatgcttctttcggagctttgtacctggctaatgtcaactgggaatttttcgctttcggaaaagccagacaaagagtgaaagttgcagaaactaaaaaccagagggatgccaaagatttatctgatgaaatctttcagcacaaaataaaagtaaccgccgcttatctgaatgttttagctgcaaaaaaattaaaactttcttacgcccggaatctcggaaggactgataccatcagaagaatcgttgaggttaaagaaaaaaacgggctcgttcccggcgtagatctatcacttgcaaacgcggattacgccaatgcaatgatcacgtacaccaaagcaaaagacaacgaacaggagcaggaaaataaacttgcccagctattgggaattcccgctcaggaatttgtactggacagtactttactgaaaagaattccggcaggtttcccaacagaaaagagctcttctctagagagtcatccattattggctttatacaaaagcagaattgatgtcagcgagcaggaaaaacagtttctaaagacacagtattatccgtcattctctatggtagggatctttcagacgagaggctcaggattcggaagcaactatgcacaaaaccagaatgattattcctcctcctactgggacggggttcatcctacaagaagcaactacctctttggaattggcgtttcctggaattttacacaaacctacaggctctcaaaggaaataagcgctcaggattatgtaagccagggtttgaaacatgaatatgacctcgcagaacaacagttaaaagcccagctggatttatccgataacaagtggcaaaatgccctccggatttatgatcaggttccggttcagctcaaatctgccaatgacgcttacacccaaaggtctgttctatataaaaacggactgactgatcttgtggatctgtcccaggctatttacgctctggtaagagcagaaaccgacagggatatcgccatcagcaatgtatggaacgccttactattaaaagcagccgctatgggagacttctctgtatttgaaaatgaactgtaagattaatatcaattataatcaatagtatctcaatgaacttaataagatttgcattaagaaaacccattacgattttagtgattgttgccggactgtttttctttggaatacggtcggtgaactccattaaagtcgatatctttccaaaactggatttaccggtaatctatgtttcccaccctttcagcggatatactcctcagcagatggaagcatttttcgccaaacaatatattaacatttttctattcgtcaacggaatcaaaagtattgaaactaaaaacatccaggggctgacattaatgaaaattaatttctatcccggaaccgatatggctcaggcagcggcagaattgaattcattttccaccagaattcaggccgcttttcctccgggatcaaatcctccctttatcattcgctttgatgcctccacacttccggtcggacagcttgttctaagcagtgataaaagatcaaacaatgaactgcttgatctcgccaacgtttatgttcgttccacatttacttcaattccgggaattgtttcgtcacctcctttcggaggaaatatccggacagtggtgattaatgccaatcctgatttgcttcgtcaacataacatgacaccagaccagctcgtagaagcactgaggctgaacaaccagaccgcaccttcaggaaacgtaagaataggtgataaatactatattaccccaaccaatacgatgattaaaaatgtaaaggattttggaaatattcccctctataaaggcagcgttcaaaatctatacttaagagatgttgccacagtaaccgacggggcagatatgacctctggttatgctttggtaaacggacgccgctcggtatatctgagtattgctaaaagtgccgatgcctctacctgggatgtagttcagaatctgaaaaaacaactgccgcagattcagtccaaccttccggatgatgtaaagatcagctttgaatttgaccagtctacctatgtcatcaattctgttaagagtttattgagtgaaggaaccatcggagccattctcaccggattgatggttatattattccttggggatatcagaggtgcactgattgtaattcttacaattccaacctctattatttcagccgttttattcttaaatcttttcggccagactattaatatcatgactttaagcgggcttgcccttgccattggaattctcgttgatgaaagtaccgttaccatagaaaatattcaccagcatctggatatgggaaaacctaaatcacttgccgtctgggatgcctgtaaagaaattgcttttcctaagctgttaattctattctgtattctggctgtttttgctcctgcatttacgatgggtgggattccgggatcattattcctgcctcttgcattggccatcggtttcagcatgattgtttcttactttcttgcacagacctttgttcctgtaatggcaaactggattatgaaagtgaaacaccacaaagcaaaagacggccatgttctgacagactctgaagaacttcagcaagctgggctgagcgacgaaaatgatacatggagccagaaagaaatcttattacaaaacgaagacggcaaccgtgacgggaaagtaagtatgtttgaaaaaatcaggttccgttacctgaagtttttagacagaatcatgccctacagaaaaatattggtttccgcctatattatcctgatgatggtaatggtagccttattcttaaacagtatcggacgggatgttttaccccaggtaaatggaagtcagtttcaggtaagaatgcgtattccggacggaacgagaattgaaaaaacagagctgcagaccttaaaattattagatggcattaaagaaattgtcggaaaagacaatgtttcaattacatctgcatatgtaggaacccatcctacccttttttccgtaagtcctatttatctttggatggcaggctcacatgaaaccgttttacaggtgggactaaatgaggattatcataccaatatggatgatttaaaagataaaatcagagaaaaagccaaaagtattaatcctgatatgaaattgtcttttgaacccattgagctgacagaaaaaattcttagccagggatcacctactcccattgaagtaagattatcaggaagggataaaagtgtgaatgaagcgtatgccaaaaaaatagaaactgaacttaaaaaaattccatatttaagagatgttcagatagggcagtctataaaatatccagctcttgacatcactgtagatcgtattcgcgcggcccagcttggtgtggacatgtcagacgtttcccgttcattggtagcatccacctcatcatcaagatttaccgaaaaaaatatctggacggatgaaaaagcaggttacagttataacgtacaggttcagattccggaaaataaaatgaacagcaaagaagaaattgcaggaattccattgcagaaaaattcaaacagaccgaatctgggtgatgtggcaacgattaaaaacagtttcacatacggggaaactgataacctgggagcaatgccaacacttactgttacagccaaccttaaccataccgatttaggaactgcttcaaaagatgttcaaaaagtcattgataacatgggagagcttccaagaggacttaatgtacagctgattggtttaagccagacattaaatgagacactgagcagcttacaaagcagcctgatcattgctattgttgtgatattcctaatgcttgcggctaactttcagtctttcaaagtttctggggtagtattggtaactgcaccggcagttcttgttggatctctagcattattgatcatcagcggatctacattaaaccttcaatcctatatgggaatcattatgtctgtaggggtttcaatttcaaatgccgtgctgttaattaccaacgcagaacagctaagaaaacataatggaaatgctttactttccgcaagagaagctgccgccctgaggctaagacctattgtgatgactgctttggcaatggtggtgggaatgatcccaatggcattaggactgggagaagccggagatcaggtgtcaccgttgggcagagctgtaatcggtggtttggttgcctctacatttgccgccctttttatccttcctctggcatttgcatggggacagggaaaagcaactacccaaagtgtttcccttgaccctgaagatgaggaaagcattcactttatgcctgaaattgttaaataaataacctttagctactaaaaaaaatatgaaccgactatataaatatttaattccggcaatacttattttcagccttcaaagctgtagccatgcggaaaagaaagaaactaaaaagtcagaagaccctgcatccccggaaatcgaaacggttaatcccaaacaggatgatttttcttcatccaccacaatccccggagaattgcagccttatcagaaagtagatatctatgccaaggtcagcagttttgttaaaaagttatatgtagatgtagggaacgaagtaaaagcaggtcagttactggcggccttagaagctcctgaaatcagttctcaacagagcgcagcctcatcagctttaaaatcaaaagaagccctttatattgccagcaaagcgaaatatgatcgtttaaaagaaacaagtaaaactcccggaaccatttcagctcttgatctggagcaggctttagcagcgcaaaaatctgaccttgcgcaactggaggctgcaaaagcatcctatcgggaagttgcagatgttaaaaactatctgcagatcagggctccgttccgtggtaatattgcaacaagaaatgtaagtgcaggagcttatgtaggaccatcaggaaaaggctccgatcttcctatgttcagccttgtacagcaggacagattacgcttggtggttaatgttcctgaatcttataccggactgttgaataaaaatggagatattaagttctccattcaatctattcccggagaaactttcactgcgaaagtatcaagatttgcaggagcactggacagcaaattacgctctcagtgggtagaaatggatgtttataacaaagacaaaagacttttaccgggaatggtagccaatgttattcttcctttaagcgaaaacagcaagtccctgtccgtcccttcttctgctgtacttaattcaacccttggagtatttgtaattaaagtagaaaaaaatactgcccattggatccctgtcacatcaggaattgccaatggcgagaccacaacaattataggacctgtatctccaggtgatgtaattgtaaagactgcaacagaagaaatccgcgatgggcagaatattagaattaaagccccaaaataggcttatagccaaacatttattaacaaaatttatactggcttttttagacttaaaaatttaaaaaacatgctgattcaggataaactgaaataagtttgttaaagaatcttaataaaaaaaaccgcatactgaccaaaaataggctgttgcggtttatttttctttaacatatgtaaataatatgttaaatagtgttaaaataagatcctgataattatcataacaggggtcttttgctcggaatctctacttttgtaatgcttttgaaaataaatattcctttttaacacggataatcaaatatatatgaagaaaagagttttgttttatttagttgctttagtttctacagtttcattacaatcgtgtgctacaaattatgtggtttcaaaaccagcaacttacacaaaagaatacaaaacagatgccaaactagcttctatagataacaaaaaaatggagcaggataagcaaagacttatcgactctttccttgctgaaaaggcggcatctatcgccaacgctaaaaaagcaattaagaattctgagattgcaaaagcagtcaaacataataaaaccattgatggtatccttgaagaagctgaaacataccttggaactccttacagatatggaggaactacaagaaacggtatagattgttcagcttttgttctttctgtatttggagcagcagcaggtcttagcttaccaagagtagcagcatctcaggctcaggaaggagaaagagtagaaagaggagaactacagaagggagatcttattttcttttctcatggaagaagaatttctcacgtaggtattgtagaaagtgtttctgaagatggtgagatcaaatttatccacgcagcaacatcaaaaggagtaatgatttcttcactgaatgattcttattggggtcctaaattcagatttgccaagagggtaatcaacgaagaaggagaagcttataacaatcttgccgctgttactccagctacaccagcaaatttttaattttataaataattgatttaaataatgaagccatcagaattctgatggcttttttatttgatatttcacaataaattcaggataaatccgtgtcatataatatcaactcaccgaatagccatgagttcttaactgttcttatcaatttcaatatccagtttatacaatagtccatatatttcagacagcgaaaatttagcttttttaagcctgtttaaagccggatctatagaataattgaccgaagttctgaaatctgctttttcgaggtttgtaccatcgaaaacagcgcctgacagatcgcaattattgaagacagcatttgataaatcagattcagcgaaatcggcttcaattaatctggaatttttgaaaaccgttttcttaagagaggtctgataaaaaactgaattatttaaagcacacccatcaaatctgaaagataatccgaatggattacaatcattaaactgtagcccaaacattttacaatctttgaaaagcacctcatggaaagctgtcttagtaagttttaccatgctgaggttgcattcattaaattcacagtctgtaaaactgaacccagacagatctgcatattcaaaattacagttgttgaaagtacagttctcgtactctcctttttctatttgagaaccgtttgtatttacgaaatcctggtcagagacataagcttctttcatcatgtaatgatttataaaacgacactatactctgcaatgtgcagatttgcaaaacaggcatatcaaccttttgcgatttatatcaccgcttaaaagatttacaccaaactgtttttatcggaataattaagtttaaagaagataaacgtcatcattgagaaggcaagtaaagaacttcctccataactgaaatacggaagagggatcccaaccgtagggaaaagccccataaccatccctaaattgatcgaaaagtgcatcagtaagatcgaggcaaagcaatacccgaaaacacggttaaatgtggatttctgcttctctgcaaggtaatatattctgccgatataaaccatgtaacataaaataagaattgcacttcctaaaaagccccattcttctcctaccgtacaaaagatataatcggtttcctgctccggtacaaatttaccctgggtaacagatccttcacgatatcctttcccccaaagtccacctgatccgatagctgtttttgaatacagcaggttgtatcctgaagtatccctgaacgccttctctcctttgtaaagaacctcaattctttctctctggtgtttaggaagtttttctaaaatataaggagatccgaaagccagaccgcacagcaaaagaacagaacctgcaattcctgagatagaaatcacatcccatgacattctgtgataattcatggcaatcagaacaccggcaataactaaaactgccaccgcaacataaaccggaggaaccgccagtgaaatcagaaaaacgccggcaaaaataaatcctatcccgaacaaaagcccactcagaccttctctgtataaagcaataaagaatgcgataaacacaagcatggaaccaacatccggaatagcaagaacaactgcagccggaattcctataatggcaagagccgtccagagggactttttatttttaagattaaaatccggacttgaaacataattggccagcattagtgccgtcccgatttttgcaaactccacaggctgcatagtaaaactaccgaacttataccagttcttctgcccgagaatctctttaccaaacggaaaaagtcctatcaaaagcaggacacctccaatgtaaataataccggccatattctcaaagaatttgcttcttcccacgaatataacaagaccaacaacaagagagatacagaagaagaccaattgtttctctcccagtttctgatcaacactgtaaatatttgcaatcgcaaaaatgcaaagcaggaaatacagcccaaggcccagtttatctattccttccgtccatttcattgcttcacagtttttttagcagtgttattttttttagcttcttctattttcttttgcagctttgctttttgttgttttaccaactccaggctatccttaattcttttttgtttaatagaatcaggtttagggtcaacatataaacctttacgcttcaggtctgcaatccattgccttttatactcaggcatgaaactcgaagtgatcatttttttgtaaagattttctctttttaaatcacctgtaatatatttttcagcaatcaccgtacaggccggacctgcccatgtagcaccgaaacccgcgtgttccattactgccactaccacaattttaggtttctctgcaggagcaatcaatacaaaaattgagttatcttttccttggggcacctgtgcagtacctgttttggctaactgcgtaaaatcattggatttcaaaccacgggctgttcctctcaaaactacggcttccattcctttcagaaccggttcaaaatgctttggatctacaagtgttttatgttttactttgaatcttggatcagggtttggcttcccgtcaattgcttttacgatatgaggagtataataccatcctctgttagcaatagctgccacataattggctagctgaataggcgttaccaaaacatctccctgtcccatcccattataaatagcaccggttgacatctcatcccagtttttgaaatcagttctctgagacccgctggccttcatgatcgccttaaatcttctttcgtaaaaatctcctgaaggtattctgcctcttgccccaacagcaaaatcattatttaaaaactccccaaccccgaagctgctcatgatctttttccattcatcaactccttttgaagggtttcccgggtattttttgataatcgcaataaatgcataagtaaagaaacagttactagaaacctgaatagaaggaataagcggatcagctccaccatgacctttgattcttttacctttatagaagaatccgccaccgcaagggaaaatagttttttcatccattactcccatttgcatagccgctaaggcagtcaacagtttaaaagtggatcctggcggatatcctgcctgtaatgcacggtcaaaagtgggtttattttcgtaaagcgtatcttttgacagcgcatataaatttttggatttgttgggtccggtaaaaagattcggatcaatatccggtccggttgcagaaaccagcacttctccattattaggatctaaggctacaattgccccgtgtttattgacgagcatttcttcagctgttctctgaaggtcgtaatcaatcgttaatgtgatatctttacctgtaatgacgtctttatcaagggcaccatttttataggaaccaatattccggagcctgatatctttctggatatattttactccttttaccccacgaagttctttttcgtaggatttttcaacacctgttttcccgatgaagtctcccggtaagtagtaggtagaatcttttttaatgtctctttcatttacctcactcgtatatcccaaaagatttccggatgtggaaacttcatactgacgctggggtctcgatacgatattaaatgcgggatacttaaaaataatttcctgaactcttgcaatatcttctctgctgaggtctttaataaaagtcatcggggtcagcttagaataatatttctcctttttgataacattgattctattgataaaatcctgttttgtgattttcattaaactacaaaatgccagggtatcaaaatcaggtttcattaaagcctgcgtaaacgaaatttcataagcaggctggttacctaccatgattttaccatttctgtcaaaaataaccccacgctgtggaattacatattctgttttaatggaagtattggcagcattcagtgcataacggtctgtaaacaactgcaaataagcaagcctcgccacaaaaataagggcgatcgtaacaaggatggaaaaaatttttaaataacgtgtgttcaaactttttgtttgattttaaatattaatgcgtaaataactataaagataaatgaaattacacttgtcaccaacacattaaataatatttcaaaaaacctgctaaacttaaagaattcaatatactgaactaaaagctgatgcaggaaaatacttgaaaataaaaacagcaaaaactgcgcccactggagggactgaaaagagaaaaagtctgttgacgtatctgtggaagtcctgaagatcaacgttctgaagtaagctatcaacgttgttgcaaatgcattgattccccatgaataaagaaaaccgtcgatagacagccctattaaaaagctcaatgccaggaactgaaatttatttctgaaaaacggatagaacataacgaacacgggatataataccggcgtgtatttcccgaaaagtgtaatcctgttgagtacaaaaatctgtaatgcaacaagaaagatcatgatcaatatatctgtaaataaagttctgctaatcattttctttttttattacagcctgcatagtgtcctgaatcttctgcacttctgctttcttaagattcttcactacatacactttattcaacgctcccattttttcactcagctccacggaaatatcccagaagccggttttgttatccacagaatatcctgcaatggtaccgatggttactcctttagggaaaatagcagacttaccatctgtaacaacggtatctcctatctttaatgcaacatatttcggaatatctgccaggtgcatgacccttgagttatctccgttccatgttaaagtaccaaaataccctgaatttttaagcgctgcattaatcctgatcttgtttacgcttaacacggattgaactaatgcataactgtctgtagaattgattacaattcctgcgattcctctcggcgccatcacccccatttgaggaaagactccgtctctgcgtccgcggttgattgtaaaatagttatttcttctgttgatactgttgaaaacaatttctccatcaacaaaagtataaatctgcccaccaccaatggtatcatgaactcttttaaaaacaggattctttgaaccgtcttttccgtagagttcagtcataagggctttattctgagccacaagatcttcattaatctgttttagcttcagataagaaactccttcatcaatatatccggaaacccatgaattgaacgctgccgtttggcccgcaatccaggatctctgcatggcatttcttgagaatatcaaaaccagagcaataatttgcaggaatataaagaagacgaaaagagtattcttcgaaaataatctcagcaaaaatcccattcagatatatagtcgtaaaaaagttaaaattatttaattaagaaattgaacttatccatattcttaagcgcaatacctgttccgcgaactacagctctcaacggatcttcagcaacaaatacaggaagacctgtctttttgtggattctgtccgcaaggcctcttaataatgctcctcctccggcaagataaatacctgttttgtaaatatctgctgccagctccggtggtgtaagagaaagggtttccattaccgcatcttcaattctgatgatagatttgtctaatgcacgtgcaatctctttgtatccaaccataatttctttaggcttccctgtgataaggtctctaccttgtaccgggatgtcttcgatatctacatcaagatcttctactgcagaacctacttcgattttgattctttcagctgttctttctccgatataaagattatggtgagttcttaagtaatatgcaatatcattggtaaacacgtctcctgcaatctttacagacttatcacatacgataccacctaaagctactacagcaatttccgtagtacctccacctatatcgatgatcatatttccttcaggcttttgtacatcaatacctactcctattgccgctgccattggctcataaataagccttacttcttttgcatttactttctgagcagagtctcttaccgctcttttttcaacttcagtgataccagaagggatacagattacaattcgtaatgccggttggatgaatttacctttgatgccaggaatttttttgataaactccttaatcatgtgttcagaagcatggaaatcagcaataaccccatctttcaaaggacggatggttttgatatcctcatgagttttgccctgcatatgtttagcctgctctccgacggcaatcggcttacccgatgaacgttcaattgcaacaattgaaggttgatcaataacaattttattattatggatgattagggtattagcagttccaaggtctatcgcaatttcttgcgtaaacatatcaaataaactcatatttttcttctgattttaagtttacaaagatataaatttaacactactaaagaaatttcccaccaacttaatttggttaaaattttattaaaatttataattctttattaactttcaatttagaggtttacagactttgagttcaactaaaattcatggagtgttaaaagggctgaaaagcgaaatagcaaaagggtaaaaagactaagaaagcacaacaatgaagacagaaataaaactgaaaaacagtaaaaactttttatacaatatcaattgtgccattttacagttttgccttttatggcattcgcttttatagttttttacgataattatcatatacactatctgagataggttaattaaaaaaatcgtaaatttgcgactgcttatgttacagtattccaatattcatcaaacgtcaaatttcgccgtgctttcaataagctacgagaaagccgacgtagaaacaagaggaaagtttgcattctttgatgagaacatcaaaaactttgtttccagggtccaccaggaagatcttggagatgcatttgtggtttctacctgtaacagaactgagatttatactacatctcccaattatcttttggttgctgaagaatattgcaagactatcggagtacagctgactgattttcttcagtttgccaatattcttacaaaagaggaagccctgattcatcttttcagggtagcagccggccttgaaagccagattattggtgattttgaaatcatcggacagattaaaaaagcatacaaccgtttcaaaaaagaaaggcaaaattcgaatccttacctggagagagccatcaatgcggctattcagatttcgaaaagaataaaaaacgaaaccggcatttccaatggagcggcatcggtttcttatgcggcagttcattatattctgaacagccagaaaagaattgctgaaaaaaacattcttcttttgggagtaggtgaaataggacagaatacggttgaaaatctggtaaagcacgtttatcagccgaaaattaaaattgccaacagaactcaggagaaagctgaaaagatttcccagaaatataatattcctcatgttgattattctgattttgaccaggaattaaaaaatactgacattcttattgtagcaacaggagccaagcatcctattgtcaaccagtcacatttcccgaacggaaaagaaacgcttgttattgacctttccatccctcataacgttgaaaagaatgttacagaaaataaaaatgtaaccttaatagatgtagatgagctttcaaaacagatccaggaaaccattcagcaacgcgaaaaagaaattccgaaagctgaaaaaatcataaaggagctgatgaaagattttattgaatgggagaaaaagagaaaactggcacctaatattcatcatttcaaagcggttttaaagaacatggaacgcaatgaaatgcataatttttataaaaagaataaatacataaacatcacggatatggaactttctgacaaaatgatccagaaaatcaccaaccgttttgcaaaatatatcatcgataaccctttaaaagccgaagaaattagtaaattaatgcacgaaatattagttgaacaaccaaacaacgaattcaatgaaaagcattagaatcggaacgagaaattccgcacttgcactttggcaggctagagaggttgcgaggcaccttcagaacaataattatttaacggaaattgttcctatcgtttcttccggcgataagaatcttaatcaaccactttattctttaggaattaccggggttttcacaagagaccttgatattgccttattgaatgatgagattgacattgcggtacattccttaaaagacgttccaacccaattgcctcagaatattgagatgattgcttacctggaaagggattatccgcaggatattctgatcagaaaagaatcttcgagaaataaagagtttcatgaacttaaactggcaaccagcagtttgagaagaagagctttctggctgagaaattatcctactgctgaattttcggatatccgtggaaatattcagaccaggcttcaaaaactggaggaaggagattttgatgcaacaattctgtctcttgcaggaattaaaagaatgaaaatggaaatcgattatgagatgcttccattaatgatttctgctccgtcacaaggggttatttccgtagccggacatactgacaaaccggagatcaatgaaattgtacgccagatcaatcaccaggagactcagatctgcgtagaaattgaaagaaactttctaagcactttagaaggaggttgtactgcacctatcggagcttttgcagaaatcattggcgatcagatccgattcaaagctgcactttgctctctggatggaaaaaactgcattgctgtagatgaaaactttgtctatactccagctgagaatttcggagaaaagtatgcaaaagtagttcttgaaaacggaggaaaagaattaatggccgaaatcaaaagccagatctgatatttcagattatagattcttacctgttctttttcatcttcttaattttacagacatgaaaatcttatttaccaaaaatatagacccatctattatatccaaagaattaggagaggatattttggttgactgtgttgaggtgattaagaccaatcctatcatgatcagtccttttgatctgaaaaattactctctgatttttaccagcgtcaatggtgttacagctttttttaaaaacaggtttagacccaatgaggattttactgcaaaaaactacaataagatctattgtgtaggcgaaaagacaaagagagagttaagaaaacacggctttggtacatttaaggtattgaaaaatgctgaaacgctttccagatttattataggaaaatgccagcatgagcagtttcttcatttctgcggtaatcttgccatcaatgtcctggataaagatcttccgcttcaaaacattaaatacaaaaaagttacgatttataataccgaggaaatcaatcctgtaataactgaaaaatatcatgctgcggtattttttagtccgagtggagttcgtagttttgcaaagcgaaattcactggaaggaatgaaacttttttcaattggcgaaaccacttccggtgagctgagaaagtatacacaggaagaaatttttacttctgaagaaaatacgctgagctccatctttgcattgatcagaaaagagatcagaagcaggatttagaatacctgttaccgacatatgagatattgccggtactattatttaaaaagattatgattaaaaacgacctatatttaaaagcacttcgcggagaaaccgttgaaagacctcctgtctggatgatgaggcaggctggaagatatctgccggaattcattgctttaagagatcagtatgatttctttacaagatgtcagacccctgagcttgccgctgaaattacgctacagcctatccgcagatttcctttggatgctgcgattctgttttctgatatcctggtagttccacaggcaatgggaattgatttcaaaatgaaagaatccgttggaccatggttagatactcctatcagaactatggaacaggttcagaatattgaaactcccgacgtgaatgacactttaggttacgtttttgatactattgagcttactcttcagaaattagacaatgaaattccattaatcggttttgcgggttctccttggactattctttgttactgtgtagaaggaaaaggaagtaaagcgtttgatattgcaaaatctttctgtttccagcagcctgaagcagctcatttattattgcaaaaaatcactgatactacgattgcttatctaaaaagaaaagtagaaaaaggagtttctgcagtacaggtttttgattcgtggggaggcatgctttctcctacggattatcaggagttctcatggcagtatattaaccagattgttgaggcattaagtccgcttacccatgtcgtagtatttgggaaaggatgctggtttgctttggaagatatgacgatgtccaaagcttctgcacttggtgtagactggactattaagccggaattcgcaagaacgcttactaatcatacaatgacgcttcaggggaattttgatcctgcaaggcttcattcgactcctgaaaccatcaaaaaaatggtgaatgaaatgattaaccgcttcggaaaagacagatatattgcaaacctaggacacggaattcttcctaatgttcctgtagaaaatgctgaggcattcatcagagctgtagtagactggaaaccgaatctgtaagattgattcttttaaaaataaaaaaccttatagtacagtctataaggtttttttgatattaggtttattattttcaggcctattcctttataattttcttcctgattacttctccgcgattgttcgtgatgatcatgatataaactccctttctcaagtccgacaagtcatatgtgtccgatgttgtatcaaaggtttttacaagcttccctgacatatcaataatgtcaactttttctgccttgttttggaggccagattttatataaacctgatccttcaccggattaggatatacatttgtattatctgaataagaagtttccgaagttgccaggactccgctcgtaatcatcacattatctaccacgacgccataagaataatctccggcatcatcataaacaaatctcagtttaaaagcagcattggcatagggtgtcagatctatattggcggcagtatcataactcgttactataaatgtaaatgtattaaaatcgagatcccagactcctgcatcacctgaaaaggtaaaaacctgaacccacgaagttccgttaaaaacttcaacttttaaagtggaatcaaaatcataaatcatattagcataattaaacgaaagctttgggtttgcaactccggtaaggttaattaccggagaaatcagtcgggcatttgtattaactccagtcgggcctgcatcatcgtcatcaaaaaaagcagctccatcgggaaaacccgcaaaaccattctgtgtacctacactccagttataagatgtatccggattttctaccgtccatccggttggcaaagcgttgccattaaagttttcagaaaaaatttgtgcattacaaattccacaaacggataagaaaagaataaatagttttttcataataatggatttgatgtttatataaatttaagaaattatattttacaaaaatacattatgcataaaatcaatactttacattttttaataaaagaattaaaccttctctattattttataactttatatctaacctttaaatcacatcctatgaaaaaattaaacaaagacaaaatgaaaagtattatggcaggaggagaaatctgccttgagtgtgctattggatattaccaggttattattgatggccattgttactgtgttccgatagactaataaaaaaagcagcttaacagctgctttaatttatataagtaatattgtattggttagctcaacattctctgagcttttttaactccttcaactaaaatatcaatttcttcgaaagtattgtaaacagcaaaactcgctcttaccgtccccgcaatattaaagaaatccataataggctgtgtacagtgatgtcctgttcttacagcaattcccattttatcaaggatcattcctacatcagaggcaatccccactccctcaagattaaaggaaacaaccccggttctctttgctttttcaccatagatcttaataccctctaattccaaaagctgtctttgggcatattccaataaagcgttttcatgattctgaatattggtatgacctattctgtttataaagtcaacagcggctcctaaagcaatatttccacctacgttcggtgttcctgcttcatatttaaatggaagacctgcataagtggttccttcgaaagaacatgttgcaatcatctcacctcctccatggaatggcggcaaagcttccaggatttcacgctttccatataaaacacctgtccccataggagcatacattttatgacctgagaatacaaagaaatcacaatccaacttctgaacatcaatattgaaatgcggagcagactgtgccccgtcaataacgatataggcatcagtattttttcttgtctttgcaataatctcctcaacagggtttacaattcccaatgcattggaaacctgattgacagaaacaatcttcgttttttcacttaaaaactgatcaaaatgatccatctgaaggattccgttttcatcaataggaatcacacgaagttttgccccggttctttcgcaaagcatctgccatgggacaatattggaatggtgctccagatatgaaatgatgatctcatcatctttcttcagtttctgggttaaaatataagcgatgaggtttaatccttccgtggttccttttgtaaagattacttcaaaatcatgttcagcattaatgaatttctggattttccttcttgaaagctccatttcttctgttgccagctggctcagggtatgaattcctctgtgaacattagcattaagttctgtataatatgcgtgacaaacttccaaaactgaatttggcttttgagatgtagctgcattatccagataaaccagcggcttaccgttcacttctctgtccagtatagaaaactggcttcttatttcctgaatgtcaaacatttatttattttttaaattaaaacgttcttatttagaactcttcaaatttacggctttttttccgaaaggaagcatgaggttgacagctgatagttgtcagttgatagaaatattcaatgagttataatgaagaaagtatattaaataaaaatagtaaagatgattcatctgaactttataagatttattccaaacaaaaaaacccgtcaaaaattgacgggtttctatattgtttaaataagcaattcttattctgctgctgcttctgctgcttcaggagctgctccttcttcagttgcaacttcttcttcatcttcatcatccattgcagctgcacctcctttcattgcatttctagacatcttaacagcaactactactgcgttgtccgggtgcatgaaagaatatccttctgttttgataccaccgatgtaaagtttgttaccaattcttaatggagtaacatctacaacgatttcgtcaggtaggttagcagggatagcttttacttttagttttctgaaagactgacgtaaaacaccaccagcaacaacacctttagaacgtcctgtaattcttaccggaacttccatgataactggcttatcgtctgataactgatagaaatcagcgtgaagaattttgtctgtaattgggtgaaactggatgtcctgaagaacagctggaattgtttttccgtcaacttcaatagataccgtgtgtgcttcaggagtgtatactagacctttgaaagctttctcttcagcagagaagttcaaaggagctccacctccataaacaacacaaggaactaattcagcatcacgtaaagcttttgtagactttttgcccacgctttctctttttgtaccttgaattgtaatagatttcatttataaaaaatttaaaaaattgttctcattttaatttacaaaccgcttaaaatcaattaaataacaaatttactgctaattgatttatgctcatgaaccatagtcataacgtctgcaaataatggggcgcaagatagcacttttattttagatgacaaattatttttaacaggaattgagtcagttacaataacttccagaatttttgaattctcaatattctcgtaagcctttcctgaaagcactccgtgagttgccatagctcttactgtttttgctcctttttcaattaagatatctgctgctttacaaagtgtacctgcagtatcaatcatatcatcaataaggattacgttcttacctgtaacatcaccgataaggaacatttcttctacaacatttgccttttttctttctttataagcaattaccacttctgcacctaagtgacccgcatagttcttagctctttttgcacctcccatatccggagaagcaatggtaagattatcaaggttcagagatctgatatagtctacgaagatagtagaagcataaagatgatccaccggaatttcgaagaatccctgaatctgatctgcgtgaagatccatagtcatgattcttgttgctcctgctgcagtaagaaggttggcaactaattttgcaccgatcggcgcccttggtttgtcttttctgtcctgtctggcaagtccgaagtaagggattactacggtaatgctctttgcagaagctctttttgctgcatcaatcattagaagaagttccaaaagattgtctgcaggagggaatgtagatccaatcaggaaaactcttcctcctcttacagattcatccaaaacaggttcaaattccccgtcgctgaactcctgaaagttgatttttcctaattctttcccataattctgggcaattttctctgccaagtccctgctggttcttgtacaaaatagataacttaactgatcggccatttttactttttaaaagattttgcaaatttaaaaaaaaaccacaagatttactcctgtggtttctaagtttttattttatcaattattaagggaatttaactcctgaatatttgtttggatctacctgcggaagtgtagagttgtatttggcattgatagatttaataaattcattagccacaattccgtatccacgtcctgtaaggtgaactccatctaaagagaaagctcctcctgttacaaatgttgccgtatattttactccatcccagataattcctgatttagaattcaattccatcattttagcatccatatccacaaaggcaagacctttgtctgttgcggctttttttatcgccgtattataccctgcagtagcagcaataacttttgctgtctcagcttcagtaaggacaagcttatcttctaatggcacggaagtacctccacctgcctgtggagtaagaactttgctggctggtaaaagaattaaatccttggctgttgtttgtctgtattttggaagtcccggaacagttgacagatctttatctacaattacagctccgttaaccgccgctccagcagtaaatttaattaaccttttctgatactccgcatcgttaatagctcctaaggttttagcctgaagcaaacctgcgttatactgagcatatcctgtattcagctgagtcacctgagcatctgttaaacccgtaagaggcatagcaggaattctcgtaaagtaagggacattggtaactgttggaatattagcaataacaccttttctttttgtaccggccggaaatagtttatctactaaataagcataggtattactgaaccctacccctaccgcaccatctactggcgtaatcggaacatttggatcagctcctcctgaagttgcatataataaaacatcattatttcctatccataaagaaatgaaggttgggtcttgttttagtgcatcttctactactgaagttgttgttgatgacgcaaaccttacgaaatatggatttgcagtagcaggcgtggagattaatccggctggatttccatatcccggagccagtaaatgcgctactcttgctcccggaactcccatattctggtaaggaccaccagcagaaacattatccaatgctgctcctggagctgttgggccgggagttaatgctccgttcacaacacttaacacatatttacctgcaaaatctcctgttgctgggttaaataaattggtaaaccctcctgtgtcattaggcatcattggctgtttaaaagctcctccacctgctaattgcatttgtgcagcaatcatgcttggataagattcattttgtccactgctgtaaagtgctccatctctataaccagcagttaatgagtttcctaatgatatatattttgaaaagtctgcgtctccttttgttaccgggatatctctcacatccgtatcgaaatccgtattacagcttgttaccgtaaaaagaagtgcagaaactgcaattgtcgatattataatttttttcatagtcttctaaaattaaaatggattatatgagaaacctaagcccaggtagaaagctgttgctttagactgtccgttaagtccaatattagcgttgtttacctttctgtactgaggcattgcatatcctcctgctatatcaattccgaattgtttcagtttgaaacctaccccgcctgtaaccacataagtatcgtatgaaggtgtctccggaataaagttatccgtagtataaggtgcttcatcataataagctcccaaacgtccgtagatcatatttgtgaacgcatattgagttcccagtctgaatgttttggagtttttgaaattcttaggattggtaagaattgttgggtctgacggattgtttccaataggtgcattatcaaaatccaatgtcagcttactatatctctcccatccatgatagttaaagtctgcagaaacctgccactttggtgttactttataagttaaaccaatagtatattcttcaaccagtggaagtgttgctgaaaaaccatcttgtccggccgcattcagtcttagctgattataaacagattgtgacgggaactggaaggaagcagttccgtttttagctttcatatctaccggtgaacggtaagcaatacttacatctaatttaggatcaggtctgaaatagaaaccgaatccatatccatgtccgcttgcttttttatcattgatgttaactttcccatcaaattgagtaacagctttatcccaatctaccactcctcgtgcatagatatagcttgccccgaaagcaagccatggagccagcttcacagaaaccataggctggaagtaaaaactcttaagctccagcttctgtaccaattctttaccttcccagttatcaggccatttgattgtacttccaaaaggtgtggtaacactaagacctacggtaagtttttctatgggtctataagtaatcgctgcgtaaaaaggagttcctacagggttatctgtttctgcactttgtaaagtgttgaaattctgaaaagtaaccttgttacttgcagcaaaccctcctgccactacactcagtttggaagggataaatgacatacccgccgggttaaagaatgtcacactcgcatcttcagcatgagcactagtatgcgccattgccaattgttttaccccttgcagggaaactctgaagcctcctgcgtaagatagaacgcccgccaataaagcagttgatactaatatttttttcatagactattattatataagccaaatataaaattattttgaatacatctgttaatatttgccaatattttaaacaatatcccaaaagaaaactatgtttgaaataatatattacagaaaacaaactataaaaggcttattattaaacatttaaaacaatataaaatctacagcattcacattgtttaattttaaacaaatgtttaaccctaaagctataatgctctaaaaacccttatgcaaaaacaaaatgataataaatgttaaattaaacagtaattgaaaagtaatgaatttagcacatctgttttattctgcataaaggctttgtccggcctttagcattcatttttacttaaaatacagaaatgttttaacctgaattcaggttatttgagtattttagaatttcataaagataaaaatacataaatttgcagattataaataaacaatagtactatgagttgtggatgtaaaacatccggcgattctgcacattcttgcggccctaagaaaaccgcaaatggctgtgaaaatgtaaatacctgcgggaatagttataaattaagtgtttttgactggctttctaacatcaacaatccggcaccaaacaggtgtgattttgtagaagttagatttaaaaatgacagaaaatcgttttataagaatgtaaataatattcctttacatatcggtagtgtagttacagtagaatcaagtccgggacacgatgtaggcgtggtaagccttacgggagaattagtaaagattcagatgaaaaagaaaaagttttctgaagaatcagcacttaaaatatacagacaggccaaccaaaaagatctcgaggtatggcaggaagcaagaaaaaaagaagacagcgtaaagctcgaagcaagaaaaattgcccagagattaggccttgaaatgaaagttactgatgtggaatatcagggtgatgcttcgaaaatcaccttttattacaccgctgataaccgagtggacttcagacagttaattaaagattatgccggagctttccgtactaaaatcgacatgaaacaaatcggtttcagacaggaggcagccaaagtgggcggaatcggatcttgcggacgtgaactttgctgttctacatggcttacagatttcagatctgtaaacaccaatgtggcaagatatcagcaattaagtatcaatccccagaaactggcaggacagtgtggtaagcttaaatgctgcctgaactatgaactggacagctacctggatgcactcagcaacttcccttcttcttcaacaacgttggaaactgaaaaaggaaaagcattctgtattaaaatcgatgttttcaaaaagaaaatgtggtttgcttatgtagacagttctatcgcatggtatgatttcgatattgaccttgttaaaaaactgatttcaaaaaataaaagaggagagaaaacacttccccttgaagatctgaaacaacctgaaacttctatccataccattgatctgatccaggaaaacaatgtggatcgttttgaaaagaaaaacagaggaaacaggaacagaaacaaccagaataagcagaataacaaccaacagggccaggggcagggacaaaaaagaaacagacctgagaaacaggaaagaccggaaaggactcagaaaaccgagaacccaaatgctcattcagccaatcagcctaaaccccagaagcagcaaccacagcaaaaagcacctgtggaaaaagcagtgagtaatgctgatactgataaaaagccgcagggcaataacccaaacaagaagaaattcaaaaagaaatatcctccaaaaaaagataataatgcataaaattttaggattactttcacttatccttttctttagctgtaactcttcctcaggagaagatgttatgatgaattccgttgataacaaatggaataagaaaagtgagcaaaaatttaatcttgaaatttcagatcctcagaatcctaaaaatattatatttgttgtaagaaataacaacagttatccttacagtaatataaggtttatagtgaatttcaccaatcttcagaacaaaaaaaaggagacagataccctgaattacgtactggcaaaaccaaacggagaatggcttggtacagggtttggtgatacgaaggaaactttatttcagtataaattaaattataaatttccgggaaaaggaaagtatgaaatcggtttaattcaggcgatgagaaacgacaaccttcctggaattgaggacattggtgtaaaaatagaaacggctaaaccgtaaccataaatggaagagaacaaaaaaaatgcaggaaataaggggaaaacatttcctctgcctcccaagaaaaagaaagatacctcctggaaaaaatgggtttcatttatctggatcggactcattgcagtagttctgggaatttcaggacttttcttttcagtttctcaaggattccttggggaaatgcctgatgtaaaagaacttgaaaaccccgatatctttgttgcttctgagatcatttcttcagacggagtaaccctgggtaaattcgaaaaggaaaaaacccagccaattgtttataaagaccttcctccttatcttatttatgccctacaggctaaagaagatgagcgtttcaaagaacattcaggaatcgatttatattctgttgccagagccgtagcttatggtggcggacgtggtggaggttctacgattacacagcagcttgccaagcttctttttacaggaaatgcttcccagaataaaatccagagagcatttcagaaactgaaagaatgggttgtagcagtaagtcttgagaaaagatatactaaggaagaaattatcactctttatttcaataagtttgatttccttttcaatgccaatggtattgaaatggcttccagagtttactttaacaagaagacttcggaacttacattacctgaagcggcaacgtttgtagccatgcttgaaaatccaagaaaaaacaatccttacagatatcctgaaaaggcgaaagaaagaagaaatgtagtattggatcagatgcagaaaaccggatatattgatgctgcaacttatgaaaaggctgctaatactccaatcgaagtggactttcatccaatcaagagcatcactgacggatactctgcttattataaattttacctgagaaaagagattgataaatatcttgaaactcatgaaaaagaaaccggaaagaagcttaacctttacaaggacggtttaaagatatacgtgacccttgactctaaaatgcagaaatacgcagaggaagctatcaaggaacacttaacagatcttcaaaagagatttgacgcagaacaacgaggaagaaaaaacagacctttctactatcttactgacaagcagatcaatgatgtaatggttcaggcgatgaaaagaaccggccgttataagcttttgaaagcagacggaatgcctgaagattctattatgatggaattcaagaagcctatcaagacttcacgattcacctggaacggagaagaagaagtggaaatgtctccatgggattctatcagatatcacaaacaaattgcgcaggcaggtctgatgtctatggttccgggaaccggagaaatcaaagcctgggtaggtggtatcgactggcagcacttccaatatgaccacatcaagcaaggtaagagacaggtaggatctacctttaagcctttcgtatatgcaactgctattatgaagctgggaatgacaccttgttcgactgtttctaacggaacttatgatcacaacggatggcatgtaccgggaagaggaggaatgcttactttaaaagatgcattggcacattctcaaaaccctgttgcagcaagacttattgaaatgacaggagtagatgctgtaatccagactgcaagagatctgggagtaacagaagatattccaagaaacaatacaatcgctttaggttcatcagacattacgatttacgaaatgcttggtgcttacagtacttttgccaactacggtaactacaacaagccggaaatgatctggagaattgaagatgccaacggtagagtcatcaaagaagtaaacgtagaacctaaggaagtaatgaacccaatgtacgcctacaccatgattgaactaatgaaaggtgttgcacaatacggaaccgcttctggagagcttggtagaagaggcatctcaaaagcagtagaaattgctgctaaaacaggtaccactcagaacaactccgatggatggtttatgggaatcactccaaaactggcaaccggagcatgggttggatgggaagacagggcaactcacttctttggaacaggagaaggtcagggtgcaagaatggcattaccaatctgggcaattttcatgaagaaagtatgggcagacaagagtttaggagttactcctgatgataagtttgttaaaccttcagactggaaagacggctgttcaaaccttaaaggccttggcggaggatatggagacgatggaagtcttcagactatcgatgagattaaaaatccaagaccggtagatcctactcctaaaaaaactacagagaagaaagaggataatatcaatgaaaatcttcatactaatgatgaagtagatttcaataaataaattctcttttagaaatacataagacctttcaataatttggaaggtcttttcttttataattaatacctttgaaatatgaatatcgaacgtatcagacagccatttattgagaattttcccggtgatttctccaacaatcctatgcaaagaaatacgccaaaggttttatttgccaccattcggcctgccggctttaacaagcctgaactgatcgcttttaacgaagccttatcagaagaaatcggtttgggaaaatatgaagataaagatctggactttctggttggaaataatcttcccgaaaatgttcaaacctatgctacagcttatgcaggccatcagttcggaaactgggcaggacagcttggtgatggaagagctattctggcaggtgagataactaatgagaaaggaaaaaagacagaaatccagtggaaaggtgcaggagccacaccttactccagacatgccgatggaagagccgtattaagatcttctgtccgtgaatacctgatgagtgaggccatgtatcatctgggcgttcctactacaagagcactcagtctcgcttttaccggtgaagatgtaatgcgtgacatcatgtataacggaaatccggagctggaaaaaggcgcagtagtaatcagaaccgctgaaagttttttacgcttcggccattttgaactgatgtctgcccaaagagaatacaacagccttcaggagcttgctgactttaccattgaaaattattacccggaaattacatccactgacagtaagaagtacaaagacttttttgaaaggatctgcacccgaactgctgatttaatggttgaatggttcagggtaggttttgtgcacggggttatgaatacagataatatgtcagtgctgggattaactattgattacgggccttattccatgatggatgaatatgatttgaattttacacccaatacaaccgaccttcctggaagaagatatgcatttggaaagcagggacagattgctcagtggaatctttggcagctggccaacgcccttcatcctttgattaaagatgaaaaatttttagaagatactttaaataatttcggcacctatttctgggaagctcatgacaggatgctttgtaaaaaattcggttttgatcagcttcagaaagaggacgaagaatttttcaccaactggcaggggttgatgcaggaactccggttggattatactttatttttcaatcaactgaaaaaaataaaccaaaacacaagtattacagaacattttaaagatatctcttatattaatctgaatgaagaaaagatagcgaaacttgaacacttcatccgtaattatgagaccagaatagcattaaactccatttcaaaagaatcctctttggcaatgatggaaaaatcaaatccaaaatttattctacggaattatcttctttatcaatgtattgaagagattagcaacggtaaaagagatatgctggaaaaacttaccaaagctcttgaaaatccctaccgggaattatatcctgaattctctgccaaaaggccatccgactatgatgacatcgcaggatgctctacactttcgtgcagttcgtaatttataatattcataaaatattaaataattagtaattattttcatttttttattacatttactgtcaactttaaacgtaaaccaaatgaaaacaaaattactattcattttcttagtctcttctatattgggaaatgcacagattctcacagagacttttcagggcacgacattccctccgacaggatggacaacaggaacaaatgtagcatcaagaccttggggttttacaacaacaatattcaatgcaaccggtcaggctacatttaacattacaggtggaaaatccgcaggtatcggatggattgctcaggcacaggatgctcatttaacaagtccttccttcagtttggtaggaacaacaaatccggtgttaaagtttaacgccaaaataggatatgaatacatggttgaccctaatcctaacggagacttaaaagtagaagtatctacagatgggggaactacatggaaccaggtatgggttgaagaaaactatggagtttatacagattacgaaacattggctattacggttagtttagctcaatacgctggacaggctaatgtaaaattcagattccattacgtagctaatgatgcagacagcctttcaatagatgatgttcaggttttggcaaatggcacattgtctactcaggaaacaaatgccaaagtaaaagacgctactaatatctatcctaatccaacaaaaggagaaataaacatcaaaacagataaaaaaatcaaatctgctacagtatttgatgtaagcggaaaatctctgttcaacaattcttcggagagactggatatttcttcacttccaaaaggaacatacttactaaaagtagacttctcagacggaacttccaaaacggaaaaagtaatgaaacaataacatcatttatataaacttatacaaccaccagctttggtggtttttttatttacttttgcaaaaaatttgacagtgtcttttatcaaaacaaaaatcatcggtttttccaaactgatctttccttcctcttatacagaagtgacagtatttctgttcttcattacctgttatgggattctgggatcttatattgcccttcattacaggatcattttcgacagcagaattccctgggatgcatatttcagttttgataataaatcgatcctgatgaccggaggaagctttgagagacatcccctgtcctactattttttcaactgggtaagagaattttcattattcatttcaggagggaaaatggatgctaatttcaggcttactctggcatggctgagcaatattatcatctcattgaatattattcaggttttcaaatatttaaagaatattattcaccttccattggggttaagcatcttgattattctcttctttggagctttttcaaccaacattgttctctcttttactccggagaatttcacatatactttatttttgctttctctatacaatcactacgcagccattaaattaagaaaagaagaaaagacacctgctgtcgcgttatcactcgcgggtattacgatcggaggacttactattactaattttataaaggtttttatccctctcctttttgaaagagatcttttcagaagctggaaaaaattcgcgaatgctgcgcttagggttgttgttgctgtgatctgttttgtacttctttacctgaacagaattgattttaaataccagaatatcttttcaaaaaccaatcagcaatatgaaaagttctcaaatgtagaatcgatgccgacatgggatatgattttgtccttcttttttggaggaaatattcttttcccgggatttattatgtcagacaaacataatatgaagggattcaattttaaagggctttatatggatctttattcatcagctctgccttacttttttatagcaatattattgattctgataagttggagttattttaaaaatttcaggaataaatgggtccagatcatcactatttcatttgcagttgatatcatcatccattgtgtgatgaggttcggacttcatacttcctatatctatgggggacatttcgttttcgtctatccgatactgttagggtggctgttttacgcttatagaccctcacctaaaatcatgtcatttttaacattgacactggtaatattattcacttacctgttggtcaataatatctttagaatgacagaatttttctggtttatggaaaattattatcaataaaaaaagctgagaaaatttctcagcttttgtttttttatgttgaaataaattgctcttattttgcttcagcacagaaaattctatactgtaccgctactgcagatttaaaatattctctgattctggaaaggtcacttgctgcactttgttttgtgaaataacttcctgctaaaattttataattaggtcttaaagaagcatccgtttccactttcaggttaggaaatctctttctaaaataagattttacctcattagcttcttcattacttttcactgttgtaatctggattttgaaccctaaaattctaggattttttctacaaatttcagcattggtaagctctctgctcggcacaaagattttaggaggttttgtatttattccggtagaaattccactatcattattgctgaaatccttagtggaatttgttgggacagctttagcacatttcccttcaactccctccaaagcagcattaattttggaatccatcgtcatgacaagctccgttcccgacagggtatcttttttaacaacctgctgtgcctcaatattataaaatccaaataatgataatatcgaaaatattttgattagatttctcatttaaacttgtttccgcaaatttatacaaattaaaaaactataccaaacaggttatttagaatcaatacaaattaaccttaaatgacattttcccctttttatatgccgttaaatttctgttaaaaatattatttttgccgaattgattgaatgttcaataatttactaacataagataatttaaatgattagttggagaaagcattataaaaaaacgttgatcgcgataggcttattgctatcaaccagtgcttcattttacgggcaagacggcgatcctaaaaacggagagaaacttttcaaagcgaattgtactgcatgtcacgcgctggacaaacaggttgtaggaccaccattaaaaggggttgtagaacgtgtaaagacagaaggtggtgtagacaaagactggcttcacaagtggatcaaagacaacaaagctcttagagcttctggggataaatacgccaatgagatttttgaaaagtttaataagactgaaatgcaggtctttccgaatcttacagacaaggatattgacgacattttagctttcacaactaaccctcctgctccggaggagaaaaaaccggaagcaactcctgcaactgacgccactgcggcagctcctgcagacaaaactactacaaacgttgtaatcatttcacttttagcgatcgcagctttactggtttggatcttggtaaaactaagacaattggtaaaattgggtcaatctgaagatttagcaggacttaacgaaacaagagttcgttcgttcagtgaaatgtatgagaagttccactacattggtaaaggtttattagcaattcttgctattctggccgcttacggagtatggaactggttgatgtggattggggtttacaaagggtacaaacctgaacagcctatctacttctctcacaaaatccatgctggggaacagaaaattgactgtcaattatgccactccagtgctaaatatggaaaagtatctgagatcccttctatgaacgtttgtatgaactgtcacagaacaatctctgaatacaacaaagatcactacatggagccaggaaaagacaaggcattctatgacggtgaaatccagaagatctacgctgcaacaggttgggatcctgcaaaacaacagtacacaggaaaaacacaaccggttgaatggacaagaatccacaacatgccagacttcgtttacttcaaccactctcagcacgtcattgctggagaacaggcaatcatcaattctttcaacaaaaagaatcctaacaacaaaattgatgttgtatgtaaagcttgtcacggtaaaattgatacaatgaatgttgttcagatggctaacgactttactatgggatggtgtatcgagtgccacagaactactgaagttgatatgaacaacggttataataaagagtacttcaagaatctacatgacaagttgaaaaaacaatatccacaagatggaggtaaaatcactgtagatgcaattggaggtcttgagtgtggtaaatgtcattattaataactaaaaaattagaagtataaatggcttcaaacaaaatacaattcagaagtattcatgaacttaaagatccggctttgaataataagctggctcagaaagagtttcaggaagaaattccggtagaagatttccttggagatgctgagaaaaacggatcaagtacttcaagaagagatttccttaaattactaggattctctacagcagcagtaacattagctgcctgcgaagctccggtaatcaaaacgattccttatgtggtaaagccgcatgatattattccgggaatccctaactattacgcttcaacttattttgacggtttcgattttgctagtgttttagtaaaaacccgtgaaggaagacctatcaaaattgaaccaaacccggctggtggcgatttaggtaaaactaatgcaagagctcaggcaagtgtactttctctttatgataacgataaagtaaaacagcctaaactggacggaaaagatgaaactttcgataaagtagacagttttgttattaaaggtttggaagaagctaaagcgtcaggcaaaaagattgtggttttatcacactcttttgcttcaccaactttcaaaaagttattcgctgaattcaaagctaaatatcctacagcagaattagtaacttatgatgcattcccttattctgcacaattagatgcagctcaggaggtattcggacaaagagcattacctgtttatgaccttagaggttctgagctggtagtttctttccaggctgatttcttaggagattataacgcttcaagcttagagacttcttatgcagcagcaagaaagccaggaccaaacatgttaagacacatccaggtggagtctaacatgtcattaaccggtgctaacgctgactcaagatacagattaaaaccaagtgctgtaaacaagactttagttgaagtttacaatgcaatcgtaggtggtggtacttctgataagactgctactgaaattgctaacgaattgaaagcaaaaggaagcaaagctgttgtttttgctgacggttctaaaggagcacaggttttagcacacttaatcaaccagaaattaggttcagtagctttcacaggtaaagccaacttactgaaagaattcgacggtgcaagataccaggaattccttggatgggtaaacggtggacaggttggcgttttagttaccaacaatgtagatcctatctactctcatccaaaaggagaagatttcaaaaaatctttatctaaagttccttacgtaattgctgtagcagataagaaaaatgaaatgtacaaagcagcgaaagctgtaattccacttgctaactggttagagtcttggggagatatcgaaccacagacaggagtatattcattaatgcagcctaccatccagaaaatctacaaatcaagacagattgaagaatctctattggtttggaagaacggaaaaaacaatgcggcaaacaactactacgattatttaaaagcaagctctgcttcttttttaggtggtacttctttcaacaaagcattgtataacggtatcaacgcatctactaattcaacaacattatcttacgcaggcggaaacgctgctcaggctgttgctgaactaggaaactttaaaccttctgaattagaattagtattatacactaagacttcaatgggagacggtactcaggcaaacaacccttggttacaagaattacctgatccaatcacaagaatgtcttgggataactatttgacaatttctccaaaagacgcagaaaagttcggaattgataacgatcttaacgcaagaatgcagttagatggttctatcgtaaaccttactgtaaacggagtaacaataaaagatgttcctgtattcgtacaaccaggacaagctgaaggatctgtaggtcttgcacttggttatggtaagaaaaactcaggagcaactgctgatactggtgtaaatgcttatccattatttgacggttctaatcttgttctttcaggtgttaaaatcgagaaaacaggagaagatcacgaatttgcagggatccagcttcaaaatacattgatgggtcgttatgagatcgcaaaagaagttcctttagcagatttcatcaatgtagctttcgatgatgagcacaaaggatggaataagcctttggaataccacacgatcagcggagctcttccagcaagaaaaatcgacctttgggatgctttcgatgatacagacggtcctcacttcaacttatctattgacctgaactcttgtacaggttgtggagcttgtatcattgcttgtcaggcagaaaacaacgttcctgtagtaggtaaagaagaggtaagaatgtcaagagatatgtactggttaagaattgaccgttactattcttcaagacaaacggtagaagtatatgaaggattaaaagatggaatggctgtaccagaattatacggtactgcattcaacaaagagggaggtgcattgaaccacccagctgataatccggatgtaatcttccagccagtaatgtgtcagcactgtaaccacgctccatgtgaaacggtatgtccggtagcggctacttcacacggtaagcaaggtcaaaaccatatggcttacaacagatgtatcggtacaagatattgtgcaaacaactgtccgtacaaagtaagacgtttcaactggtttacttataacctaaatgacaagttcgatttcaacatgaacaatgatttaggaagaatggtacttaacccggatgtagttgtaagaactagaggggtaatggagaaatgttcaatgtgtatccaaatgactcagaatacaattcttgaggctaagaaagaaggaagaagagtgaaggatggagaattccagactgcttgttctaaagcttgttctaccggagcaatgacatttggagatatgaatgataaagattctgaaattagaaaggtatatgcctctaacagaagatattatttactagaggagatcggaacaaaaccaaacgtgttctatcatactaaagtaagaaacagagtagaaaaataaagtttaaataataaataggtaaaaaatgtcaggacattacgaagctccgataagggaacctctaattattggtcacaaaacttatcacgatattacagaagatatcgcacgacctatcgaagaaagagcaggtaaattatggtggatctcattatatgctgcgctagttctattcctctatggattcggctgtatcgcttacactatcgggacaggtattggagcatgggggcttaacagaactattaactggggttgggatattaccaacttcgtatggtgggtaggtatcggtcacgccgggaccctaatctccgcagtattattattatttagacagagatggagaatgtctgtaaacagatctgcagaggcgatgacgatctttgcggttgtacaggcggcaatcttccctgtaatccacatgggtagagtttgggttggatactgggtattccctttaccaaaccaattcggttctctttgggggaacttcaactctcctctactttgggacgtatttgcgatctctacgtatttctcagtatcaactgtattctggttcatgggtctaatccctgactttgcaatgatcagagatagagctaaaactccttggactaagaaaatttatacattccttgcattcggttggggtggtaaagcaaaacactggcaaagattcgaagaactttctttggttcttgcaggtttggcaactccacttgtattctcagtacacacaaccgtatccttcgacttcgcgacttcagtaattaaaggatggcactcaactatctaccctccttacttcgttgctggtgcgatcttctcaggatttgcaatggtacagaccctattgttggttgcaagaaaagtttgtcacttagaagagtatattacaatgtatcatatcgaaattatgaacatcgtaattatcttaactggtggtatggtaacggtagcttacgccactgaatatttcatcggatggtactcaggttcaagattcgaagatttcacatatctttctccgggtgctgccgtaggaccttactggtgggcattctggtcattgatcatctgtaaccttgttgttcctgcttctttctggttcaagagactaagaacgaacattatctggacattcattgttgcattaatcattaacatcggtatgtggttcgagcgttttgatatcatcgttatcaacctttcaagagactacttaccaggatcatggaccatgtttaagccaacgatcattgatgtaggtgtatacttaggaacaatcggattcttctctgtattattcttattatacgcaagaacgttccctgtaattgcacaggctgaattaaaatcgattttgaaaatctcaggtgaaacttataaagcaaaagaaggagatgagcaccactaaaattgtatacggactttatgctgacgacgacgatttaatgaacggcgttaaagcattcaacgataaaggaatcgcaatcaacgaagtttatactccgtttccggttcacggactagacaaagctttaggtttaaagaaaaccagaatttctgatgctgctttcatctacgcttgttatggtgtaactatcggtgctactttaacctggtatgtgatgaatcacgactggcctcagaatatcggtggtaagccagcttttgactggggacacaacatgcctgcattcgtagttccaatgttcgaattaatggtattctgtgcagctcacatgatgtctttaactttcttggttagaaacaaaatgtatccgggggctccggctcagaacccagaccctagaactactgatgataaattcatgatggaattcgtaactgaagatgtagaatctgtaaagcagttgcttattgaaactggagttgaagaaataactgttaaagacgcttaaaatgaaaaagaatgtattaaagattacagcagttttaggtttaacaacagttttacttaactcttgcggaccaaaggagaacactccgttggtatatttcccggacatgtattttccggtagcttatgatccattgatgaaggctcaggatgcgtattcagatcatgaaaatgaaattcctgcttttgttaaaaataatggagcaacaggtctttctcctgtagaaggatcagttcctcagaataaagacggagtttttgaagaaagcttattacctaaaaatgttgacgagtacaacgcagggtatgaagcttctaaaaaacttacagtatctcctttgaacccagctaacacagcgaaggaccttgaaagaggtaaaatattgtttgatcacacttgtgctgcatgccacggaacaggaggtgatggacaaggacctatcgtacaaagtggagcattctccggagtaccgaactatgctgacagagaaattactgtaggatctgttcattatgtattaacaaacggtagaaatgccatgggatcttatgcgggacaactgaacgcaggagacagatggagagtagcaatgtatgtgatgagtgctttcaaaaaaggagcagcagcaccggcagcagctacagcggcggcaccagcaacaactgaaacgactaccgaaactaaaaaataagaaaagaaatgtatagtttttcaccaaaattaaaatcaacttctataatacttcttgttgtaggtttagttcttttcggtattggtttctttttgaacaaaggaatttctactgagaaaatagaacaaatgatggaagctgttcatgcttcaggtcatacggctcctacacattcaagtgaaatggttggacctcaggatcacgcggctcatcttgagcacgctacattgcaggtacacaaccagcctttagcagcaatacattttgtagctgtatttttctttggagtaagctgctgcgtattattcttctattctattcagcacgctgcccatgcaggatggcctatcatcattacaagagtaatggaagctattgcttcttatatcccttacggtggtgcaatcctggtaatcctgatgatcttaaacatcactcataatggtcacctattccactggatggaccctgaattgacaaacccggattctccgcattttgatgtgatcttattcgaaaagaaaaaattcttaaatattcctttctacgcagtaagaactttaatctatgtgattggcgcttctttcttcgcatggaaattaaaagctcagtctaagaaagtagatgaaacgaagtctaaagtagagtaccagatgctttacagatggtcagtaggatacatcgcattcttcggatttgcttctgcagcatgggcttgggactggttgatgtctattgaccctcactggtattctacaatgtatatctggtattcaatggttagctgcctttcaagtggtattgccgtaatcattttattaagtgtttaccttaagaaaaatggtttcttaccacagttcaatgataaccacttacacgatttaggagtattccttttcgctacaagtatgctttggacatatacatggtttgctcagttcatgctttactggtatgccaacgttccggaagaggttaactacttcttcggtagattccagcactactctcctactttcttaccaatgttgatcatcaacttcttgttaccactattggtattagtaagcagcagcatcaagagaaattacaaagtagttactacaatggcagtagttgtgatcttaggacacatcttagattacttcaacatggtaatgcctggaacagtaggaccatactggaacactcctgaagtattccttttaatccttggagccatcctgttcgtagttggattatttatgtttactgtactttcagctttatctaaactgaagttgatccctacaggaaacccattcttacacgaatctgaaatttatgagtatcctttctaaggacttgtaacaaaataaaatgataaaagactgattgttaaaacgatcagtctttttttatgcatattggtcaacagctaaaacaaatcttattatgaaaacaaaacttttcctctattcacttttcttttttttagtcagctttatccaggctcagaccattactttcgtttctgaaaaaaataatattccccttcccagagtttcagtatttggaaaagacggaaccatcttagcctattcagatattgaaggtaagattgataaacagtcattgtctccttcccaggaaaagtttcagcttgtttataataattttccggtagctactttatcatattcggactttgaccaatcggttataaaaattaatgatcaggtaaaagaaattgaaacagtagttatcaagaacagtaagcctgccaagtatatttttatcaaaggaaattttaatgcctatgttacggtaaataataagctgaacagttatgcagacggaattgtaagctatatttttgacaacaaaacaaaaaaactgaaaagtacccatgtagagcagtaccgagtattcagaatggcagaatctaaaaacgaaaagaaagaaacttcgtcatgggattatggcaactcactgaatcttccaaagcttaaaaatgtggggaatcccgaagaatataaaaactcaaaaaatacgatcagagaattgaaaggagatcgcagagatcagattgaagtaacaggaggaattcttcaggaaaaagaattttcatttttcggatacagattttatgatataagaactattttaaatatgtcgtttgaaaaaggatctgaaaaaacattaaaagattttctggaatataacgaacttgtttttgttaagctaaaacacaaaagtgaacctgaatacaatcagatttcagtttataataatttctatcctacggaattaagcttcaacaatgacaacgatgtagaaaaagtaaaatttgataaagacaacagcaattataaaaccccttactggcaggatgcatcatttcccaatatgcagacgatcttcagtaactttttcaaaggagatctgaaagaacagcctaacaaaaagtaaaaatttaggattatgcctactttgaacaggaatataacagtctaaaaaacataaagtgaaaataaaaatccagtattaataaaggttttattaaatttgcaacaaaccaaataaaaatgaaaaagttttcttttctacttgttttcagtctgttgctttttacagcatgcaagaaagatcatgtagatgctacgaatactaaaacactgcagtcaagtatcaacgatatgacttccagtttacctaccattaaacagattaagtttaatgaagctctttacatccttaaaacttttggagtagaagctgatggtgatatcaatgagctgaaggccctgggaaaactgatcaatgggaaaaaagtacctgagatcatggctatggctgacgaagttgcacagaaaaacggaattgaatgggcaagtactgctcctccatcactgggagaaatgaatatcttcggagatgataaagctaaagaaagcgatccaaatgatgtaaaagcaggatcattaagccttgtgacaagacctacaggagatgacggaaccggagcgcctacagctattcagattgttccgagacttgtagacgcagcaggaaacccggtatcatttacaggagccggcctcgaagctactcttgaagtattcagtaacggtgtaagactggcaacagccaaaaacctgatgcaggataacaacttcaaaggtttcaatctgaaattctcctctatccctgcttctaaagtagtggacaataaaatagacattacggtttctgtaaagacaacagctaaaactttcaaaatgtcaaaaatcgggcttgatgtgaatgcagcagccctgaaagtgcctgttgttccaaaaaccgattctacagctgtatcggaacagccaagcgcagtggtagatccaaataacccaacagctccttccggaactactactgatcctgcagcggctactcctgcagcaccagctgcaccaaaacagccgaccacagatcctaaaaatacagtaagtaaatttttgaatagcgtaagctctcagaatttaaaagcagcctatgaaacatccagcaatcctagctggggtagctacgaatctttctcaaaccctacttcaggtttcgggtctgtgaaaaatgtgagcataaagaatattacgacaagcggtgctacagccaacagcgccagcgtaaatgctacttatgatgtaacggataaaagcggaaagactacttccctaaaagtaactttcgggcttaaaaatgtaaacggagactggaaaatttccagttataaaatcaattaataaatggcttcagcagaactgatcaacaaattagaagaaacaattgaaaacatccctgattttccgattccgggaatacagtttaaggatatttcacctatctttttaaacccaaaactttatgaagaggtaattgcagatcttgcagtcttcagtaaaggaaaaatagatgcagtctgcggaatagaaagccgtggttacctttttggaattgctattgctgtggcattggaagttccgtttatcctgatcagaaaagccggaaaacttccccctcccatcatttcggaagaatatgatctcgaatatggaagcgccattatcgaaacccgtgaaggacagttaaaaccaggacaaagagtcttaattcacgacgatcttttagcaacaggaggaaccacagaggcggctgccaaactggtagaaaaacaaggagccaccgtttcacaattcagctttctgatcggcctaaaaggattgggaggtgatgagaagttaaaaaaattcggtgctgaagtctaccatattttagaatattaagatttaatatatatgcttcgacatgctcagcatgacaaccctaataaattactgtgagatttgaacaggtcatattagaagtgtcatcctgagcatgtcgaagcatctttttttaattaattcatcattcacaactacaattcataaaatttcattaataatactcataaagtattttgtaaatcattcagaaacaattaaatttgcatttcaatttttaaaaacttatggcaaaattgggaaagagtgctcagaatgagcaagaaggtaaagaaacggttgagttctttaaagaccttgacagagaagcattaaacactgaaagatttgttgaaaaatattcaaaaccgttgggattaatatttggagcactgcttttaggggttttaggattctttgcttataagcaatttgtaattgctccaaagaacgctgaagctgtaaaaagtttccttgctgctcagaaaaaccttacagaaggtaaagataaagatgctttaggcggaaaatttgcggctaatccgggttttatcggtactgctaatgaatattcttctactgaaattggtaaactttctgcttacaatgccggtttattaaaattcaaagaaggaaaattccaggaagcgtatgatcttctggataaattctcttccaaaaacaaaactctgatggcaatgaagtatggagccatggctgatgctaaatcaggtcttaacaaaaatgacgaagctctttctttattagaccaggcagcatctgcatcagatgatccttatactacttattatttcacaagaaaagcaggtatcgttgcattaggattaaagaaaaatgcagaagctaaaaaatacttcgctacaattgacgaaaaatatcaggactacgacaacggaatgtctgattcttatattgaaatgactaaatattattaaaaaatggcaacagttaatctttccgattacaagccacttcatataactaatgccgaagatttttctatcggcattgttttttctgagtggaatgattttgtaacatacaatcttcgtgatgcagctttggaaattcttgaaaaagaaggcgtaaaacctgaaaacatcaagcttttcccggttccgggcgcttttgaattaagctatgcaagtatgcagctttgcaaagaaaggaagtatgatgcagtaatctctatcggatgtgtaatccgtggagaaacaccgcattttgattacgtatgttctgcagtagcgcagggaattaaggattgtaatattatgactgatactcctactattttctgtgtattgacagatgataccaaagaacaatctattgcaagaagcggtggagatcttggaaacaaaggtgtggaagcagccgtaacagctcttagaatgattgatttcaaaaagaaattatctgataaaaaagggaatatcggtttcggacactcttaaccgggattcactttcaaaatatcatggactattttttaatagtccttttttattggaatattaataaatcataaatctcattaataaaaaggatgtttttgtttttttccatcaaaagttctctacaaaaactatctttgtgaaaactaataaaaacagacaatacatgtttttaaaaaaaataaaacccttcctttatttaggaattttctatcttgttatttcattgataataagaacaatattcttttttcatcctattacaacggctagttttggatttttcgaagtcgtaaaggttctgctcataggtctggtaaatgacgtttttgtcttcatcctggccagctccattctcgccctttatttcctcttcctttccaattcgaaatataaaaaaccttacggctacattattttgggagcattggttctgttcttcctttatatatggcttgtgccgaacaatatttttaagcaatacggcggctctgtaatggaaatcgctcttgctttcgtaggaataaaaactcttttctttggattgatgcttttccttcctgcacaaagaattaaaatccgtaatacactgtatttcataacgttattactatacgttcttttgattattttcaacggcgtaagtgaatatttcttctacaatgaattcggggtacgttataattttattgcagtagattatcttatttataccaatgaggtgatcggaaatatcatggaaagttatcctgttattccattgttttccgcaattatgatcgttacacttgccattacatggtttatttataagaaaacgaaagatgaacttctggaccttcctgattttaaacaaaaaatggtgcttctcggtagttttatggtactttgtgctctcagtgcattggctataccttctttaatgcagatcagatcagacaatgtttttgctgatgaaattgaagcgaacggacttcctaagttctattgggcatttactcataatgagctggattatttccagttttattcacagattaaccagcagcaggctgaaaagaatttcctgagccagtacccgcagcataccttatcaagagcagttgttgctgaacagccggaaatgaagaagaatgtagtattgatttctatcgaaagcctttctgcagatttcatggagcattatggaaatacacagaaaattacccctttcctggatagtcttgcagaaaggtctctgatgtttaccaatctttatgctaccggaaacagaaccgtacgcggactggaagctttaacattgtgtattcctccaactgcgggagaaagtatcatcaaaagagatgacaataagaataaattcacaaccggaaatgtttttaaatccaagggatatgacgtcaaatttttatacggaggttacagctatttcgacaatatgcaggatttcttcggaggaaacggatatggtattgtagacagaaacagcttcaaacctgaagaaattacttttgccaatgtttggggtgttgctgatgaagatatggccagaaaagccattcaggtaatgaatgctgaagcgaaatcaggaaagccatttttcaatcactggatgactgtttccaatcacagaccgtttacttatcctgacggaagaatcgatatccctggaacagcaaaatcccgtgaaggcggtgtaaaatatacagactactcacttaaactgttctttgagatggctaaaaagcaggattggtataaaaacacggtttttgtgatcattgctgaccactgcgcatcgagtgccgggaaaacagagctaccgatggataaatacagaattcctgcgatggtattctcagaaggatttatccagccgcagaaattcaatgggctgatgtctcagattgatgtgatgcctacccttttcggattgctgaatttcagctatcagtctaaattcctgggccaggatgtgttcaaaccggaattccagcctaaagcttatgtagcaacctatcaggatctgggccttataaaagacggacatctgactattatttctccggtaaaaaaggtaaaacaatattctctggaactggaaaaaagtgatctggcacctgagtttaagctgtattacgatgaaaaactattaaaaaatccggatcagaaacttgtagatgacgctgtatcagcatatcagtctacttcttactggttaaaaacgaaacaacttaacagataaatatctaaatattttcgcttataatctggtgtaaaatatttaaattaaccgataaatttattagtatgaaatggacagacgacagaggcggaaacgttgatgaccgccgtggttcaggaggcggaagtggcggcatgattgtaggaggcgggctcggaaccttaattatagcagccatcgtgttctttttaggaggtgacccgtccggtattttgaattccggaagcatgcagccttcaggcaatacaggagaacaaagagaactgactgccggtgaaaagcagattggagaaatggtaaaaatgatggatgcatggaatagtcagacctggactcagatttttaaagaaaacggcatgacgtataccgatccgggtattgttcttttcgaaaatacaacttcttcagcatgtggtacggctcaatctgccatgggaccattctattgtccggccgatcagaaagtctatatggatatgagtttttttggtgaacttcagcaaaaattcggagctaaagtaacagaatttacggtagcttatgttcttgcgcatgaagtaggacaccatgttcagactcttttgggaactacacagaaagtagatgcattaagaagaagcggaagatattctgaagagcaaatgaacagagtttccgttgctacagaattacaggcagatttctatgcaggagtgtgggcgaaaagaaccaatgacagcaaacatattctggagcccggagatattgaatctgcaatagatgctgcagaagctgttggagatgataatatccagagaagagcacagggatatgtaaatcaggaaagctttactcacggatcttctgcacagcgtaaagaatggtttatgaaaggatacaataccggagatatcagacagggtgatactttcaaccagctgttgaaataatttataaaactttaaataaaaaaatgcggcctcagtgtgaggccgcatttttttattattgtaattcgatcggattagaatttctctttgcttcttcttttatccgctcctccattctctttctcatatcggcaggattctgatttcctcccccgccagggcctccaattctcatgggtgcagctacaccaccaccctgattcataaatgacattggatctgttttaaacttttgctgctgttttacaaaatcggctcttttcacttttaaagtattcccaaactggttcaaagtcggaaactcggcaattttgtaattcttcatgagatcaaaagaataatctcctttgtcatcttctatttttacaattaatcccggaagtccaccaaacttatagggaccgtcctgataaggaagatctgtggtaaaccatgcagtccattttctgcctccaaaatcggtttctgctttctgaactttgtattcgccaatttttcttgtttctgactctattttccagttcagcggtctgtcttcttcgtacgaataaatatcacggccgattctgtctttgaagtaggttttttggtttgtcttatccttttctacagaatagttgatattggacctcagactttccatctgatctctgttgatacttcctcttcctcctccaccttgaaatgccttttgcatgatagaatcccttttgattctgttttcagaataaaaaaccgatttttccggagaaatatccagataagcattttctgtcttgacatctgttttattttctgcatccggcttcatagtcacatgatacacaaacctgtttgtctgtgcagaaacattctgtatgaagagtgccaatgcgataatacctaattttttcatttatatttttatttattttaattcaattggattctgggctgtatgggtcaaagaaggaatttctccagacgaatctgttgagacaggaattccttgattttcaccacccattcctctgtgcattccgccaccgcctctcattcctccgccactcattccgcccatgccaccatgttttcctcctccaaaattcatatttccagccattgcttttctgcttttaccaaactccagctccaacgctgctttatcgccatggaaatttatccttgtactttgtttggcatccggctgaatctgttcttcaaaagcatttttaatattaatctttttaacaagatcaaatttataatctcctttgtcatcttccagctttacaataagtcctggcagtcctgagaatttataaggtccatcagaaaaaggaatctctttggtaaaccatgccgtccaggttcttcctccaaattcagtgactgctttttgagcagaatacccattctgtttctcaattacattgatcacctcccattttacaggtctgtcttcctgatagtaaatttgttttccggcagccttttcatagtaatacactttctgttccggaatagctttggtaataaaatattcaaaaaaagtaggctcaaaatgttttctcccttccatttttgaaaaatctttttcttgttttctcgtttctttcgcttctgattttacagaagtaaaaagagagtctctttttagtttattttcactgataaataaggaatgcccttctttaatatccagaaaagttctctcacttttcatgcttaccagattgattgaatccgggtttaccagcgtttcataaacgaatcttgtggtttgcccataagatattgcagtaaaaaacaacacaaaaaaagttataattttttgtcccattaccaattttctttatagatcggaaatacctcagaaggttaaaattacaaatgaaatcttcacataaagagaagaaatttatctgtttttaacataaatctttgctttaaaaatccctattaatatcagaatcattaaaatagatatcttcgatttgagattgcggaaattagttcgtatttttgcatcattaaatcattctaaataaatacaatgataaaagtatcagatcatgcaaaggaaaaagccatccagttgatgacggaagatggttttaaccctgctgaagattatataagagtaggggtaaaaagcggcggatgctctggtttagagtatgttttaaagtttgacaacgaaaaaacagacgcagatcagatttttgaagataataacattaaaattattatagataaaaaatccatcctttatttagcaggaacaactcttgaatattcaggaggattgaacggaaaagggtttgtttttaacaacccgaatgcatccagaacatgtggatgcggggaatcatttagtctttagagaaaagacattagatcctagatttcagacctcagagctattctgaattctgaaatctaacatctgaaatctaaaaaattataatgagtaaatatacagaagacgatttaagagtcgatctagaaaataaaaaatacgaattcggttgggaaaccaaaatagattatgaagatttcccgattggtttaaacgaggatatcatccgtgccatctccgctaagaaagaggagccggaatggatgactgaatggcgactggaatctttcaaaatctggcagaaaatggtagagcctacatgggctaatatcaaatatgaaaaaccagattttcaggcaatccgttactacgctgctcctaaagtaaagcctgagttggcaagtcttgatgaagtagatcctgaattattgaaaacattcgaaaagctagggattaatatcgaagagcaaaaaagactttcgggcgttgccgtagatatcgtaatggactcagtttctgtgaaaaccactttccaggatacattggcagaaaaaggaattattttctgttcaatttctgaggctattaaaaaccatcctgatttagtaagaaaatatcttggaaaagtagttccgagaggagataacttttatgcagcattgaattccgcagtattctctgacggaagtttctgttatattcccaaaggagtaaaatgcccaatggagctttccacttatttccgtatcaatcaggcaggaacaggacagtttgagagaacccttgtgattgcagatgaaggaagttatgtttcttatcttgaagggtgtacagctccgtcaagagatgaaaaccagcttcatgcagcagtggttgagcttattgctttagacaatgctgaaattaaatattcaacggtacagaactggtaccctggtaatgaagaaggaaaaggtggggtatttaactttgtaaccaaaagagggctttgcgaaagaaatgcaaaaatctcatggactcaggtagaaacaggttctgcagtgacatggaaatatccgtcttgcatccttaaaggagacaatgcaatcggagaattctactctatcgcagtaacgaacaatcaccaatatgcagatacaggaacaaaaatgatccacattggtaaaaacaccaaatcaacaatcatttccaaaggtatttctgcaggaaaatcacagaactcatacagaggactggtgaaagtaatgccttctgcaaaaggggccagaaacttctcccagtgtgattctctgttgatgggtaatgaatgtggtgctcatactttcccttatattgaaattaaagatccttccgcacaactggagcacgaggcaacgacttcaaaaatcggagaagatcagattttctactgtaaccagagaggtattgatactgaaagagctattgccttaatcgtaaatggtttcagtaaagaggttttaaataaacttccaatggagtttgctattgaagcacagaaactacttgaaatttcattagaaggatcagtaggataaagatatgttagctacagaaagattaattttaagaaaaccaacaaaagaagattttgaaaaattctttgaaattaatcatgaccctgaaaccaatgttcataatccagccggacccatgagttttcaaaaagcagaaagtacatttaccagaatgcttgaacactgggaaaggtatcatttcggaagctgggcaattgctgaaaaggaaagccctgaaaatataataggttttggaggtctgagctataaactctacggagaagaagaaaaattgaatttaggctatcgttttgcttcccaggcatgggggaaaggatatgccacagaattcaccaggaaagctatagattttgggcttaatgagggcaacaatgaagaaatttttgctattgtccgccccagcaatatagcttctgttaaagttttggaaaaggcaggtatgatcaacatcggaacccttaatgacgttcctggtcaacctgaaagtttagtatatagaattcaaaaataatttgtttaagcaaataaaatgttagaaattaaaaaccttcacgccaaaattgaagatggcgcagaaatattaaaagggatcaatcttgaaataaagccaggcgaagttcacgctatcatggggccaaacggagccggtaaatctaccctttcttctgtaatcgcaggaaaagaagattacgaagtgactggtggaaagattcttttcgaaggacaagacatcagtgaagatgctcctgaagatagagcccacaaaggaattttcctttctttccagtatccggtggaaattccgggagtttccgtaacgaactttatcaaagctgctttgaacgaaacaagaaaagcaaacggactggaagaaatgcctgcaaaagaaatgcttgccttaatccgtgagaaatctgaaaaactgggcatcaaaaaagattttctttcaagatctctgaacgaaggattttcaggaggtgagaagaaaagaaacgaaatcttccagatgatgatgcttaatcctaaattagctattcttgatgaaaccgattcaggacttgatatcgatgctttaagaattgtagcagacggagtaaattattttaaaaacgaaggaaacgccgttcttttgattacgcactatcaaagattgcttaattatattcagcctgacttcgttcacgtgttagcagacgggaaaatcatcaaaacaggtgataagtctttagccttagaacttgaagaaaaaggttacgactggcttttaaattaatttgaaatttactatttgagatttgaaattatgccaaccattcatgaagtgcagcaaatatgaatctctaaagtaaaaattggattcctattcctcggaataacaatattttagttcaaaaaaaagaaaaaaatggtgcaaaccacagatataccagtaatggcattaaaagaacaaattatagagaaccataatgagtttttggagagtcttcgtcacagatttctggatgatgaaagaaaaacggcgcttcaaagatttaacaatattggttttcccactaaaaaagacgaagaatataaatataccaatctaaaggagatcacggaaaaaagctacaacttcttcccgaaagagaaccataatatcactaaagagcagtttgatgagttgcatcttggagaagaaaattttgattggatcgtttttgtaaacggcaaacttcacaaagaactttcaaaagtttctattgaaaacgtagagttcctttctttcaactacgcattgaatgatgagaagcacaaagaggtttttgaaaaatactttaataccattgcttctaaagaacaggcctttacaaacttaaaccttgcttactgcaaatatggtttctttttgaaagtacctaaaaatgtagtcattgaaaagccaattcacgttttttacatttcccagaaccaggaggaaaatacattctacaataccagaaatcttttgatcgtagaagaaggtgcaaaagtagaagtgattgaaagccatcataattttgacagctcttatgtattgaccaactctgttacggagatctttacttatcctaatgcaaaagctgactggcacaaacttcagaacgataacaacacaacttaccttatcgataatacttttgcaaaacaggagaaagacagtttaaccactgtaaacacattctctttcggaggtaaactggtaagaaataaccttgattttattcataacggatcgaatatcaattcatttatgaacggaatcaccatcatcggaaaagaccagctggtagaccaccatacagcggttcaccacaacttcccgaactgtgaaagctaccagaattataaaggaatcttcgatggcaatgcccatggagttttcaacggaaaagtttttgttgataaaatcgctcagaaaacaaacgcttaccagcagaacaacaacgttttgctaagtgaaggagcaagtattgatacaaaacctcagttagaaatctttgctgatgatgtaaaatgttctcatggctgtaccgtaggccaattgaatgaggatgcattattctacctgagagcaagagggatctctaaaaaagaggctcaggcattacttctatatgcattcgcaaatgatgcaatgcagaacattgacatagaacctctgaaagaaaaaatttcaaagctgctggctgagaaactagaagttgatatagaattttaagacttatatatattgatacacaaaagcacttcaaatgaagtgctttttatttttgtgataagtcgttttatttttttaaccagctttgattgtccttattatctgaacgctttttgccattatctatattataggcaagacctacccctaatgtctgtttcaactgtgttttccatatctggttatggtcatacaacagatcaagggtaacattggtggaaatgtatttattgatcttcatgcttaaaactccgctatatccgagaacaagcctgtccgggtgatcaaggtagtttgagaagacagatgctgtatttaacagggtaatgttctccataattttcagcttatacatggcagtacccaaaaaaccgaactggaaaagggaagaatctccatcatttttaagaccataagttcctgctttctgaagatctttgtctaaaacaaatgtccatcttgcattggccggacgtaaggttattgtaagattatcattgggacggtacgtaactcctgctcccacgctcagatatccgggagccataaaattggaaatctttttagcatcaggattatttccatcttcataacccggagcaaactgagtctgaagaccgactcctgcagataaataccaatgtttggcgaattctctaccgtagttggtagaaagattaatgacatcctgtgtttttcttactcctgttccctgagtattattttgtccataccccagaataataatattctcccaaagatcctttcctttttcgtaagtaagattgtaattaacaccggcaagccatcctacgttgttggctccgcctcctacccagttggaaaaggctgcctgattaagcattaatgtattttgtccctgaatagaccaggctttcacagtgtctgatgccggcgcatctgttttagtctcctgagcaagcgctaaagccccgaaagagatagagctgatcaataaaagttttttcataatgtttatttattacaaatgtataaataataatctacgtctttataaaattcactttaaaatgaatttaacaccaccggatttacccctataacattatgaaaataaattatttaactacaaacacagtatacctcaaacttaagtcaacttaaagttacagtcttttaaaaacaaaaaatacctcatttctgaagtacttttcttagaatgtataattaattctttgttactttttgatccaccattggctgtctttccggtcagaacgttttacaccgttgtccagcgtataagcgaaccctattcccaaggtttgtttcagctgtgtcttttctatctgattgtgatcgtacagcaaatctaaggtcacattagaggaaatatatttgtttactttcaggttcagcaaggccccgtaagccagaaccaatctgtccggatggtcaaggtaattcgagaagacagacgctgtattggtaagataaatatcttccatgatttttaatttgtatattgccgttcccagaaaaccgaattgcagtaatgaagtatcgccatcattctttaaaccgtagcttcctgccgtctgaaggtctttgtccaatacaaacgtccatctggcgttggttggacgtaaggtaaccgtaagatcatcattgggcctgtacgtgatccccatcccgacattcaggtaacctggtgccataaaattggatattttttttgcttcaggattatttccatcctcatatcctgcagcaaactgtgattgaaatcctgctcccatagagaaataccagctttttgagaattttcgcccataattggtagaaacgttaatgatgtcctgtgtttttctgattccctggccttttgtatcattctgtccatatccaagaatgatgatattttcccaaaggtctttatccttttcataggtcagattgtaattgacaccggcaagccaccctacattgttggctccccctcctacccagtttgaaaacgctgcctggttaatcatcaatgtgttttttcctattactgaccagtattttacggtgtctgtcaccacggaatctttctttaattcttcttgagcacttgcatacattcctacaaaaaaggaaagaatcaataaaaacttcttcattactctaaataattttcaatacaaaagtattaatataattttttttaacgatatattcagctttaaagaattccatttcaataaagtttaattaactaacaacaaggtatttcagtaaaatcaatgccaaataataagtttaaaaattaaatttgataccttttgtcttaaaatcaaataagtagaagcccattcatcgacaaattttccgaaatttatcattggcttttgatttgacgtaaaatccccatgtttaagaatgtaatttccaaaagagcaattatatacccgctgctgatgctttcggcaatgtggttcgggtattttttacaaatgctgggcttctttcaaagctgttttggagccattattcctcttttgcctgagggattgcttggaatcattacctctcctcttttacatggaaatattgaccatatcataggaaactccattccgattgcagcactgatgtttctgctgtatcagttctatccattggtcgccaacaaggtttttattatcggatggctggcaacagggcttttggtttggcttcttcctcccattgacattctcaccggagaatatatgtatacctgtaccatcggagccagtggtgtggtatatgtgcttgcttttttcctttttttcagcggggtattcaagtggaatacgaaacttctgaccatttcgatgcttgttgtgctgtattatggaagtttggtatggggaatgcttccagaagagcttttctacaatatggaggagcccagtaagatttcatggcaggcacacctttccggagcggtagtgggaagtatcatcgcctttgcttttaaaaatgttggcgaaaaaaagaaaaaattcatctgggagttcccgaattactatagtgaaaaggatgataagttgtggcaggaatacaaggaaaatcatcctgaagattttatggagcttccgtacaagaaaaaagatgatatctgggatcatttggatgaattgaggaagagataaaacttaatttcactacatttgaaaaaaaacacagatgatctccgaagaatacttatatgctatcgccctccgcgagtgcagccagattggcgatattcaatttcataaacttgtccgtactttcggaagtgcccgggaagcatggaaaagggcaaaaaaagagtataagaagctcgaaggaataggacaaaaaaccgtttccgatattggaaatgcagctcatttgaaattcgcagaagaagaattaaatttttgcgaaaaaaataatatcagaatcaggctgaaacatcatagcgaactccctttcctgcttaacgaatgtaatgatgcacctgctattctttatcaaaaaggagaacttaataacatactgccaaaagtaagtattgtaggcacccggaatatgacagaatatggccggcagtttattgaaaatttctttgaagcaacccaattttcaaaatacgtctctgtgagcggtctcgctttaggcgttgacaaagaagttcatgaacagtctcttcattaccggaaaccaactatagcagttcttgcgcatggttttcaatatttatatcctgcaaaaaacagaaggctttctgagaaaattttatatgaaggaggtgcactcataacggagttcagttcttcaagaaaaccagaccgggagaacttcattcagagaaacagaattgttgccggattatctccttctacaatcgtagtggaaaccggttttggaggcggttccgtaagtacagcagcctttgccaatgattacaaccgcgatgtttttgcgctgcctggaaaaattacagaagtgtctagtcagggatgtaatcagttgattttccataataaagcaacagcaatttctaccatcaaagatcttgtccgtctattgggatttaatgatcctaaagaaaaaacagaagagttatttccttatagcgagaccattatgcaactatctgaaaatcaaaatacaatatatcaatccattaaagaacacccacatatttctttggatgatcttgtacaaaagattgatatttctactcacaaaatcttaccgataattttggaattggagcttttagggaaagtaaaatcgttttccgggaggcaattcatagcgatttgatatttaacgatttcttaatattgcattatttcacacataacatttcatttttaataaaatttaaagacaaattatcaatttaataatattacgaaacattattatttaatttttaataatgttaaaatatagtgttgtgaatcttgaaaaaaaaattaaatttgttgacaataatattcaaccttaatatatggaacaatataatattgaccagaaaatccaagagtttattgcaaaaattgaagcaaaaaatcctaacgaaccggagtttttacaggctgtaaaagaagttgccgtaacagtaattccattcattgctacgaaaaaagaatataccggaatgaagctgcttgaaagaatggctgaagctgaaagaattattattttcagagttccatgggttgatgacaaaggagaaattcaggttaacagaggtttcagaattcagatgaactctgctattggaccatataaaggaggaatccgtttccaccctactgtaaacttatccgttcttaagttcttagctttcgagcaggtatttaaaaactctttaacaacgcttccaatgggaggtggtaaaggaggttcagattttgatccgcaaggaaaatctgatatggaggtaatgcgtttctgccaggccttcatgacagaattatgtaagcacgttggtcctgaaacagacgttcctgcaggagatatcggagttggagcaagagaaatcggatatttattcggacaatataagaaaatcagaaatgaatttaccggagttcttacaggaaaaggtcttgcttacggaggttcactgatccgtcctgaagctactggatacggtgtagtatacttcgctgagcagatgcttaaaacaatcggacaagatttccaggggaaaactgtgacggtatccggtttcggaaacgttgcatggggagttatcaaaaaagcaactgaactgggtgctaaagttgtaacaatctctggtcctgacggatatatctatgataaagatggtatcagcggagaaaagattgattatttattagaacttagatcttcaggaaacaacagagctgaggattatgctaaaaaatatccatctgctgaattccacgccggaaaacgtccttgggaagtaaaatgtgatgttgcattcccttctgcaacccaaaacgaattagatttagatgatgcaagaaaattagttgaaaacggatgtatctgtgttactgaagcggctaatatgccttctacattagatgccatcaactatttcttagataataaagtattattctctcctggtaaagcttccaatgccggaggtgttgcaacatcaggattagaaatgactcagaactctatccgtcttaactggacttctgaagaagttgatgcaagattaaaggaaatcatgatcggtatccataaggcttgcagagactacggaaaagacgaagacggttatgtaaactacgtaaaaggtgcaaatattgccggcttcgtaaaagtagcagaagcaatgttggctcaaggagtggtgtaacaaaaaatacaaaggttgggagaaattcccgaccttttttgatatagcctgttcccgggataatgggaaaaaagtaaaaagtgaaaggagaaagcgttgctatatgcagcgctttttttattgtgcaatgaaagacactgatccatattttcatctttaaaatgcgcccagttgataaaataaaataaataaaaaatcctgaaatacaagatttcaggattccgactagtgtttgctaaagtgcttttactttttctttttcttatctttcttttcctctttaggagtatctgcaggcttggttgcatcagtaggtgttgtacttactgacggatctgttgcaggtgctgtctccgttgtagttgcaggtgatttttcctgagttttcggatccgaaggacttgtagtctgggtattcggttgttgagtttgagttgtcgtagtgttattagtagaagtatcggccggcttctgagtggttgattgtgctgatactgcgattactccgactaaggtaaacgctgccgttaaaaataactttttcataatgataatatttaaatgattgtttaacttaaacgaagcatcatttataaaattatgcgtaagtagcttatttaacggactttatgattatttaagaggaatttgcaaatataaatttgtttggtttggctggaagagtgacgctggaagctggaagctttttagattagaaataataacttaacagaagattcattaagtttaaaatcaaaaaaacacagtttttattatcaacaatgattacctcccatcttccttctcacaaagctatttcgcaatattcttcatcatcttttctacaaattcaaatgctgccgggcagatcactgtatttttcagcattaaattattaatctgatagatttttttccggtctgtatgcggatattcacgacaggcttttggtcttacttcgtaaatagagcaggtattatcactattcaggaaaaaacaaggaagattctgcagtactttatcattgtcctcatccactcttaaaaattttgcttcaaagtctgcagatttcattcgcagatgtttggcaatgcgttcaatatctttctctgtataaagagggccggttgtcttacagcaattagcacactgcagacaatctatctcttcaaaaacttcatcatgggtttcctgcactatataatcgagatttttgggcggttttttctttaatccgtccagaaattttttgtgttctttctgcttttgtatagcctgttttttataaaaatctaagttcatctattctttatttcttacgaaatccgggagctcttctttcctgtactcattaattttatccagatccagtatcgttgaaagattttctttatttggataatacatcgggacaaattttgcaccgtatacaatttcccctgtagtatacgaagacctttgtactacagtatttgaaaacacttcatcaaatgcacgcacctgcacaataagttcaatatccgtatttttaaaatcctcttcggaaaaaccgtaaaacggagaattctcatcaattttatgcactacagtccagttgagtgctaaggtattaatcttacttaattgggtttcaagcctgtaaaaattgcttttggcaactccgttttctataacttcaatagctgccgacaggataacatcagcatccgttaatgcattatttttatagggggcaagcctgaacattaatgcggaagattcctgaaaaggagcaataagcgcaatatcggagaatctaagataggccctaggccttgaaaaccttccgtaaaaaagaccggttgcaatggcaaaggtaagtaatcccagaaaagcttcaaaggtcgccacaaggctcgccaaaaagcctaccggtgctattcttccgtacccgactgtggtaaaggtctgggaactgaagaaaaaaacatcaataaactcgtttagcggatcacttttgtcgatgccggtaagatgttccactccgattagataatagatcatggcgaaagccaggtttaccagaatataagcaataaccagataggaaatgaaacggaatgaagaaagattcagcatggtgtgataccagcttaacctgttaaagacattcacacctctcctctggacattcgggagaccgtccttattgatgaatcttccggatgcattggttccgaaaccactattctccgcatttttctgacggatcttttttctgaatcctcctgtcatttttatagcattttcttaccgtttgtggtgcaaagataaaatattgttttgatgaattttatcaattgattcatttgagttttaaatcgattttggagtacatttgaagtatgaaaaaactggaatcaagagaggacattgaacgccttgtcaactcattttatgcaaaggtagttaaagatgaagccatcggattcttttttaatgatattgctaaagtagattgggataaacatcttcctaaaatgtattctttctgggaatctattctttttggacagatgacttataaaggaaatccgatgggagttcacttcccgattaatgagatacaggccatggagcagaaacattttgacaaatggctcgaactctggagaactacgattgaagaaaactttgtgggagagaatgctgacatggcgatttacaaatcagaaaatatagcaaagctaatggctttcaaaatggatctggccagaagactgtaagggaaatgtattcgggatgcgggatgcgggatactaaataaacagattcacttaacttttctgcgatttgtccttttgccttttctcttttaaggaacgattactgtaaagatataagcagccagattcactaataatacggtcccatacagaatgttggtttttccgcgactaagggaaagcattacgataaacacggataaagagagcaaaataacgtcttttttgtccagaccaagcaccaatggtatatcatacataatacacaccactgaaactgcaggaatcgttaatccgatacttgccaacgcagatcctaatgccaggtttaagctggactgaatctgatttgcacgtgccgcccggatagcagccacaccttcaggaaggagaacaacagctgcaataattacccctacaagagatttgggtgcccccagacttcttaccatactctcaatcgtatctgataatccttttgccataagcactacaattgccagacaaacaagcaggaaaacaaagcttatcagtgttttggccaaggtaggaatataatgctcttccggatgttcatcgggaacaataaagtagcttctgtgacgcaccgtctgaaccatcaggaagatcccataaatgataagacaggcgatggatataaaaataagctgagcttcgttatagaaaggtccgttaacacttgaagtaaaattgggaaggaccagtgtaagcaccagaatggaaacaatacttaccagataagtagtggctgaggttctcgcaaaaaactgctcatggtatttaacgcccccaacaagaatacatatccccagaattccgttaagaataagcattacggcagcaaaaactgtatctctggccagcgtgattgcctgatctccgccggcaaccatcagcgagatgatcaacgctacttcaataatggtgatacaaagagcaaggataatagtcccaaaaggctcccctactttatgggctacaacttcagcatgatgtactgctgataaaacacttccgattaacaaaataccggcaataatatcataaaaaactcccgttcccatcaatccggaaaagtagtaccctaccgcaaggagaggaaaaatataagtgtaatgtaagaattctttaagtctcataaagtgactacaaaatacaaaaaatctataatattttcaatatcaaaagaaattattaatgttattttaatgaggccagaagttaaagtcctgataatctgttaacatatgaaacaaaagaccaattcctataattctgatattgcctctgaaaaacaacatcaaaaaatacaccgcaatggcataataggaatgtaaaaaatggaaaccaatactttcccttgacgggtcaaaaacaggattggcaaaaagatggtccagatctaccagcattgtagccaataaaatgagatacacttttttccagtgtttaggataaaaaatcaatgctataaataccggaaatacaaaatgtaaaaaataatgtatacacgttttaagcagagcaatttcagatggagccattaatgctatattttcagtttagattaccaccgtaaaattaggggtaaatctcctttctttgcttttatttttacccaataattctgtgctttatttccatacaggatataatcaatatctgaaatgatctttttctcactgtcagtcaatgattttaaagatgaatacagcaaggcattattcctgatcagtaaataattttcgtttaactgaggtgataactttactggtttcctggtcgattgtatgacaattttattattatttgagctgatcttattgggctggaaaggaatagccgtgaattggttttctctattgatccatttcttagattgaaaatactcccacatttttacggaattatcactttcaatattaataacataattaggctgcgtaatcttctgaaaggtctttttttccacttcattaaagttgtcatcatattcataactgataatggtatcgttgacctgctccagatcagcgatagctttcagggaatttgcctgtaaggaatccgcaatgccttttttgaaaaaacgggtaaaatttctgatgttttctttgtcaagttccagttcaagaaaatgattttctttctgaagttttgaaaatattgcatcaaatatttcagtatctggattatttctgatctcaatttcatcatcatccagttcaatagaaaaattttgaattttctgcccggaaatgaaggaaatacttcccaatgtattgtgaataaactgatctgcatcccaaatatgatttgcagaaggttgaagaacctgtttctgaatggttttaaaagcagaatcagaagttcctgcaatacaaatgttattttctatcctaaagaaaatctggcccttctgaaagcagttatttcctttatcagtaaacttttgcttctttaaactggcaatgaatttctgtgaatctttaagttctaaaatggtataccattcggagaatctggtatctttaatgtggaaaatctgtaaaaaatcaggaattctgattcctgagtctatggcctggccggaactttttctttttgctttacttccggaccatactgagggatgtgtaagccagctgaagagatattgtcccgttaatttcttagtgtcaattaaaacaactgcatctgcattctgaggaatatatcttagtcttttatccttatgaaaaactataaaatatactgcaacagccagcaataaaagtaacgggacaataatcttctttttcttcatctataaaatttgtggcttcttttctgtttcttttgttttaaaaacctgatcgaatatatcaaagaaatacattaaactgttttctgaagaatctttgatattataatccatttcggtctggatgctttctccttttacttctgttttataatacaactctcctacattttttctgacagcatccaatgctcttctttctttcgcgctcttgaattctttatctaatcccgtcaaaagcttcctgatatccagtcttcctgacaaaggatatttcgccgagtcttttgcccattttctggaaatatcagactggtttacagataaaatattgtcggcagaactcatcaggtatactacaccatcttttaccgtaaaaaacagctggtcgatatatcctccgtctttttcttctttgaaagtgtacagatttccttttttagagaatcttttggaaaatttcttgttggtcgccagcacatcaaaaatacggttccagtatccttcattttccgttgcaaaggcgaaagtgaagttaggaacagcgatctctttggttttctttacttctttttcattgaagtcagcatcatattcgtaatctgtatattctactgttttggatttcagttcattcaaaacgaatattccgtttccgggagctattttcgtaatggcttcttcatccagaacaatcttcatggtttccatgatcagctccatttcttttttgtattcattttctccggaactctgaagaaggctgtacatcatatcaaagcattttgccccattgacgttcatggcatagtaaccaacacttttttcattgatcagctccagcagctttttgtttttcttacctttataaacagcctctatattcttttgaatatcagcatttttatgttgataattattaaccagccttactttatctttgtcgaaatacagattgtaagaatagttggaatcatacatattcctgaaaaacttatcatagctatagaactttgtcatcttgccatagatgccttcattcacaattcttccgtagtccgtgtacacaaaaacatcagaattggagtcccggaatttcagcatttctttaggaacttcaatttctaaattggaactgaagtatagatcaaacctttcttcagcattctttttaacgaccatgaagttttctctacggatagaatcctgctctttttgataggctttttcttcttcctcgttataagcggtatcaggcatttcttctccattttcaggactttcagtgttttccttttcttcaggatatttatgatgcttttgcagatatttgatatccttctgaattcttgcgatttcgttgttgttatctttaatgctttctttcagatacttaatatcctctttcaggtttttgatttcctccttataatcaaatggtttttccggttcatccgtataagctgtatccccggcatctacagcaacgctgtctgcaacggccaccgaagtactgtctgcaacggcttctgtagcccagatatctttatatggtctggtataactgatcatgctgagaaccgcacggcttccgttccatgccacaaaaacatcatcattgatatcaacgtaagaatagttttttctgctggagacttcctgtccttttttcttcactgaattaatgaattcccggaacttttctttattatcaatgataaagtgggtattataggtcttaatagaatcattaaaacttgcataatggtactgaacagcgtcatatttgattcctgttttggagtagtccgtccatgaaaggttttctttgctttttttgctgagctcatgcagcaaaggattcagtttattccagttgattttattattcagctgctttccgttgacctccatataaaatacggcatcagacggtattttcatgctgttctgggctaaacacaacgtaaagccaaaaagtacgaaaataattttttgtatttttaataagatagatttcatgactatagtttagaaatttattgaaaaagaattgtgttttggatttgttttttctgaaggatcagatccaggatatcagcatccagtttgacagcttttttattcggtgaaagtatataattattattgctttgggatttcaccggagtttcaaattggatgatggaagtatatttcgcatcattaaaaacttctttgtctgccttactcagtttgtcgtaatcggctttgaaagtattcactttatttctggtgaatgtctttttttcaagattctgaccataaacttgtgtagggaccattttacctaaaattttctgagctttaagtttttccagaccggcattgatgttttcaatttttttgaaattacagcttagtctgatgatataattatcaaaatccatggatgttttcacattgctgattccgggagttgctttaaaaatttttgcggcttcattgatcttgttttcaatttccgcctttttgggaaccttttttccgttgatggtttccattttggagattgatgcgagtcttgttttgcttttgctggcgttaagaattatggtatattctcccgtaccgtctgcttttaagtttactttatcaagaatatcgaaacagcttgtcagaaataataaaggtacaaatagaagaaataatctgagaaaatttttcatgattgggtttaaaagcacaaaattactcaattccggccttacatccttacaatctttgattttttgggcataaaatagctgtttcccggtactttttcaggggaaatacggtattgcttccgtatattatttttaaacacgtcctttgagatagtccagacgaagatcttcgtccagtttttcaatagcataccgaaggcaggtcctcggcatttctttgtaatatgaattcagatagctgatcagttctccttcattcttatttcccatttctctaagcagccatccgtttgccttatgcatcaggtcatgaggatgcttcatatttctggttacgaattcttttgtaaggtcaaatgaacctttttttatataatgcatcgtccccactacagcgattctcttatgccacatttcttcagattctgaaagttccctaaggaggttttctttctgattttcaaaagcatacctgcctaaaattttgtaacaggtagaatctaccagatcccagttattgacataagtaagatgatcaagataaaaagcgaccacttcttcttttacagctttatcttttgttttttcaaattttgaaatcagcataaaaagagctgttaatctatgctcatggtattctgaagaaagtaagatgctgagttcctgcaggcttattttatgataatattcctttgccactgagcgctggtccggaacttttacgcccaaaaacaaatccccttcgccatattctccttttccggttttaaaaaatctcggaaagaatgctgccttttcagggatggaaagaacagctaatgcttcctgtatatcttttacaatactcatattccgaatagctgttatgtttaagctttctcttctacagcaatattctcctgctctttttcctctttggcaatcttattaggattggccactttagcaatggtaagcccctgaacaatgattgagaagaccacgacacagtaggtaatacttaagataatctggctgtattcacttttaggaatagacatcgccaatgcaatagacactcctccacggattcctccccaaaccagtacttttacggcctgcggactgaaacttctcctcagagaagtaaattttgaaggtccccagatagaaataaatcttgccaataaaacgaccacaatagcaaccagaccaggaatcatgaaatgtctgaggtctttaatcatcagaagctcaaaaccgatgaacaggaataatacggcattcaggatttcatctatcagttcccagaatttgatcaggtagtcctgagtaatggatttcattttaaatctcacattaaaattccccataaataatccggcggcaaccatcgtcagtggcccggagatatgcatttgtcttgcaataagatagcctcccatcacaacggaaagtgttaccagtacggaaataatataatcatccacttcacgcatcagcctggaagtcacccatccaagcaatcctcccagtaaaatccctcctccggcttctctcagcagcagcaaaccaatgttttcaactccaagatccacttcatttccaatggcaagctgcaggacaacagtgaaaaccactacggccataccatcattgaaaagggattctccggcaacctttgtctccaatgatttggaaacatttgcctgtttcaggacactcagaaccgcaacgggatctgtaggcgagatcagcgctccaaaaacgagacagtagatgaaaggaagattaatccctacataaggtaataaataaaacatcccgaagcctactacaaaagtggaaataacaacacctaccgtagaaaatatcaataccggccggaactgctctttcagatcgttaatgttaatatggattcctcctgcaaaaagaagaaaattaagcatagctcccattaaaacctctgtaaaatcgatgctgttcatcaggttgtgaaggtgtccgaaagttctcggaagtactgtttccccgaacattaccagaaaaatggaaaccacgatagcgatcaccataattccgatagtactcggaagttttaaaaacctgtagttaagataggcaaatattgatgctaatacgattaatgctgaaaatgaataatataattccactaagtgtttttttattttgagattaattggttagttccaaataaagtattttaatataaatctgcttcccatctttttcccagatgtcaaacataccatctttggccggctttgagcttcttttataatcctgtcctacattcaggatgttgagcaggatatattcgtcccctacagaattgacaatataagctgtcttttcagatttcccgtctcctgaaccttttatgccttcagtaagtgcacggaactgattcaggtgatggataaagttatttccatcctttaaagaatcatatgctctgagtaggataagcaaaatgtccaggttggtaggatctttgtcatacaatgcttttccctgcttgatgcagtctgcaaagttattctgcttaaaagcatccacaagatttttaaagctgtcctctgatgtgcttatcttatcatttctgaagtttcttccgtagtacagatactgtgattctatactgtctaaagacttcggatatcctttaaatttaaaaattagtttctcgtaattgtatggagaatcaggatttttgagacttttctcaatagcttttaaatcaatttttgatttctggctgaacccaaaaaccgaaaacaggagaaataaaaggaaaaagtgatatttcattaattgttgctttcttcttcctcatcatcgaaatattcgaaaaggaaatcgttgtacgggaatctggaaatatgaatcttcatgacctcatcgtagatcattttcttcatttccgggaaattttccttcgttaaggcagaaatgaaaaccgttgggtattttgattttgccatccatgtttttttccattcttccagtgaaatatttttacgggttgaaggtgtaagatcatcttcatcctttttctcatagctgaaatcatcaattttattgaaaaccataatcattggtttctgatgtgcgttgatttccatcaggatatgatttacagattcaatatgatcttcaaaactttcatgagaaatgtctaccacatgaatcagaagatctgcttcacgaacctcatccaaagtagatttaaacgattccaccagctgggtaggtaattttctgatgaatcccaccgtatctgtaagcagaaacggcagatttccgatcactacttttcttactgtggtatccagtgttgcaaataatttattttctgcaaaaacttcagattttgaaattgaattcatcaaagtagattttcctacattggtatatcctaccaaggcggcacgaactacctttccacggttgttacgctgggtagccatctgcttgtcaatcgtcttaagtttatctttcagtaaggtaattctatcacggataatacgacggtcagtctcaatttcggtctcaccgggacctctcatcccaatcccccccttctgacgctcaaggtgggtccacattcttgttaatcgtggtaaaagatattgatactgggctaattctacctgagttcttgcgtaagaagtctgtgctctctgggcaaaaatgtcaagaataaggttggtacgatcaaggattttaacttccatttctctttcaaggtttttaagctgtgaaggtgaaagttcatcatcgaaaatgactgttcctatctcgttttcttttacatattcttttatctcaatggcttttccgcttccgataaaggttttggagtcaggctgagtcagtttttgggtaaaacgtttttgtacggttgctcctgctgtgaaagctaaaaactcaagttcatctaaatactccgtcagtttttcttcgtcctgattctgggtaataacacccaccaggaccgctttctcatagttatgttctttcttttctagcattaagttctgtctatgtttatgatttttacaagttaatatttttcagaaaaaaaacaaaatcaatttttatttaataacatattttaatataaatttaagttagctgatggaagatgtataaaaattcaataactttatataataaatttctgatttttaattatttaaatcaaaaactaatctccggaatatcatgattacgcatatcagatgtatgattattgatgatgatgaactggacaggctggttcttcagcattatatcaggcaatatcagaatattgaaattgttgcctcttttgactctgcagaaaaggcgattccttatcttgacctccctattgattttctgattaccgaaaccaatttaggcggtatgaacggactagaattcagaaaactggctcacaagatccccgcgtgtattttcgtaagctcacatcctgaactggctgcgggcgcctttgaaatcaatactttagattttattaccaaaccccttacggcagaacgctttcattattctatgaagaaactttttgatttttttgaagtaaaggaaaaatgcgaatgctatgatgccatgacaggtgaaaattgtctcaagataaaagaaggcgggcatatttttcagattaaaatgaaagatatcctgtacctggaagccctgaaagattatacgaggatcattactctggaaaaaaaacactgtatcttaaattctctgggaaaccttctgcaaaaaaactgttttgattcctttgtcagaatccacagaagctatgccgtcccccgccatcttatccggggtaaaagctgtcatgaaatagaacttacccatcaaataaaactacccatcggccgaacctacaaggataatctctcttttttcaatccttaaaaatttatacaaaaatccagcgttcattcataaaaatgccattggtcgattatttctgccgttggtctattttcctgtcatatgattgagattggtggtaatttagtcttcccaaattcccctcagaaaacacattaatcaccaaaaactgttatccatggaaagaatatctatttactgtattattctgtctgtcttttccatccccatactgcacgctcaatctgcagtgctggcaaccggattggatgcatcagcagctaatggttttgtttcttacagcgtaggccagacggcttatctggaaaaaggaacagggcaagtactggaaggcgttcaacagccttacgaaatcatcacccttaccactattgaaaattcttctgaattgtctggcattttgctatatcctaatcctttcagggattatctgtatctggatttcaccacaaataattttaaaggatcagaatatcagctcttcgatggccaaggaaaactggtaaaaaaagacaagatttcacaatcaaaatctgagcttaatttctcctcacttccttccgctatgtacatcatcaggattacgcaaaatggagaaaatattaaaactttcaaaatcataaaaaaataaaacgccatgaaaaaaatattatcaatgttctggatcctgaccggtttcttcatgggactgtctcaggctccggaaaaaatgagctaccaggctgtcatgagaaatggttccggacaacttttagccaaccaagctgttgctgtgaaagtaagcattttacagggatcacctgccggagccgcagtttactctgaaagacttaccgggaacactaatgccaacgggcttatcagtcttgaaataggaacgggaactgtacttaccggaacattctctactattgactggcctgcgggaagctattatttaaaaacagaaacagatcctgccggaggaaccaattatactatatcaggaaccagccagttactgagtgttccttatgccatgtacgccaaatctgccggtggcggaggaggaagcttcacaatcccctataccaataccgttaataatgcctcaactttattttcattaaccaatgatggtgacggaacatctctggaaggcaataatagtactacgacttccaatattgcagcagtaagaggagtcgttaccaatacagcacctgggggtttttcttcagctgttcgtggaatcaataacggtaccggaggattaggcataggagtatatggaagccaggccggaagcggctggggtgtatacggtgttactccaaatggtttaggagtatatggtaatgccagcgccaacggaaccggtgtttatgccaacagtaatacaggaaccggtcttactgctaccagtaataacggaattcctgcaagcatttcaattttcaacaatgcaaataataatgttgccctcagtgcatccagtgtagggaatggtacggttataaatgttaccacttcaggaaacggagccggagtaagaagctctacaggagcaggatttggacttcacggaataacttctgcacagacttctgccggtgtcgtgggtgataacaacggaggaggtgaagcaatagtgggtagaactaccagtgacattgccggagccgttgtgggaagaaatgacggaggcggatatggtgtgagaggttttgttgccaccagcacatccggaaccggtatcggtgtttacggacaggtaggaataaacaacagtaccggacgtgccggaagatttgaaaatttcaacaatacaaatattgatgccaatacttttgaagtgacatctaacggaaatggaaacatccctgataataccaaaggtaatgcttcttcttttatactcaataataccaatagtgtgggagcagctgtaagaggggaagtcaatactattttcgggaattttggggcggccgctatttttggcgtttcttcaggtaccggaggacgtgcaggtttattttatgcatcaaaccctgctggaaacggagcttcattaattgcgcttacagacggaaacggaaatgcgatcacggccaatgctggtaaagacggaaatggagtcgagaccaatattgatggagccggaaatgccctttatgcctgggttccttctttttctacaggacgtgccggaagatttgaaattttcaacgacgctaatacaagcgatgtcataacagtgaagacagtgggaaacggtatagcagggaactttaaggtagataaagtgaccggaacttcggctgcggtaagaggtgaagtcaattcacagtttgccaatttcggtacagcagggatttatggagtatcttccggaaccggaggatatgcagggttattccacgcttccaatcctgccggaaatggccctgcactgattgccattgcagaaggaaacggtaatggcatcactgccaatgcggcaaattccggagacggtgtggaagctacagtagacggcacaggaaacgcaatttatggttgggttcccaatttcggtaccggaaaggcaggtagattttccaatttcaataccggtaacacccagcctgtattgtatgtaaccaattcaggcactggatctgccctgtctgttaatcatactggctcttcaggagatcttgctattttacagaacgccggagtcaatgttgccagaatcaataaaacaggaaaaggattttttaacggaggcacacaaaacagtggtgccgacgttgctgaagcatttgatgtaaacggaaacatttctcagtatgaacctggagatattcttgtaatctcaaccagcgcagacagaaccgttgaaaagtcttcaactccctattcaaatcttgttgccggagtgtatgccacaaaacccggtgtacttcttacagaagaaaatatagaaactgatatttccaataaagctcccatgggtgtcattggtgtaattcctaccaaagtatgtcttgaaaacggaaagataaaaagaggtgacttattggtaacttcatctatgccaggtgttgcaatgaaagccagtattaaaaaggtaaaaatagggcaagtcatcggaaaagcgcttcaggattatgaccagaaagagatcggaaaaattcaagtattagtcaacataaaataaaccgtcatgaaaatagcatatattatcccgttattatttttaagcaccattatctatgctcaggaaaataaaaaggtcgctcctaaagaagaagatcagacactggttgtaaagcaggcacaggaacagcaggctaaactcatgcaggaagctaaagaaaataatgaaaaaactactgtaaataccggactgccttctgatcatgggctagctgttaaaaaacaggattccaaacccaaagcttcttccggtaattcgggaaatcttcttcccaatacggcaagtcttgaagacatcaaaaaaacaattcccaacagacaggcatatcacaatataaattctaggaacacaaaagcgactgttaccgggctgcccaacacagcaactctggaagaaataaagaaaactatccctaaaaactaataactctcaaagctaataaccgcaaaaaagctgataaccaaactagatttttcaaacaaagaagtccgccaaagagcggactttttatattaatgcccggctattaatcccaatcagtagctacaaatttcattgtatgaccgtgatcatcggacagagtaaggaaatgtccttcgactgaatatctggtcatggtttcaatttttttctgaaaagatgtttcaagatccatatcctgacaggctttcatcgtactgactccttttgaaatctttacctttcctccttttttaaattcagatataaaagacatttgattacatcccatataagcactcccctgaattttaccatcaacaatagcagccgtaagattcatttctgctttttgggcaataagctgatcttttgaaaaaccatctaaagaaattaacatccactgcctttggagagatgggtttttatccggtattgcagagcaattcaaaacaactcctaaaattaaaactgcaaaaagtggtaatagtatctttttcatgcggactatcatcccattttcgtaccattccgggacagaatctcgtaaaaattagtaaattagcgacacaaaaattattttataaaatgaaaagactatttctactattcactttcttactgggctttgctcagatgagggcggatgaggggatgtggctgctaatgctcatcaaaagacttaacggtgttgatatgcaaaaagagggtctgcatcttacgcctgaagaaatttattcagtgaacaattcaagcttaaaagatgcgatcgtaagtttcggtggtttctgtacaggagagattgtttctgataaaggacttatattcaccaaccaccactgtggctacggtgctgttgctgcggcttctacaccggaaaaagattatctgaagaacggtttctgggcaatgaaacagaaagacgaattcaatgcaaaggatctttatgtaagatttttagtaagaatggatgatgctaccaaaagaatcacatccaagctaaacaacaatatgaccggagcagagagaaaagctgttattgatgctgagactaaagccatccagacagaaaactctgaaaacggaaaatatactgtagtagtaaaagatttcttcaacggaaatgaattctactatttcgtgtaccaggattataaagatatcagattggtaggtgctccaccttcatcattaggaaaattcggaggagatacagacaactgggaatggccaagacatactgcggactttacggttttcagagtgtacgctgatgctgcaggaaaccctgctgaatattctccaagcaatactccactgaagcctaagcatttccttccggtttctcttaaaggaattaagcctggtgatttctcaatgatcttaggatatcctggaagaacaaaccgttaccttacttcttatggaattcagcaaatggttactaaagattatccggcttgggttgaagcttctaaattggctatggatgtcatgaaaaagtacatggataaggataaggcaactcaacttaactatgcttctcaatatgcttcagtagctaactattggaaaaacagacagggaactattgacgctgtagagaaaaacggaactatttctgacaagcaaaaaattgaggaaacgtacaacagatgggctgcaatgccaggaaatgatgagtataacggagttttagaagatatcgctatctactacaaacaagtatctgacagaaatgttgaaagaaactatatctctcagttttcaagaaatgccaaatatattacccttgctgctcaggtaggatctgttcttaaagcgtatgctgctcaggatatgcagggaagattagcaatgaaagctaaaactgaagcggcaataaaagcggcttatgaaaacttcaatccagctttggaaggagaaatgcttgctgctatgaccagcctttaccaggcaagagttaaaaacccggacgttgcttctgctactattttaggattggatgccaagactgtttctaatttggcatattcttcaatcttcgctaataaaacttctgctacaaacttcttattgaatccggatgcattgaagcttgatgctgatccgctttggaaggcagctaacggaattgttgctgatcaaaagataagtacagaaagatttgttaaaatagatgacaactttgcaaaaaacaaccgtctgttcttagctggtttaatgaaagctatgcctgagaaaaagttctatccggatgccaactctacaatgagattaacttacggtacagtagataagttacctatcagaaatgacagaaactatttcggtattactgataactactatacagatatgactggtcttgttggaaaatacaagaaaggtgatgaagagtttgatcttcctcaaagagtgatcgatctttacaaccttaaagatttcggacagtatgctgatgctgcagggtatatgcctgtaaacttcctttctaacaacgatattacaggtggaaactccggttccccggtaattgatggtgacggaaaccttatcggtatcgctttcgacggaaacagtgaagcattaagcggtgatatcgttttcgaacctgaatggcagaaaacaatcaacgtagacgttcgtttcgttctttggacaattgataagtttgcaggagcaagaagattaattgatgagttgaaacttgtaagaggagaaaacactcctgctgatacaaaaactaaaaactcagggacaacaacaatgcctaagaaaactaaaaaataatcttatctgatatatttttaaaaaccgtgaaattactttcacggtttttttatttttgactattaaaatatttcatcatgaatcctaaacctattgaattcacagctattattcagcaaaacggagaaatgaatgctgcgtttgtagaatttccgttttctacagaagagctttttaataaaaaaggacaggtaaaaattaaagccctgtttgatgataaagttgaataccgtggaagcctggccaaaatgaaatccgattgccatattttaggtctgacgcaggaagtcagaaaacagcttggtaaaacgttcggagatgaggtttctgttgctcttatggaagataaagaagaaagagtggttgaaattgcagatgatattgcctctgtttttaatgaaaaccctgaagcaaaggctttatttgataagatgagctacacccacaaaaaagaatatatccgctggatagaagaagccaggaagcctgaaaccagggaaaaccggaaggtaaaaatggttcagatgattctggatgggaaaaaggggatataaaccattctgcttccactcccgaaagctgtacactaaaaaaattgaataaataaaatattttttgtcaggttctcaaaaagtagccgactatagttacaaatatcatttataactataaaaaattacttttatgaacaagtttattttcagaacatcggttttagcggcagctactctagctgcatttactctttcttcgtgcagtgattcggataatgacacgatgacagaaatgccttttcaaaaaactatcacttttgaaaatgtggtaactcctaaagattttgtagaaagcggaagttttcagggaacaggaacccctcctattattctgcccggacagtctgtttctgttacattcagtgcaggaaaaacacaggctttaatgtttgccaccatgtacggggcttcaaaagactggttttttgcttcccagcagccaggtatcaaactgtttgatgccaacggaaatgctatcaccggagatgtttcttcaagtgtgcgattatgggataacggaacgaaagatgatacaacaggacaggcagaaagcaagcctattatgcaggttcctaacgtaaatgcttcacagcttatgaagcttaatcttgcttacaatgacgtaacctcagaatttacgctcaccattaccaatacatctggcggaacggctaatgaaactcctttttctcccggagtatgggcagtttccaactacaatggctcccagttgcttaacaacgctcctttttttactcctaatgctttatcaaatccggaaatcacagatattgcccagatggggaatatcagtaaaatgatggcgaaactgaatgccaacacaggaattatgaccggcctctctcctgctttggtagttgtttaccgtggtgacaaaaaccctatttatgaattaggtcaaacggacagcggaatgggattgaaagatattgcacagtttggaaatgtaagcaagcttcaaaacagccttaaatctctctctgccgtaagaggtgtatatgttgccgggaacgctcctgtagcaccgggaagcaaagcaacaacaagctttaatgctgaaccaggggacaaaatagcttatgtaaccatgttcgggttttccaatgactggttttatgccaatgaacagagcattgatgccaacaccaagggagacatcagttcaaaaacttcattattcgattccggaacaggtattgaccaatatccgggagccggaaatcatcaggcattattcggcggcactccgcatagtgaaaataagattatttcaaaagtaggaacccactatcctgttcccgctgttcagaatgtgattaaagtaaccgtcaattaactttcaggcttaaaagatcatacaattaaaaattccaggcagctctgcctggaattttaatatcagtaatgttattcaaccggaattcccaggtattttaaataggaatccagtattttcttatcaaataccggctcctgaattccggaaccttccagaaattgaatcacattggaacaatcccatatataggtattctgataaagctctactgttgataagccttcatgcatattgtccctgaaaaggcttgttagtgggtacaaacggtttttactgtcatcctcccattgttttcgccattctttgtaaggaagacctttcagtgtaaagggataatactgtttcatcaaaccgaaaaaattttccagcgtaagatttgtttccgggcgggcaattaggttgaattttttgcctatcgcttctttattctttgtgatgtgagccattgctttggtcatataatctactgtgatgagtccttctctaagctctgttaaagcaggataagatttgaattctatacaatttttcactaatcctgaccaccattgataggacgcacttgctcctgtttcactgtggcacattgcatatcccaaacgataggtgattaacggaagcccttctttagccgctaaatcagctacggcttccattacccatttgcttcgtacatatcctatatctttacttacagacatcaggttctgctcaatatcatcagattcgagcattactgtttttcctgtaaatatatgtccccagctatatactgagattgtggataacaaagcaagacatgacgttctttctgctcctgccagctttatgatttctcttaatccttctacattcggggctttcatataggaataaggttcaatgaagtttactgaactaccggaatggtagatcaaatcaacctgttttgccagcctgctgaatatttcttctgataatcctaaagatggtaatgtcagatctcctatcacaggaataattctgggtctctgttcttctttatgaggaatgttgtattgtttaaaacatcttccaatcttttccattgcggaaaattcatcctgggctctcacaagacagtaaatatctgcttctgtagtatccagaagctcctgcaaaagatggattcctacaaatcctgtaactccggttaaaaatattgttccggggttttctatctgccccggatcaaatcctcccgcaaagacagttccgggagccagataaacatcgttctgtaattcaacataaggctctacatcttctgccggaacggtgtctctcatttctctggatctggctataagaacttctgacagctgctgtaataccggatactgatagatatcccgcagataaacctttacatcaagtttcctttgtaaagtaacagcaacggctgctaccaacagggagttccctccgatgtcaaaaaagttatctgtaatattgataacagggcgttccaatgcagaagaccagacatctacaataatcctttcagtttcattggttggcggttcagatgaaattacgtcttttgcttcctgatcagccagttcctttaatgcattggtatctgtttttccattggctgttaacggaatggcatctataaaaataatctgggcaggaatcatataacctggaagctcttccttcaatgcattgcggactgaagaaatatctgttgttgcttctggttttaatacaacaaaagcaatcaggtatttggtgcttccttctgtttcctttccaatgaccacagcttccttgatctctttctggcggatcagtgaacgttctatttctcccaattcaatcctgaatccgcgaattttcacctgattatcaatccttcccagaaattcaatctcaccatccggtttccatctggccagatctcctgtacgataaagcttttctgtttccctgaacgggttggtaataaacttggaatgagtaagctcttcattattaaggtagccttctgctaaaagggttccgccaatacataattctccgacagctcctaccggcagcaattccatattttctcccagaatatatgcttttgcattggcaatgggcctgccaatagaggaaacatatttcccgttgatatccttcacttttttgaaggtagcatatacggtacattctgtaggaccgtaataatctattagttcatagctcaattccgtagtaagcaccggcttcagcttttctcctgctgtaaagagatattttaatttgaggtcattataattccgggtaaaatctactacagaaggagcaagaaccgtaggtacaaaaccatgggtaatatgattttttctataataatctaccaatgcctgagcctctgttctatcctcattgtctgcaataaaaacagttgctcctgaagtaagcgccgaccagacttcccatactgagatatcaaatgccaatcctgcaacaagagttagccttgaactgtgatccacatgaaaatgatggttatgccatgttaccagatgctgtatagcctggtgacttatcattactcctttaggatttccggttgatcctgatgtataaattgtataggcaaggtctttctgttgaattttaatctcaggataatgtgaaggtaaatgatcgaggttttccatgctggtcagatcaaatactttttcttttccggattcagataagagatctttaaagctttgattggtaataataagatctgaagaagtgtcggaaagaatatattctactcttttcgccgggtaagatggatcaataggaacatacgcagcacccgttttaataacaccaagaactgcaacaatccattctaaagaacggtcgagccagacaggaacatattgtccttctttaacacccttttttaataagaagttagctacctggttacttttctggtccagatctctgtaggtaattttctgctcctgatatacagcagctgttttttctgcatgaaggattgcctgtttccggaaaagggattccaatgtttcttcatgatgataatcccagccggttttattgaatccgtttaaaagtttttctctgtcttctgatgacagtaatacagccgaacctattgattgggcttctgatgagggaattgtgtttgacatggtaataaattttgattggcttaaaaattaataatcaatagctttcatcctctgtaaagtaattttaaatgaaaatgaaataaggacacaaccgggtataaggtataaccacagtttatgtactaaatgtgttttcattatagctgtaataaatgatacagagtcttaagcgatctactcagtgagcagaacgtaaacagcgttcaaacgttatttatgacattcggaaaaaagaaagaatatattgtggatattcttcggcaattcaatgcaaatttctattcggtatttaaaaatttgattttcataatgtaatatttttgataatatggcaatcaaacttaacataataatttaatctatgcgttacataattattatcatataccacattccggaattgatattctaaaagaaacaaaatcaaacatctgaatttcaacaaattaaatatttgcaaaataaaattattccttacttcctctctagtgagttcaataatctctacatttgtgaaaagcaaaacacaattcattttaatatggatcaaaaactgaagaacgaccatggattcatacatattccatgcaatgaactggatatttttatactttctgacggatattttggtattggataccatcagcctatcttagcacccgacatccctcaacatcttgtaaaaaccgaactgcggaatctttatttatcggaatcttattatgaggctcctattaatgtaatgctcatcaaaaaagaagaccggactatcttagtagatacaggagaaggattttatgatgatgaaaatgcaggaaagttattatacagccttaatgctgcagggttcacaccggaagctgtcactgatattctgattacgcatgctcacagagaccatatcggaggaatcctttctaaaaatggggattttgtatttccgaatgcccgttattatatttccagtcaggaatttgatttctggacaagtgatgagccagattttcagaaaagcaaaaacccggaaggcggaaagctgagcattcctttggttagaaaaatcctttcggcgatagacagccggcttacgaaatttgaaatgggagatcagttgttctcatgtattcagacagaagcagctccaggacatacccctggccatattatatatacagtgagtaatggaggactgtcaattaccaacgtggtagatctctttcactctccccttcttattgcaaaacctgactggggtacacaatgggatattgactttgaaacaggagttgaaacccgaaaaaaagtactggaagcctgttatgaaaacagaacacttatctgttccgcccatcttccgtggccgggaataggatacataaataaggtaaataaccggtttcaatgggttcctaaagtatataacaaccctttttccatcaatttagaaaaaaatccggaaccgggtacaatataaaattttctcaaaacaagaagtccggaccggttatccattccagaattcacggtccaggcttctgtattgtatggcttcggaaatatgatgagacaaaatattctcggattcttcaaggtcggcaattgttctggcgactttcagaattctgtcatacgctcttgccgaaagatttagtttttccattgctaatttgataaggccgaatgaggtttcatccagctcacagaatgcttcaatttcctttggtcctatctgggcattactgctgatactaagattctgataccgcttattctgaatctcccgggctttcagtacgcgttctctgatgtctttgcttttctccccttttcttttttcggaaagctgttcaaattctactttctgaacttcaatatgaatatcaattctatccagaagtggtccggaaagcttattcatgtaacgctgcatttcataaaccgatgaggtattattaggatcatcaggaaagaaaccacttgggctgggattcatagaagctaccagcataaaacttgcaggatagtttacggtaaaacgtgctcttgaaatggttacctcacggtcttccagaggctgtctcattacttccagcactgttcttttaaattcgggcatttcgtccagaaataagactccgttatgggcaagggaaatctccccgggctgcggataacttccgcctcccaccagagcaacatcagaaatggtatgatggggtgatctgaaagggcgtacagtcatcagtgaagcttctgttcctattttccctgccacagaatggatttttgttgtttccagagcctctttcaatgtcaaaggaggtaaaatactgggaactcttttggcgagcattgtttttccgcttccaggtggacctatcaggatgatgttgtggccacctgctgcagcaacctccatcgctcttttagctgtttcctgtcctttaacttcagagaaatcgaaaggaaaattattaatcttttcgtgaaattcttttctggtatccaaagtcattttttcaagaggttttccttcattaaaaaaatcaatcacctctctgatattttctaccccatatacttcgagatcattaacaatagcagcttctcttgcattttgtttgggaagaataatccccttaaatccttcttccctggactgaattgcaataggaagtacaccttttatcggctgcaggcttccgtccagagaaagctcacccataatgatatagtcattaacttcttctgccagtatctgatctgaagcggttaaaatcccaatggcaatactaaggtcataagcagaaccttcttttctgagatctgcaggagccatattaatcgtgattttctttccgggaatcttatatcctacgtttttcagtgcggccgatattctgtagctgctttctttgatggcgttatcgggaagtcctaccagatggtatcccactccgccggtatccacatttacttcaatggtaatggtctgtgcagccactccatgaatggcacttccgtaaattttgatcagcatggtgtgtttttgaggtaaaaataatcaatatagtattttaaaattctgggatttacgttaatagcattctaatcaggcggatatatttaaaaagaaattcagaaatttcggaataaaaaaaccggtacaaatttctttgtaccgacccaaccattattaaaaactaacgaatagattatttcatctgagttacagaaaaattaaatgtaagtcaggaagccggatgccggaaagagagaactccttttggggtaattatgacgtcattagattaacaaggatgaaaattttatctattgagcgtaaagtattaaaataaattactctagttcttcttcaatacaaggaaaatctctcctctgacatccattcttcctgccacaatcaatattttagcatcatcagattacgtaatcctatttttttataaatctatttttgtattcaattcccgctgcacttttagaaacaataatataatttcccggtaccagctgacttacatcaatgggctgattgtagctgtgatctgtttttttcagaaccagctttccggacatatctataatgctaacttctttataaatcttgtctgattcttttcctatataaagatgctgtgctgtaggattaggatagattttcagattattatctttaatttttgtctctcccgttcccagattgctgcagaattcccagttcccgaaatttacctcaacaaaggcaaacggatctaacatctggcattggtccggacagtattcagtacaggcatagaatccatattttccggaagttgtcgctacataagtatctcctactacacctggaatgatacaaggatctcctgccaccggaggattactgcttgggacacatttgaaccacgtatgtttgccataaaccacagggaatatatcgtcaaactgtacagaagctccgttgcagacatttactgttcccatattttcttcataggttcccggagtataagtagtcatcattgccggaagcccgtaaacaaagccatctgcaaatactgtcgggctttctgctgtacagtctccatcggtaacaaccactttaaaataattcagctgctcgttgccgctgatggtcagctgctgtgaagtagctcccggaatagcaacccatggattgttattaggggtctgccaggtccactcctgcttataccactggtaagttgtataagtctgtgtggtagaaagtacttcatcttctgtatcacagaacagaacggttccgggatatttctgaccaagtctgggactggtaactgtaggggtacactgtgcttttagattcaaaatgctgaataataaaaacactaaaaagattagttttgttttcatatataaataattaagcttggtttttgtattaaatctccggcattaatccaacagcactcgtacaccgaacttcatattaaaatgaagtggtttttctttataaattgtattgggagcatcttcttttttaaaatgatatcctattcccggttctgcataaattccgactttatcaataatcttcagctgaagacctgctgctgcgttgacagagaattgtaaaggtttgggctccagcttttcatttgaggattcctttatttcatcattcacaacataggttgttgtgatacttcctgccacaggcttttccacaagtgctcctcctgtaacatatcctgtaaatttgcccttctgaatgacattgtaattgacctgcacaggaattcctatataatgaacggtctgatctcccttaataaaattgttatcacttccggaatgcagctcagaagacagtttggtataatttactcccgttcctattccccatcttttccccagattatagtaaacagaaagcccgaaagtaacaggaaccttatgcctgattctcgcttctaccggctggctttgattcgccagcaatatggcggtcagaggatcatcatgaaactctgaagtagtccatacctgctcaacattcatggctttcccggtaattgaagcatacccgggaaattgctgttctgcggagttggaggccatatttcctgtcagcattcccagcatccaggattttttatttccggatttcctggcagaatgttttgtattttctgcgtatacctccttcaatttttcctgtttaaaaagaaccttatctgattctttttcttccaccgtttctttcacagtatcatcaacaggtgaaattttctgagcaattttactttcctgctgaaaagcctctgaagcagtaggaatctttatgatatcctgattttttccagcgttattttttattccgttatcagaatttctttgagttaagattttctttggagtttctgtattgaatgtattttcagctaagaaggcatttgttcctgattttacctcactgcttacaatatgttcagtttttccggaatttaaagcgctcttttccttttcttttttcacatctgccggtttctgagacagaagtttttccttatcattatgaggcagtatttttgtcagtaaaaacaacaatgcaatggcagcagcaatacctccgatacgatagaataaggatttttttcccgcaccttcaattctttctttcttttccgcaccaccttcatgaatttcaggaataaacccgggaatgctgttgttttcttctcccgagaataattcatctctgatgtcatcccacaacccttccgggacgtcctcttcatagtcatccattctgcttcgcaggttatttagccattcattattcatattgtgctttttttgacattttaaattcttttattttctgaacaagcaatcctttggcgcggtgaaactgagatgcagaagagttttctgcaattcccagcagcccggcaatttctttatggctttttttctcaaatacaaacaggttaaaaacagttctgtatccttcaggaagagatctgatcatcttcattatatcatctcgtggaatttcttcaaaatctggttcttcttcattgggaatatccggaagatcatctacttcaaccgctgatctgaaatctcctttctgttttatatgtttcaaagattcattaactgtgatacgcgtcatccaggcttttaaagaaccgctacctctatactcaaaggattctatcgaacggaacattttgataaaactgttttgaagcacatcatgaacatcttccttttctgtcacatagcgggaacatacatagctcagatttccggaataagctccaaaaagctctttccaggctgcttcctccttcttcagaaggtgctttaccaaaatctgttctttactttcttccatatatgcttctgctgccgtacccgtcaggatattataaactgtcaagcaaaaatagattgcatcttattaaagcgcaatccatttatgatattatctattcattaattttttatacagaacgggaaattataatcgatcacttcataaggagtaaccactgtcccatctactgtaattttttctgctgtaagagcatatctaagtgttctatccatacctacataatatcctttctgcttagaaacgaattccacaacggtctttttattaacgccatctaccggaatctgaagttccattgtcttaggagtcaaagtcaattctatcacattatttgctgtattgatcactgctgcatatttaagatcatactttacttttccaagagcttttatagctgtttctgcttttgcagggtctttcactactgttttcacaatttcggtaaccggaaattctgcaaatgagatggtatctttttttactttgaattcttttattccttctcttttactatttccctggatgataatcagcttacctttatagtttcctggtaattcttccatttttacaggtggaatatcctgttcatcactatcattacatgagtataaggccaatcctgccaaaaccattaaaactgtcataaaaaaccggggtactgtcaattttttcattgcattacattttcgttaaacattaattattttcgagtactcatctatataaatcctgttttatgaaaatcttgcatatttttttagaaaaaagaacaaaaaaatttataacgaattgattttgtgcgggtaaaatttcatcacttcattgcaaattccgtacctgttgtaaaaattgagtggtattgatgcgtccaaaacagcaaaaaggaaactacatcatatagtttcctttattatttttaaggtatgttctactgtactccaccgccaagtgctctgtaaagatcaacctcagcatttaatttttccagtgtaacattaatagcttccagatcattctgcagtttgttattctgggctgtgatcacttccagataggttgccataccgcttttatacagcttcagtgcatcattgattcctttatccagaatggctgttcgctgttctaaaagctgcaacctttctgaagaacctttagactttgccattgcatcggaaacctctcccacagcagtcatcactgattgtttaaaattgatagctgctttttcctgttcaattaaagctgtttcgtaagctgttttcagttcttttttctgaaaaaccggagcagcaagattagcagcaatcgctttggtaatagatcccggaatatcaaaccatgagctgaatttattggaatttactccgatctgcggactaaggctgatactcgggtacattgcggcttttgccaatcctgttttggaatttaagctgattacgttaaactctgccatcttaagatccggccttcggctgagcagttgtgccggtaatccttcagacaatctgttttcaggaatcattgctttcaggtttccttctctttctacttttgcaggatagtctccacaaagaatactcaatgcattttcctgaatggaaatattctgttttgccaaggggatcagcagttcagcagttttcttctgtgcttccgattgctgaaccgccaatgaattgatctgacctgctttaaactgaagattcatcattttaagagtattgtcactcagttcaatattctgttcagctattttcaactgttcgtccagactgatcagattataataagcctgtgctacctgaacaacgattctgctttttatcgcatttaagttctctttctgtccaaaatattctgctgctgcggattctttttgcattttagctttcccccagatatctacctcccaggaaagtctcagtgcagcagtgaaatcatccaggtattttgtcccaacaaactgttcattcagggaaccgttaagcgtatttttggacgcccagcttctgttggctccagcactgaaatccagtgttggcatgaggctcagcctggcctgtttataagcaagatccagctgttctatgtttttcagagcaacgtttacttcattgtttctggaaagggctttatctattaaaccgatcagtttaggatctttgaaaaaagttttccaaggtaataccacagtatcgcctgttacctgtagagattctttgtaggtttcaggcatctgaaggtctgttcttgtatatttctttcctacggcacaagacatcagcagtgatgccattgcacctgaaataaggaaattctttatattaaatagtctcatttgtcaattgattttctgttgtatgatgtttctttttggcagagaatttctcatccagatactgaaagaacatgtagaggacaggaattacaaaaacacctaaaaccactccgctcaacattcccatggcagcacttgtactgatagatttgttcccggaagccattcctcctgaagaaagcattagcggaaccattcctacaataaaggctaacgacgtcataataatcgggcgtaatctcgcctttgctccttccagcgcagaatccagaatagaaagacctgcttttcttctttggatggcaaactccacaataaggatggcgtttttggccaagagaccgattagcatgatcagtcctacctgtacatagatattattatccagcccgatggcttttattcccaggaatgcccctacaattcctgttgggatggaaagcataactgccagaggaaggatataactttcatattgagctgccaacaaaagatatacgaaaagtaaacacagtccgaagatcgcaatggtttgatttcctgccgacttttcttccagactcaatcctgtccattcgtagctgtaatcagacggtaatttacttagggtctgttccagcttacccatcaattctccattacttactcctggctttggagaaacattgatgtttaatgagttataaaggttataacgctgaacggattccggaccgtagacttttttcaaagtgattagtgtatttaccggaaccatatctcctttttcattcttcacgaaaatatcattgaaggcctgctcatccattctgaaaacaccgtctgctttaatattcactctatagaactttccaaatcttgagaaattctgggactggtctccggagaaatacgtctgaacagttcccaaaagatttgaaatgcttactcccagctgcttcgctttatcttcattcacttcaagctccatctgaggataatctgccctgaacatcgtgtaggcaaatgccacttccggaacctgcatcagctggccgatcagttcgtctgctttagctttaagtacctgaggatctctacccatgcggtcctgaagaacgatttcggcatcatttgtcattccgtatccttctacaggaggcattctgaaagtcattacacttccttctttaatcactcccaattttgcagcagccctatctaccacctcctgaatatcctggacttcgcctctttcttttttaggtttcagcttaacaaatcccatagcataagccggtcctgcactgttactaagcaggttgtagcctgtaatggaagtattttcctgtaccgcttccaccccttttaagatttcattaattttattggagacttctgtcgtctttgtcaatgcagttcccggaggcatacttaaggtgtacatgaagaacccgtcatcttccataggcacaaagctttttggtgtgcttgacatcagccatcctgcaactccgataacggctacgattaatcctcctgcaatccattttctccctattaaaaatcttactccttttgcataacggttggtcatattattaaaaccagcgttgaatgccacggcaaacctttgcccgaatccttttggtttcactccttctcctgcaaggttgttttttaaaaatacagcacataaagcaggggttaaagtcaaggcattaaccgctgaaatgataatggcaatggccagtgtatacgcaaactgcttatagaacagccctgctgaaccggacataaatccgatcgggataaataccgccgacattaccaacgtaatagaaataactgctcctgtgatctcgctcatcgctttatgagtggcctctcttcctgaaaggtctgtcccttccatattactgtgaacggcttctactacaacaatagcatcatccactacaataccgatcgccagtacaagggcaaaaagcgtcagtacattgatggtaaatcctaaaaccagaaggaaaaagaaagtaccaataattgctaccggaactgccactgcaggaataatcgtagatctgaaatcctgcaagaagataaatactacaataaatacaaggataaatgcttctatcaatgtagacttcacctgtcctgttgcctcatccagcctttctttggtactcattacctttgtatatttaataccaggaggaaatgattttgataaccgatccagggcttggtttacccctatttcaatctgattcgcgttggaccctgtagtctgcatgatcgctacagtaaccgcatttttcccattggacaggttatctccggtattagaaatcgctccaaattccacacgggctacatctttaagcctgatgacctggcttcccgtgtttttaacaatgatgttttcatattgttccggcctgttcttttttcctttatatcggattacatattctaaggcagcgtctgattcctccccaagtttacccggagcggattccaagctatgatctgcaatcgcactggaaacatctgccggttcaagtccgtaggaagacattttctgagggttaagccatattctcatagaataatctttaatcccgaaaaccatggcctgcccaaccccttttactcttttaacctgtggaataaggttaatatttgcatagttctgaagaaaggtttcatcatattgcttattgtcttcagtatagatattgaagatcaacaccatactgttctgctgtttggaggtagtcaatcccattctcactacctcctgtggaagaattggtgtagcctgctgtaccctgttttgaacatttacggcggcctgatcggcattcactccctgcttgaatataatggaaatagaaaacgtaccgtcattgctggccgtagacttcatatattccatgtcttccactccattgatctgctcttccagcggcgttactacagaacggatcaccgtctcactgttccctcccggataagaccctgaaacggtaatcgtaggcggagaaatatccggaaatctggtcaccgccagctggtttaatcctatgatccctaatatgacaatgataagggatattaccgtcgccagtaccggacggtctattattttttttaacatttttgaattttctgatagtggttatacaactatttcaaaggaacggtatgtgcgacaacctgtgctccgtctgtaagggcatcaattcggttgatggcaattttatctcccgcatgtactccttctttgataaagtaatcctgagacgtacttcctgaaacggtaatctgagtcatttttactttgtctttaccattcagtttatagacaaagaatctgtcctgaatatcttttaccgatgttttcggaagtttgattactccattcagagcattgtgaatcatcactctggctgttcctccggctcttaataatttatcaggattctgaaaaacagctttcatctggatacttccggtatttctgtcgaagtttccactggcattttcaagcttccctttaagagcataggtggagccatctgcaagaattagctctacattttctgtagtatttcctgatgctgaagctctgctgtgcgcaatgaaatccgcttcattcattgagaaatacacattcacagtgtttatattggaaagtgtcgtcaacggtgaggcatcagacggactgatgagatttcctactctgttcggaattcttcctatgtatccgctaacgggtgctttgatataggtaaaattagcattgatttttgaagatcccaatgatgactgtgcttgtgctacctgtgctgatgcagctttataacttgcctgcgctgttttcagctgcatatcggaaaccacttttccttctacaaggggtttcagtttttccacttcaagccttgctgtttcctgggctgccaaagctgatttcaaagcagcttcattggtatttacctgttcgttgtagactgatgggtttattctgaaaagggtctgtcctttactgacgtactgtccttcttttacatatactgcctccagatatcctgttacctgtgctttgatgtctacattatcctgcccttctatgcttcccggataaccggttgatacatccgcatctcccgatttcacctctataaaatctgtaggcaacgcttgctgcatctgcccggcattttcctggccgttcccggagccgcacgaataaagcaccgcagcagcaagtgaaagtaccagatatccttttttgtaattcataacattggttttaaattttacagcagcaaaataacttcatataataagggtattcgcacagaaattgagtgaagcgtcgttaattgaaggtgaagcgtacgaaaggaaaaatgaaaggaaaacagctgtttacctctataaacaggacaaaaaggattttatccggaagaaataagagaaactgttagatcaatgacggctaacaagtaagataaaaaaagactgctttttcagagaagcagtcttatctattttcaggaataaatattaataatccatccaggatttgaaaatggaagctttctcgcggcttacaatcacttccatctccgggtgttttcttaattccagctttagttttccgttaaaatggttaaaaatctgttttacagaatcaatatgaatgataaattgtctgttggcccggaaaaagaatttcggatccagctgtttttcaagttcttccagagtttggggaacgttctcaacaactccggtattcagcatcgctttactgattcccaattcggtataaaagtacaggatatcctctgccagaactgttttatatccatctctgtgagcgataagaaaacgttttctgtaatcttttggctggatataattcaataatccttcaatagcggttcctaccaccggaacagcttccataaaggtttcatagcgtttcagggcagcatccagttcttcttcttctataggtttcagaagataatccacactgttgtatttgaatgcctgtactgcatattcatcataagctgtggtgaatatgacagcacttttaacttcatgcttgttaaatatttcaaagctgagcccatctgcaaggcgtacatccatcatgatgacatcaggaacaacattattttccagccagtgcaccgttgaagtgatggagtcttctacagacaggatttcgatatggggtcttaatttcagcaatagtcttttgagtctatctgcattgggtctttcgtcttcaactattaaaatcttattaattttcatatcaatggaagttttacaataaatttatcttcagttttttcaatcacaggtttaggatatcctaaaatttcgtatcgtgcaatgatattggtaagccccactcccgaggaatccggcttgttgattaaaggcaggaatgtattggaaaccaccagctctcccacggaattggtatagacatgaatctccagaggttttacctttgaagtctgattgtgtttaatcgcattttcaaccaataattgcagggacagtggcagagtatgcatagatctgtattcttctttaatatctattttaaacacaaccccttccccgattcttttttcaatcagaaaaatgtaagattctaaaaacttcagttcctcttctaccgcaatgatatcttttttggaattgactaacaggtatcggtaaactcttgcaaacttctccgaatattcatagcctagctgctgatcttccagaatgagttctgacaatacactcagattattaaaaataaaatgaggatctatctgaagcttcagtgcctgaagttctgctgccatggcagcttgtttatgttttgatgcccggagtttatgctgggcagcttctaccgctgttttcttccagttttcaagcaggtaatccaccgtattaaatgcactgataatcaaagagattacaatattggttgcaatccattgcccaagtaatgtatattctttccgtgaatccatttcaggtaatgttactgaggtacagtctacaatagcattaataataatcacaatcataacacttcccacaatctgcagcaaacactgaatgagcagccgctttacagttctgtttcgccagggaagcagtttattaagagttctgtcaataaatatactgacctctgaaatgattacagaaaataaaataatccaagaggcatcttccaggatcatttgcagcggcgtgttcaggtatcctttccagaccggatcaaacggatctatcagataggagaaaacacagaaagtaaccactgctacggcccagatcacgagccttcttttcatagtggaaagaatctttttatttcggactatatttttcctgatggcggaaatcctattcatgggcgaactttgtgattgtaaatatagaaatagattttatatgggtcttgtccgaaatagacgagaccgccaaaacgggagctgaaacgtaaaatagcagcgttcaaatgaatctgacggttcatcacctgaaaaagacatttcatcatcattttatgcaacatcgcattatttttatcattagctcatgatggtctgtcctagttttgcagtactaaatccggtacaatgaaaacaataattgtctgcacagatttttctcatgaagctgaaaatgccactcattatgcagcatctatggctaaggaaaatatttataagattatactgtttaatcttcaaaccgtttccatacatgctttgaatgcacaggcttcggctgattttttctatgcacaaacacttaaaaatcaaaaaaaactggaggataaagcaactgaacttacaagattgtatggtattgaagcagagcatcatctggcatccggcaatttcattgaagaacttgaaaactgtatacaggtacacagctgcgatttcctggtcatgggaatggcagagaaaactttggaacaaaagcttttaggtaatactgtaacaagggcaattcacagaataaaaaagccaatattaattgtcccttctcatatagaatatacaggaatcagaaaaatactttttgcttatgacacccacaaaaacatgacctggtctgccctgaacgatatttattatttcattaatgaatttaatgctgaggttgaagtctttaatgtaagtgaaaggctggaggattttgctgaagttattcaggatattgacctgaattccggttacgacatggatgatattaaatacagttttaaaatgattcagtccatcgaagtaattaaggctatagaggaggaaataaaacttaccaaccccgatcttctgaccatggttccttataaatataaccttgtagaatcacttttccaccgaagcaaaacagccataatggcctataagaataaaataccattactgtcaattcccctaaacatagattaagatcaataaaaatctgttcacatttgaattatcctttttgcctttaaaggctaaattttacacttaatcttgtttaacaggcccgggaaagtttcccgggcctgtttttatttcagagatttacaatcacttttcctgcaacgcggttagtctcaacttccagatgtgccattgcaaggtcttcaaacggaaatgttttataaacaaagggcttcagcactccttccttcaatagaccggcaattgcctccgtggtttcttttttagattctaccatcataaattcaatatttacatctctctctctggctttgtctgcaatatcctcaggaatctcaggggacggaagcgttacaataattccgttttcttttacaatatctaccgaatcagataaggtttttcactgaagagtatcaatcacgatatctacatcctgcactttttcatgaaagttttccgttgtataatcaatatgttcatccgctcccagcgacaatacaaattctttatttttaccggatgatacggcgataacgtacgccccgaaatacttcgccatctgaacagcaaaatggccgacaccgcctgaagctgcatgaaccaaaactttattcccttttttaattttcgcaacatctaccagcgcctgatatgctgttgaggccgccattgatgctgcagccgcctgctgatggttaatattctgaggctttaaagccagatgagccaccggggcagccacatattctgcataggcatttccttttccaaaaaaattgaccattccgaagacttcatctcccggtttaaaatcacttacatttctcccggtttccactacttctcccgagatatcccatcctaaaataacgggtcttttttcttcaaaaatccagttgaggacgccttcatacgccctggattttacatctactggattaatgcttatcgataccacttttaccaatacttcatcatttcctattacaggcgtgtctatttctgcaaattgaagattttcaacacttcctgcttcttttaaaataacagctttcattttttttgattttaattaccggacaaatgtagtctcatcatatctttgcagcaagtatatacttttttgtaatctacataccaaaaatatactaatgctgattatcaaattattgaaaaaatgttaaaaataaaaaaagtcaccaatgagccatcctgtcctgttgactacgcttttaaacggattggaggaaagtacaaaggccgtattttatggtatctccatctgaatacgattatgcgttatggcgaacttcgtaaaactctttccgatattaccccgaaaatgcttacccagactgtacgggagctggaagatgacggacttatccatagagaagtttatcatgaagttcctccgaaggtagaatattctttaacggaaaccggtgcagagctcattccttttattgattatctgcggctttggggtgaaaatcagattgaaaaagagagaataaaaaattaaaatcccttcaaaaccatgaatgatcatcatggttttaattttatatataaaggaatatcattggatatttttaactaaaagaacaaacacagcaattcatattcatctgaatatcaaaaagtcgtaaatttagtataggataaaaacagtgttttcacccttttttatagttgtgccgttcgctaattttgttccataaaattaaaaaccataaaaatgaaaacttccttttttactaagattttaagtacgctctgcacagcatttattcttagtttctgcttgctaagctgcaatgaacctcctaaagaacctgtaagtaacagttataaaaagaaactgatcagctaccgtgaagggcgcgttctttttgatgaatacaccagaaccaatcatgaaattctcatgaagtacagaaacggagaacctgattcccgatggtactggttttcgcttgaagatatggaaggatatattaaatatgtaaaagaaaacgccagaaaacaaaaattaaaaaatccgggaatcagaatttatatgggaaaatatccgatgaatcatcctaaaaacaaaatggcaaaacctgaatatgcaggttaccaaactatatttttagtacctactgcccaaaaaagagaaagagagaaggccatggccagatcagccaccaccgaagaaaacacagacgttacttcaatagagtctatgaacatgaccaatctggcacccccaccaaaaacgttatcagaaacaatgccttaaaaacatagcattatgaactggaatattgaaacagggaaacagatatcgatggccatatccattgtcgtgatgattctgatggtcataaaatatagaaaaaccggaaaggaaaatttatttttcatcataggatatctgttgttttccctgattgatatctcctgttatttctatttcaagctgacaaatctgcctacggacatcttctatgtaattggttttttaatggttgtattttttctatacttattttactattaccaattattgtatgttccgctgctcaaaaatatacaggctatcatcctggctctttttgtcctcaatattgccgtgatgttttatacagaaaaagacctgcttcatcatttctctttcaatatgctgtacgcagatattcttctgttgctattttcaattattttgttcctgtaccaaacctttaattctgataagatactggaaatcaaaaattatttaccattctggatatcagtggctttactgatcctttttatcggaagcattccgatactttttttcagaactactgtttcggagacaatttatttcttcatcttatttatgctgaatctgatcagtaacagcatactcatactgggtttaatctggaacaaacaggaaagaataagataaatgctttgcagatatggaagagaataatctggtcatcatctttacgattactttattcatcattgttttaacaatggtcttcatctatgcggtttttatcaggaaaaaaacaagcctattgattgaacagaaagaaaaagatttacggtttgaaaaagagctggccacttcacaggtggaaatgaaggagcaaaccctgaattatatcgggcaggaactgcatgatgatctgggacagaaactttcggtagtccgcttacgtcataaccaattgattaccaaattaaaaaactcagaaaaagaagacctgattgaactgaatgaattattgggagaatgcatacaggatataaggaacctttccaaaacattaatcaccgaacagatcattcacttcgggttggcagaatccattgaaagagaagtccagagaatccaaaaactgaaattattaaaaatcgaattcatcacccaaaaacaggatattgatatttcgcctaaacatggtcttattcttttcaggattatccaggaaagcatcaacaatattctgaaacactccaaagccaaaaacgtttctatccaactgaaagatgactgtgaaaaattacatatcagtatttctgataacggaaaaggctttgatacaagcatcattcaggacggctcgggattaaaaaacatggagttgagagccaaactgattcatgccgaactgtctatacaatcacaactgaataaaggaacacaaactctgataacctatcacaaaaatttattatgaaaactattcccatagcgatcgttgatgatcatactttaatctccaaggctttggaaaatatgatcactgagaatactcaatacagggtcattatgaatcatcccaacggagaagaatttattgcaggcgtggaaaaagcttctgaactgcctgccgtagtcctgatggatgtcaatatgccttataaaaacggtatagaaaccacagaatggcttacggaacattatcctgatattaaagttattgccctgacaatggatgatgatgaaagaatattgattaaaatgctgaaggcaggtgctaaaggctatctgctgaaagacatgcagccttctatccttttccaggccattgaaacggtatttgagaaaggcagtttttacactgattttgtagcccaaaagctgttgaaagtaaagacagaagaagcaaaaaatgcatccctactttcagagctgagagacagagagaaagaatttatcaaatgggcctgcagtgagctcacttataaggaaatagcagacaaaatgtgcctcagtcctaaaactattgatggctacagagattcggtttttgtaaaactggatataaaaaacagagcgggactggtactttttgccctgaaacatgatctgtgctgacttaaaaccttaatttctaaccttaattattacctaaaaataaacatctttacattctgtttatcaattcggcggcttttcaagccgccgaattctatttataacaccctcatatacaaacaaaaaggtgtttttcctttttcaaaatacggttttctcctctgttttcgtcatgcggaatgatagaattttgtcatagaaaaaaacacaaaaaggcagcccccgaaaagccggaacagagtagggaaaatttttaaaactaatacaatgaaaaaagcacttatcgtaggtattaatgattatgcgcctatcggatacggaggtccggatcttaacggctgtgtaaatgacgcaagagacatggccaatacattggtaatctgtggttttagtcctgcaaagattaaaatcctgaccaatcagaatgccacaagagcgaatatattgaactatctgaaatccatgatcagcacaagcgtgaaaggagattctcttgttttttattattcaggacatggaaccagagtggccaatatcggatcggatcttgaactggatggtttggacgaagctatttgcccacacgattatgcgaatgctggtgtcattcgtgatgatgattttaaagcggttcttgataaattaaaggctggagtgaatatggaagtggtcttcgactgctgttactcaggaaccggaaccagaaaaatggatctgggtctggaagctgatcttctcaatgaaactgcccgttatattcctccaatgcttgaggatgaattttacctgacctatgccagtgaaatcggaactaaaaatgtaaaaaaatcaaccgttcttaccaaagcacttgttccggttacaggaatgaatcatacattatgggctgcagcaaaagacaatcaggtatccatggaaggaaatatcagcggacagatacggggttattttacctatcatttctgtaaaatattgcgtgctaccaatggaaatattgtccgaaaaacacttgataagcaggtcgctattgcattggcagctatgggagcggcccagatcaaccagacagaaagcatgactgcagaattttcacaaaaaatattcacttaaccaataaccattaccggcggaatccgaaaagccataaaagagtaggaattaccagattaaaaataataatcatgtcaaaaattgaaaacaacaacccgatgaccactgaagaagtgtcaagactcagaacggttaaagcgaaatcaactgaaaaaccggaagttattcagaaattattcagccaggctcctgccatggaaacgattaacggaagaacttttcctaaagggatgaaaacaataggaatgcctatggatgaaaaaacagcagaaaaccgggcactggaaaccgatcatttctatcctacccatgctgattttgaatacagcccaaaactggaaccgaaaagagaccgtaaacctaaatttatcgacagagattctttccttactccggagaatgcaagaaccatttttggagttgatcagagaaaagtatacaattctacagcctatccgtggagatgtgtcggcagagtagaaagttctctgggttcagggagcggtgtaatgatagggccaagacatcttcttacctgctctcatattgtagactggcagcctaataatacaacaggatggctgaaattcactccgatgtattacaacggaagcgctccttacggaactgcctggggtacattgacgtattacaagtataaagttgcaggaccttctattgattcaacagagatacaatatgattatgtggtaattgtattggacagacctatcggaaacagcacaggctggttaggctcaaaatcctattccgactcgtgggatggaggagcttactggactcatgccggatatccgggagaccttaccggaacgcaaagacctacctatcagacaggtatagcccttgatggagatttctggagtgctgatgacaacgaaagcatgagccataaagcagatatttggcctggacaaagcggaggtcctttttggggatattgggatggctctccgtatgctgtagcgactcaaagcgcgcataatccaagtgataattttgcaagtggcggctcagatttagtcaatctggtcatcagagcgagaaatgaacatccttaatttatttttttagtttaaatcaaagtctgcctttcggggtggacttttttatgcagattaaaatatcggactgatttagccagtattctcaatattttaatacatttgtttaaaacatacttcagatgaatttcgaacagatcaacttacaccttgaggcttacaaagaacataatcagattctggatgcagcaaaatacctgatccattcttttaatctggaacatgaaaactttgcgggattcgggttcagggaggaactttctcccacctcaatgcttcttacggcagaaggcgatctgggaggaccgcaaactgtaatgatcccaagaaatttatttgattttgatctgaaccttgtcctgaatatggttgcccacgaaatgcttcatgtaagacagaaagcgcccggacaggtgatcgaagacaaaaatgaaagagaatttcaggcgtattatgaaatgctttttcacaaagtgtttccacagattcctgaggtttcggattttcataaaaaattctttggggggaaagccctggaatactacagaagaatgggtgaaggttcagtattacagcaaaaatatgcagaacagaaaacagaagttgaacatttaattaacaaattgccatgacagtaaaaccagacatcacctgggcagattttgaaaaaatagacatcagatgcggaaccatcatctcagtgaatgattttgaaaaagctaggaacccatcatatcagctggagattgatttcggagatttaggaatcagaaagtcgtccgcacagattacttctctttacacaaaagatgagttgattggtaaacagattttagcagtggtgaatttcccgaagaaacagattgccaacttcttcagtgaatgtcttgtgttaggattatacggggaagataaaaaagacgtcactcttttaacaccatcattacctacaaaaaacggaatgcaggtaggataaccgcctgttaaatataaaaaaaaccttataaatatttataaggtttttatgttaattattgatggagagtctttactccaagattcgtaacctggccgaagctaactgatacattaggagtattctcatccatatatccagtactatttcctgcatcataagaaacagtatagtttccctgtggcaacccggaaaacatgaaaaatccatcggggttaggtattgctgtagaaatcgtatctgaagccataatggcgtgaacaactgcctgcgccgcctgaggctgtacgtatcctttaatctggccgttggtaagctcagagaacgcccgtatcaccggttttaagatataagatccgttccctgtagtgacaatagatcttcccgcatcgaaatcaatccatactgtataggctccgtttgctgataatgtctgattccagttaaatttcagtccgctttgttgggccgacggagtttgcagaggataagtaattccattgacaactacactgttgttaggtcccagcaccattctcatctgagaaacatttccctcggggagtgtggcctgccctaaaactacatctgttccgtttttaaagttaagaagattataaacgcctggatttggaaagtttaatgctgtccattctccattactgttaatttcgattcgttgaatatcaatattaacagcattatatgctgcagggccgtcagtaagccttacattcactgtagcagtaccgttttcactggaatcgttacatgatgccagaaataataagcagatactgcttcccataatgaataacttcttcataagctaagttttaggtataataaaaacgttttggataattggtttattatgtcatatattcggttataaaaaacaaaaaatgatccaaagtatacctttagaaagagtcttatttcttgatatcgaaacagttccacaggcaggatcctgggacgacttatccgaaacagaacagtatctgtgggataaaaaaacaaaattccagagaaaggaagatgtgacggcagaagaattttatgacagagccggcattatggccgagtttggaaaaatcatctgcatcaccatcggaatggtcgaaaaaaatgaaacgttaaaaataaaaagcttttccggacatgatgaaaagaaaatgctccaggaattcggagaaatcttcaacagtccaagactttacaatgtgattctctgtgcccataacggaaaagaatttgattttccatggattgccaggcgttatcttataaatggtatgcagccgccggctccttttcagatgttcgggaaaaagccctgggaaattcctcatatagatacaatggaattatggaaattcggggattacaagagctttgtatcgcttgaactgctggctcatgtctttggaattcctactccgaaagatgatatagacggctcaatggtttcatcaatttactacatagagaaagacttgcagagaattgttgactattgtgaaaaagatgtcttaactttggcaaatgttttccggcgcatgcgccaggaagatttgttgaaaaggaatatcaatctagattaaaaaatgaaatttacagacgatcaaattgctgacattggtgaggaaatcattggtgtgctgaaaaccgtatatgaccccgaaattccggtagatatttacgaattaggacttatttatgatgtccagatctccgatgatgctgatgtaaaaattatcatgacacttactactcccaactgccctgttgcagagacgcttccacaggaggtaaaggataaagtgtctgaagtagagcatgtaaaaagtgtagatttagagcttactttcgaaccgagctggaataaggatatgatgagtgaagaggcgaagtttgagctgggaatgctttaatcacccttaacaatataaaaccccgaaagaagtatttttcggggtttttgttttttaaatatcttttgctatttcctttccttctctcctgctccattcactccatgaacccacatacagatccggaaccggaaatcctgcatagtccaacgctaaaattgtatggcaggctgtaacacctgatccgcagtgaataataaggtgttcaggtttatcttttaataattggctgtatttttcttttaaaacttccggactcaggaaatttccgttttcatcaaggttctcagaaaaaggaatattgatcgctcccggaatgtgtcctgcaaccagatcaatgggttcagattctcctttatagcgataagcatctcttacatcaataactgtagaagaatcgtttttcaattcattttcaacaacttccagacttgaaaccggaagaagccattgctttttttgaattaaaggcgctttatcaaatttctcttctcctgaagaaaactctaagcctgctttttctgcagcctgcattccgccatcaagaacctgaacattttctaatccgaaagatctcagcatccaccatgctcttgctgctgcattggaagcatttttgtcatcatagacaacaatatgagcatcttctgatattccaagatttgagagagttacagcaaacttgtctaccgaaggaagaggatgccttccaccaaaagctgcattttctccaatctctgccagatctctgtccagatctatgaaccgggctcccttaatgtgtttatcaaggtagttttgctttgcatcttttcctgttcttgcatcaagaatgataagattttccgccggaatattttttagttcgtatgaagagattattggagacattttgttgattttcaggttaaattttaaatttaattcgggtacaaccattattaaacaggtcgttcagccttattttgtcattccgtagaatctcaatttattattaaaaaatagtcctgattcctacggaatgacaaatctggctatggatatcaaagatccatgtaagtttttaaacaggtaaaacttataattcattcatcttaaaaatgaaaaatatccttcgctttattgtatgagctttcaaaattcagcagattcagcttatgttctactttttccaagctcataaaattgatgacctgttcagtaggcatatttcctacaaggtcatctttagccataggacagcctccgattccttttatcgcactgtcaaatcttctgcagcctttatcataagctgctttcaatttggaataggaatcttcatagcggttatgaaaatgtcctccgaagttaatttcaggatattttgaaggtattttttcaaataaaagtgcaatcgtttccggagttgcgacgcctgtagtatctgacagtaaaatatctttcactccgatatctgagaaccgctgagcccattggtcaacatcttcccatttccacatttcaccgtatgggtttccgaaagccatcgagaaataaatattaagctgttttccttcactctttaccagatcaagcattttaatgatctcatcaaaagcttcctcctggcttttattggtatttctgtgctgaaaagtttcagaaatagaaaacggaaagcccagaatatctacagactgatgtttcaatgctttttcggcgcctctgtaattaccgatgattgcagaaactttcgttttggaacgggacttatcgatattctccgctacttcattggaatctgccatctgcggaattgcttttggagaaacaaaactcagacaatccaatacatcaaaaccaacatccatcaaggagttgatataatcaatttttttatcagtagggataaattctccccatccctgcatagcatctctaggacattcggtaagaaacattgttactttttgattttctcaaatataataaaactaaactatttggtatactgtaaatacaaagctagcactattttgattttcaaagttttatatgtgattaataatttcgataaccgatattaaatcgcaaataatgtattctcagcatcaaatttgctaactttgttaaaattttgatatctgatgagtacaatagaattcaacccgttgtggaaagaaaaattactgaaccgttttcttagttatgtaaaaatatattcaaccagcgatgcagaaagtgaaacaacaccttctactgaacgccagtgggatattgccaattatatcactgaagaactgaagactattggtctggaagacgtttctatagacggcaacggttatattatgggctatattccttctaacctggaaaatgatgacagacctaccatcggatttatttcacactatgatacttcaccggacttcagcggagaaaatgtaagacctcaggtttggaaaaactatgatggaaatgatcttcttttaaatcaggcaacaggattcacattatctccttcaagatttgaaagtttaaaaaaatatatcggccagacgttaattactactgacggaaatacgcttcttggtgctgatgataaagcaggctgtgcagaaattgtaacagcggccgaatatcttattgcacatcctgaaatcaaacatggaagaattgctgtaggatttactccggatgaggagattggaagaggagcgcataaattcgatgttgctaaatttggcgcagaatgggcttatacgatggatggaggagaagtcggagaacttgaatatgagaactttaatgctgccggagcggtggtaaaaatccatggattaagtgttcacccgggttatgcttacggaaaaatgatcaacgcagctcttttagccgctgaatttgctcaaatgcttcctgctaacgaaactccagccactacaaaaggttttgatgggttctatcacttaatggatattacggcggatatttctgaggccaaactacaatacatcatccgtgatcatgatgcagataaatttgaggccagaaagaaattcatggaagaaaaagtagctgaattcaatcaaaagcacggtgaaggaactgctgaagtggaaatcaaagagcagtacagaaacatgaagcagcagtttgaaggcaaaatgcacattgtagaccttgcagcaaaagcaatgactgaagccggtattgaacctaagatcaaagcgatcagaggtggtacagacggtgcacagctttcttatatgggacttccatgcccgaatatctttgcaggaggaatcaacttccacggaccttatgagtatgtagctttggaaagtatggaaaaagcaactgaagtcattattaatattgtaaaagcttaataatcatgaaaaaggtcttagcatcagcattcattttcgcttttattttcagcagtgcccaggtttctgaatttcagagggcagactcacgctatgaaagaaagaaaacggctctgtataataaatatcctaagcctaatgatttaagaacaaagaaagaatggcttctgacagaggataaaataacagcatataagacggctttggagaaagcttctcttgaggatcagaaaatgattgctgccgaccctcctgtaaaaacaaaagtctctaaagaagctgaatatgataaaggtaaggcaggttttcaaaagcttttatatgaagccgtagatcttgactttctcaacttttcgtcggattcttacaaagctacaatcagttttgtggtagactccaaaggaaatgcccttaaccccaaagtaaaaggcaataatgaagatgtaaatgcatttattgaagctgctttttacaggattaaagataaaggcaaatggaaaccggcagcagacaaaggaaaaccagtctcttccaatgtttcagtccctttaacattaaattttaaaaaataatatactaaacccgctgttatgacagcgggtttttatttttcatataataaaaatataattaaagatcattatgttgttgatattaatttaatataattcttttgtaagttttaaataattcacctaattttgattaaaacttaaaatcactgtatatgaaaatgaaatccaaccccttcaaaatcaacagaaatttttacttttctttccttctatctattttctgtttgtttcttttaacgtcttgttctcaggatgatcctgcagatctccctgctgaaaaacctgcagagtctgttcaaatgaagactttgggcaatctgactttacagaagaatgttattattctgaatgatgaatcagtcaatgcaatttctacccatactgatggaaaaattacgttcagccgtatgactcctcaaactgatagtatttcggtaggaactgttattgtagggactaaggttgaaggtgatcaggtaagcaccattctttcaaaagtaaatactgtttcaaaactgaataaccaatttacagtacagacttccagtgccaagcttgaagaatttatctatagcggaacactgagcggagtgtatgatccatcaggaaaagctcccgtcaatattgatggaaaaatggttaattatgttcctgtggaaggcatggtttctgaacaaatcaatcagagaatactttctattgaagctaaaaatcttcagaatcagaaactaattactttcaaccgttataattttaataaaaccttttcgtttcctttatcttctgcaggaacatccagtgttaacgtacagggaggatttactccaaagattgattataatattacattctcatgggggcatttgtccaatttctatgttaacctcatcatggacgacatcaagcttcagagctccgcaactattgtaggaagcctgggctatacagccagcaccacagattacctgaatattcctattgttcctatcgtcttaggccccacaggactgatcttaagccctaccctatctgcaggccctttcctgggagtacaggctacaggaaaagtacaggcccggcttttggatcttgaaggaaatgccaactttttggtaagcaaaactccggaaattaatatcaaccttcagaaaaaatctgagcctgccattacaagcgcagaaggaaatttatctgctgaagctggtttagaagcaaaaggagctgtaggactcatgttccttaccattcctattgctaattcaggattgaaaggaagagcttctgccctttcctctttaggattaacacttattccttcaagaaaaggagtgattactgtaaaaggtaaaatccaggcagatatgttctatggttttggaatcgctcctttacgatatgagggaactattcctcttttcagaaaagaacgtctgctctatcagaaggagttcagcttctaagacaacatattccattgattataacaagccacttttgcagtggcttttctttattaaagcgccacataaaattcatttacagcacattaagtcatttttattatatttacaaggaagtacaattttaaacaataacatttaataccaaattatcatgaaaacaatgaaaaaacttttgagaaaagacttatctgccattcttggcagcggaggaaatgaatgccatatgggcggtgattcctataactgccagagtgactgtgagtgtgcctggggaaaagcctgtgaaatgtatgaagacgggacacccggacaatgcatcgctgtgggcggaggcggaaatcctggcggtggaggcactggcggatgcattcgaccttccatttgtgaagaacaaccttattaatgaacagaaaaccggaagcattactgctttcggtttatttttttcatcgggaaacaggtccttgtcaaagtatccctgccgttcatcaaataaaatttcatcccatctatcataattgttgttttgcaacagatttttaacaataataaaattatgaagcagcaatttttcgctttaagtgcattgttattatgcatttttggcggtgtggaagctaaggcacaacagaccccggcttttcacattggggtaaagggaggggcaaactttacaaaaacctccacggaatcttctctggaagggaaatatggattcggttatcaggcaggagtaatgacaagagtggatctcggaaaactgtatgtgcagggagaagctctgttcaacaaaagaaaaacatcgttccagtctcaagacggaggctcttccaaactttcctggaacgctattgatattcctgtggtagtaggatacaaattcattaaaaccgaagattttaatgtaagagctttcgccggcggagtctacagctacgcctttaataataaattatctgcttctcaggctcttcaggagggctttaaaaagtttgacaaatccaatatcggaattacgggaggtataggagtagattataagaacttcacgatagatctgagatatgagaccggtcttacaagcattagtaaagaatttaagtccaaaccccacagtttttcccttgggataggttatttcctgttctgaaaaacttaaattatctttaccattagaaactgttttccctgcagtttctaattttttttatcaacctatttcctgttccatgacaaaatcttttgttttaaaagaatacatatttacctttattttctggcttgtactggccattgtattgtggtttaatttccagagtacaacagaaaaatatcttgcaatgacgcaggctgcgattattgcagcattctcatttacatttactcattttttaaccaatagattactcccgaaagctcttcgggaaaagaaaatgaaactgttccttgtacagttggtaatggttattttcatgctcagcctggttttctccgttatattcacgtatcttgaagtggaacccaaagatcagcttccggaaagcttcagagatcagctgccttttctttggaagggcttttatatgtctctgcctgcctcattcctcatcaacggagcagcatgcggtataaaattttataatgaacatggaagaatagagcgcgatcatattctccttcagcaggctcatctggaaaatcagcttaagcttttacaggatcagattaatccacatgtagtcttcaatattctgaatcatattcatattctgatgaaaacggatatacaacttgctgattttttattgttgaaattctcagacattctgcgataccagctatatcattgtaatcagccactggttcctttggataaagagattgagtatctccaaaatcttgttgaggtagaaaaactaaggtggggaaacgaactggatgtaaaagcccaatggcaaatcaataatagaaaagcttctatcgctccgttacttttggttccttttgtagaaaatgcatttaaatatgtttgcaggcttccggggcataaaggttatgtgaaaatctcctgtaaagaaaagaatcacagtctttatttttatgttgaaaattcatattcggatatggcaacctataaaaaaaaggatggaaccggcggaattggtcttcaaaatgtaaaaaaacggttgaaattacaatatccggactcccatgatctgaatatagaatcggataatcacgtctttagaataacattaatactaacactatctgacagttatgagctttaatattcctaaaatgaaatgtcttattattgatgatgagcctctggcaagatttcatcttaaagaactggctgatcagattgattttttatccgttgaaggaacctgcgcaacagcactggaagctgacgcaaaggtaaaggaaagcgaaacagaccttcttttcctggatatcaatatgccctatcttaccggcctggagtttctggagcagcttgaaaatcctcctttatgtattcttaccactgcttattccgaatatgctttggaaggattccggctgcaagtggtagattatcttttaaaacctattgccttcaaccggttttatcaggcggtaaataaggctcagcagcaatttatcatcaatgaaaaatttaaaaagaacacttccctggatgatcccttcctttatgtaaggcagtctgatactttcattaaagtttcatgggttgatattctgtacattgaaagcatgcagaattataccaagcttcattttaaagataaatccctggtcattcaccaaacgatgaaagcgattgaagaatcacttccttcggatcattttttcaggattcataaatcatacctcatcaatattacccatattgatatgatctccggcgggcgtctttttattaataaaactgaattacctatttcgcgtaaccgaaaagaagaattacttaatcaggtggtgtataaaaaactaatcagtaaatagaaaattgataatattaaagggaaggcagtaaaaaattattactccttccctttattttttatggcagattccaacgtaatgatactgctgcgtaaaatgtactggaaaatcttggatcagctatttttttatctctgaaaatgctgctgattttccgatcattttcactaaagctcctcaatatcgccgttcctcccgtaagacgtaatgtgagcttatcattgatttttaattccggtctgagcccagcggtgatctgctgataacccagcaacatcgattttccgtttatatttctctctgctgtcattccgttcagttctacaacggcttttaaggcaaatttatcagagaaaagatatccggcttccattccttccgggaaattgatattgaatttaattttcccgtttgttttccagtcaaaataaatccacggtaaaatcataggaacaccaaaagccgtggtaagtaccggcccggcgcccagggaaagattaggattaaaatgcctgataaacaaaatacctccctgcccaagcacatcgtcaaagtctaccttttcaagatctgtatatacccccacagacgctgtcatcatcatgctccactttttgcccaaaggtctcatatgctgtattccgacctgtgcattcagcatctcatccggaaaaagccgagtttcgtaatttttgtgcgtcatctttgcgtaagatccgctcaacagcatagaccatgctcttactttgccatcggtatctttttttacagacagcggaatgctgagattcagatctactcttttaaaatcacttttagagttggtttttgtactgtcttcaggacggatataattagatgccggaatatactcggttttaagctctgcggagagcccggactgtgcattcacccaacatcctaatggcaatatacagcatagagctgccgaaagggttcttttcatattttaaattttatgcaaagagaaccctttgactattttttacaaaaattacttgattaagtgtccggatcgtgtgacaacaggatcaaatagcaggattagtttctgtggaagattgtgtatgtacgctttcctttttctgggtcttaaaaatacgatatccaaaccacactgcgatcaatgccattgcagaacgggttaccaccatcgggattatagaatctgcttctaaaaagcccagcaatgctgacattaaaaatgtaaccataagctgcataaagcccagtagtgcagcggccgtgcctcttccttctttaaacggagatagtgcatgggcggatgtaatcggaaacaaaataccaatagcaagcaatgacagatagagcatagcaatttccagtgctacggataaattttctgccgcaatcaggatatgaagcgtacataccaccagtaaaataactgtagctacaaataaaagcgttgaattgcttattcttttaatcagtttaggtgtaatataagctgcagtaatcaaagccagtgaattaaaggcaaatataaagctgaatacactgcttgagaaaccatgaatttccatgaatagaaacggagcatttgagatataaatgatcagagaagcaaaagcaacacttcctaccatggtactgctgataaaatctctgttggaaataatcattttcagctgatcttttaactttttttcatccgttgcttcatcatcaggaagattgattctggtattggtttcgggtacatatttatacaccataaaaaaggttataagccccataatgcataaaaaagcaaaagaactgttccaaccccagaatttaaggaatacactccccagtaacggcgcaacaataggagcgataccgctgatctgcgactgctgggaaaagatagtgacggctttgtgcttatcatacagatcaataatgatcgcccttcctacaacaattccggcgctgcctccaaacgcctgcaaaaagcgcatggcccataatacataaatatctgaggtaaaatagatggccgtccctcctgtaataaaaagtaaaagtccagagtacaggacaggcttacgccctttcttatcagataaaggtccccataacagctgtccgaaagcaaatccggcaaagaatacagaaatggatatctggatatgtccgatatcggtattaaaaatcttcgccatattgggaaaagcaggaagataaagatctatacttagagactccagcgtgttgagcagtgcaagaataaacactacaatattcaaattcttcttcataaataacggtaagccttcacaggcattttttcagctgcaaagttgctgtaaaaagccatgcttttcaataaaagaactgaaggaagtataggacaaaatgaagatttaagtagaccaacaaacggaaaatatcagtttaaaacatttattatagtaaatactgaagattatcttttttcattattcttaaaataatctggtgtctggccggtatgtttcttgaaaaatcttgaaaaatatgaagcatcgttaaaacctagtttaaaagcaatttccttcactgtaagcgctccaaagctaagctctcttttggcttccagaatgagacgctgggaaatcatcttttttacagttgtccctctcaaaagacgtacaatatcattaagatggtggctgcttattttgagctggtctgcatagaaatctgtttctttatgggctatataattccgctcaataagtcccaccagttcctgaatacgctgacggtcattttgtagaggttcctgaggaatgatctgttccccgatgatgatacagaatgctttcaggtaagcttttaagagttccgttcttgctgtagtcttatattcctgttccatcagagagataatggtgatgcaggtcttttcattttttggattcaaaagaaagggtagttctcctccgttgagtactgaccctatatcacatgcttcgttgaaaatttccctgcttattgccattgcatatccttcctcgcctgccagtttcatattgaaggcctgtcctggtgcaatgatacagatttgattgttttcaagtctgtagctttcaaaatccagttccaaacgactgctttcaaagacttccgtgaaccagataatctcaaaaaaattatgccggtgcacatcatgaaaattttcaggacctgccgcactcagggtactcatctgaaacttttcagaggtcagatggtgaaccgggatttctttttctggtatactcattactttaaactataaacaaaaaccacagcaaaaaaagtgctgcggttttcttacaatatttaaaattaaatataattttttgattattggtttaggaaagcgtcccatccttgtgccgtcaaagctaccaattgattagaccctcttgccaccataaagttcccttcttctttttctacagcgtgtcctataatggtaaagtccggatgatttttaatcttatcaaaatcgttaggagaaatcgtgaacaaaagctcgtaatcttcaccaccgcttaatgcagtcattaccggattcagattcatttcatccgcagtagaaattgtaagactgtccagcggaattttttcttcgtataatctaaaacctacttttgactggtctgaaaggtgaagaatttcggaagctaagccatcagaaatatcaatcatggaagttggtttaatatccagttcttccagaatctttttgacatctgttcttgcttcaggtttcagctgtctttccagaatatagtcatatccctccatttcaggctgcatattcggatcagcaaggaaaacagcgtgttctctttcaagaatctgtaatcccatgtacgctccacccagatctccggttactacaagaaggttatttggttttgctccgtttctttttactatattttcttcgttttctattcctacagcggtaatactcattaccaaccctgaattggaacttgtggtatcccctcctatcagatccactttgtatcttgcacaagcagcctgaattcctgaatagatctcctccaaagcttccaccggaaaacggttggatacagcaagagaaaccagaatctgcgtaggagtggcattcatagcagcgatatcgcttaggtttaccaccactgctttatatcccaaatgttttaaaggaacatagcccagattaaaatgtacgccttctgccagtacatctgtcgtaagaactacttttttgttgtccggattaacgactgccgcatcatctcctaccccaagctccgaagattcattggatagcggaaaatgctctgtcaaatgtttaataagaccgaattctcctaattttgagatgggtgtaagttcctgtgatttatcttcaaacatgattttttgtattaatgtccaatgtaaaaagtatgaatgattttaaaattgctcctccaatattgaaccttgaattttaaactttgaattattgagtaagttctgccggatcgatattatgtggatggaaaggcagctttttaaagtcttctttcgacagcaccacagtttccgggctcttgtatttattcattgcttccactacgtcatccggcggagtggtcatttttctaagcatcatatcgatccatacccctgtagcttctgatgtcgcacaatgtaccccatccggagtatagaacttatgcaggaaacggtagatagaagaatcttctgaacatccgtctatttccacacttacgattaccgtctggtctgcataaatctctttgaagaaagaatatctctcatgcaggattaccgggccaatcccccatctgctgagctgggtaactcccattttttcttttgtcatgaaagccattctggcttgcgcacaatattgtacataggatgaattggctaagtgcttgttggcgtcaaggtcgctccatcgcacttcaaatttatggtagaaaatcatttgaaaatcgtttttggtctcactaaaattataatcttcaaaaatactcaaataagatggtttataaaaattgtacttttgaaaaaataatcttccgcataggattacatatacatgaaacagatcattattatcggaggcggtgctgcaggctttttctgtgcatccaaccttgacgaaaagaaatatacaattacaattttagaacagaattctgatgtccttcagaaggttaaaatttccggaggtgggcgctgcaatgtaactcatgcctgtttcgatccaaaagagcttgttcagttttatccccgtggaaataaagaattgctgagtgtttttactaaattccagcccggcgatacgatggaatggtttgaccagcgcaatgttccgttaaaaattgaaaatgataacagaacttttccgaaaagcaattcttctcagaccatcatcaatacttttctgaatgaaactcaaaagaaaaatatttatgtaaaaacaaaatgtacggtaaaagagattgaaaagcagggcgaaaaatatatcgtaaaaaccaattccggagattttgaggcggattatattgtgtatgctaccggaagttctccaaaatcactgaaaatcgttgaaaatcttggccataagattgtggatcttgtcccttccctttttacatttaatattaaagatgaactgctgaaagagcttccgggaacaagctttgaaaatgcaggaatttcaattccgaagctgaaaacagaagaaagcgggcctttacttattacgcactgggggctttccggacctgctgttttgaaaatttctgcctgggaagcgataagtcttgccaggcttaaatataactttgaaattgaagttaattttatttcgaaagaaatggatgaagcagaagaaatcttccaggaattcaagcaaacccatcctaaaaaaacaatcggacaatctaagatttttgatattaccaacagattctggcataagattttagagatttcaaaagttgacctcaacaaacaggtggctaatatttccggaaaggaaatacacaaaatactggaaaatctttgcaggagaaaatttcaggtgaccggaaagtccacttttaaggatgaattcgtaacagccggaggcgttgatttaaaggaaattaacttcaaaaacatgtcttcaaaactacttcccaacttctatattgccggagaggttttgaatatcgatgccgtgaccggtgggttcaatttccaggcgtgctggagtgaaggatggctcattgcccaggatctcaacagcttataaaaaagtattatttttacgaaaactataaaacatgaaaaaaaatttcgtcttctttcttttactctggatctttttaggatatagccaggaaagaacaattgtttctgactggacttcacttacccaggccgtcaatatagagaataaacccaactggaacttccgcgttacagctaaaatcaggaaagaaaatgaggataatggttccaattgcgggctgtggtgcagaatagacaataaagataagtcaacaggcttttttgaaaatcaatattacggaatcaaagtaacccatgaatggaaaacatacgaaataaaaggaaccatcaatccctccgcagaaaccatgaatatcggtgcttttgcacagaacaacggagatttttattttgacgattttaagctggaagtcaatgatggaaaatcaaaaaaatggatcgaaatccctttggtaaattctggttttgagaaagatattatagcatccggtggctggtttgaaggaatccattctcagaaagtaacacatgtaaaacactttacaatcggagcttcagattataagccattcagtggtagcaaatcattgctgatgaaagggcatgatattatcggtacaatgccgcatggaaagtttatggatgtaaacggcatcaaattatattatgaggtttatggagaaggtgatcctgtacttttacttcatggtaacggacaatcaatcagtgcttttatgaaccagaaggatgagtttgctaaaaaatataaagtcattatcgttgattgccgtgaacgcggaaaatctacttacgataaaacaaaagaacttacttttgatattcagacagaggatcttaagctgtttttagagaaactcaacatcaaaaaaacaaagatcctgggctggagtgacggcggaattcttgcgctgtccatggcaatgaaatatcctcagatggtagataaaatagcatgttccggagccaatatttatccggaaggagttaaagatgatgagttaaaatctatgaaggaaatgcttgccagccttattaaagagaataaagatcataaaaatgatattcttattgatcttttgaacctggaccttaagtatccgaaatggaagtatgaagacctgaataaaatacagtgtccatcattgattattgcgggggataaagacattataaaaacagaacataccgtaaaaatagcagaatcaatcccgcatgggcaattggcgattattcctaattcaagccattttgttcctgaagaaaaaccggaattattcaatgagttagtcattgatttctttgaaaataaataactaaaaaccaaacatgaaaaaaacaataacattctttgtatttctaggatttggactcacattttctcaggtaaaggaaactgaaactctatcagctaaagatcagtctgaagagtctgttttgtcgaaagacgaaaaatctgcagaatatcccagaggatggatggcacttcgaaaagatattgctgacagaataaggacgaaaaaaataaatatgagaggaattgagggaacaatcacggcgagggcaaagtttatagttaatatcaaaggtaaaatagaagacatcacagtaactggtgataatgccgacttcaataaagaaatagaaagagctataaaatctctgaaagcccaatggaaaccagcagaatccaagggtcgtattgtccgcagctattatacttttcctcttacgataaaacttgattaacagccaatgctttctgtcaaaagaaatatctcttctttctttaaaatccttcttattgcagcgtttgggtatttcttttggctgatgctgaagatcacactagaatatatcccttttaaccgagaagtgagttttctgatgatcaaacaaactgaagttacagaaagaccggaatatcttacattgttctatacgcatgtttatacaagtatttttgtacttctttcaggttttctggccattctcagaaaagattttggactgaaaaactttcaccggaataccggaaaagtatatattcttcttattctgatctttgctgcaccctcgggaatttatatggggctctttgccaatggaggctttttatcaaagatttcttttgtcatattaggctttttatggtggttttcaacatataaggcctatcagctggcaaaacaaaaaaagtttaaagagcaccaacaatggatgtggcggagttttgcctttacattatctgccattaccctgagaatgtggaaagtaattattgtctatttatttcatcccacccccatggatgtttatcagatcattgcatggctgggctggattcccaacatccttattattgaatatttaatcacaaaaaaacatatatgaaaattgtaaagtacactcttatttctctactggcagttgctttggtaagctgcaaaaaagaagcaaaaaccactggttccggaaaggattccctgactgcaaaaaaagactctgttattgttcctgaagttcacaaagaatattacggaatttacaccggtgagtttgccggaatggaaaagatggtagatgaaacagacggctcggaatatgatgtcgataattacaaaagaatttctttaaaaatcaacaggattaccagggacagtgtttacggacaaagtatcgtgaatggtaatcagcgcccgttcagaggagttttcaatgaagcgacggcatcttttgtgcttgatgagccgggaaatgataaaacagacggaagatttgaagtaaaactgaaaggagacagcttaaccggaaaatggaatgcatttgataaaacatccgtcaaagcccctttaaaaaccctgaaactgattaaaaaagagtttgtttacaatcccaactttatgctggataaggattccgatctggtagactggacaaattcaaaagagttcaccgaaaaatatacagatgaggaaaccggtaaaacagaaagctataaaacaacaaaaaatcgtttcgcttccgaagccatattcaaactaaatgcatcaaagcagaaattaacagaaaaagatcttaaaaatttaagaaagctggatcttgaaatcatcaaaaattctgtatttgcaagacatggatactctttcaaaaaagaaacctacagaaatttctttgagcagacagattggtatatcccggtttctaataatgtagacaatgatctttctcctctggaaaaggaaaatgtggcattactgaaccgctttaccaaatatgctgaggataagtatgacagctttggtcgataggtaataagtgactggctttaaggattagggaccgaggttacaccaccattgtttgccatccttacatacatatagagaatcaggcagcctatggcatagcacagattatcaatccatgaaaaagaatttccgatcacaatatacatcaggcttccaggacggaagcctagtttttctgccatatggaaatactgtgcaaattctactaaaaatgaaaaaatcaaaattccaaaaatcagtttctgatcgtttacttttacaaaactcctgacaaaagtataaagaagcatcaccacaatgacatctccaagataagctctgacaaagaaaatatggcttagtttggcagcaatcaatacctccaccagaaaaataaagattgtcataaggaaatatttcagactgaattgtaatttcattttaaactggttttaagtcataaaaaattgatattcccggaaatctctgtctgttgcatcttatttatcagactaatcatttataaaatacaaaatattatcattcaacaatttacaaaaacaaaaattaccgctcgaaaaaatattttacaaataaaggatttatttttatcatcaattcatttttttgatatttttacagccttaaaaattaaaccatgaaaaaaacttatttacttctgccaatcttctttttggcttcatgttcaagcagcaatgatgaaacagatttatccaacaataatgggaataacaatggcaacaataatcccggcactcctgtcttaatctcgaaacttactgtagatggagatacatccgtattcacctataatggttcaaaaatttctcaggttaaaaatattaatactggagaagtttccacttatacatataccggagatttaataacggaagaattaaccacgggaggaagctcaacctttaaagtaaattatacttatgatggaagcggaagattaattaaaaaagtgagtgtacaacatatgcttgttaatggatacaccgcaacagatgaatataattatgcctacacttccaatactaccttaaaaataacttataccaagactgttgcaggaaatttcacaggatctccttcgataacaacaggaactaaaaatgcgacattaaatgcagatggttcattaaatagttggacagaaacagcctcaatccctattcctggtacttctggctttaattctgctaccggtattttgaagcctattgtatatgatacaaagaattctccacataaaaatataacaggatatctaaagattattgatactgaagatgaaaatggatcttctcacaatattttaagttatagtgataaactggatcttaataatggttctggaggtgctatgtggggaatatttaaatctacttatgaatataatacaagtaactatcctaccaaaaatgtcagagtttattatgacaagacatccactaatgtaacaagcagtgaggttattacttacgaatacaatcacctataacacagaagagcgctcaggcgctctttttatttttctttaattcatatatttaatttttcacaacccatagaattatgaagatcattttgtatatttgagttgaatcaaaactaaaatatcatgaaaaaattaaacattcagaaaagaaaattaacaaaaagtgaattgaaacagattaacggaggcagcggaccactttgtcccgggacttgtttctgtaatattgatggagagatgaccattggggcatgcactcctaaaggacaatgttgttaatacattacaacttgtcatataaagaataaggattgaggcaacccctcaatctttttttataaaactatatttcaaacaaacataacattttgactcacaatattttgaacataataaaataacttgtaaattagcttttaccaaattaaaattattatgaaaaattcaaaaaaacagaaaagaaagcttagtaaaaatgagctgaaagagatcagcggaggagccaacagaccgatctgcccaagagtgataagctgtacagatccgaataccggagaagagagatatggagttccgggcatgcaggacggattctgctgctaatagaaatatgattaaaaaaatgattggattaccctccaatcattttttttatggcgttgagcttcattaaagcttcaatcggtgttaaagtattgatatctattttcgtcagttcttcacgaatattctccagaacagggtcatccaactggaagaatgaaagctgcatattttcctcggtcacccttttgatgctttccgaagtagctccattaccctgagttctgctggcttcaagtgttttaagaatttcattcgctctgttaaccactttcgcaggcatacccgccagttttgctacatgaataccaaagctgtgctcacttcctcccggaaccagctttctcaggaaaatgatatttcctttgttttcctggatagaaacgtggaaatttttcactctttcgaaattcacagtcatttcattcagctcatggtaatgtgttgcaaataaagtctttgcctgtgttggatgctgatgaagatattctgcaatcgcccatgcaatggaaaccccgtcataagtggaagttccacgcccgatttcatccaataaaataaggcttcgctcggagatattattcagaatatttgcagcttcattcatttccaccataaaagtagattcacccgcagaaatattatcggtagctcctactcttgtaaaaatcttatccagcatcccgatttcagcatattttgccggtacaaaacttccgatctgtgccagaaggcatacaatcgctgtctggcgtagaattgccgacttaccggccatgtttggtcccgttaccataatgatctgctgggaatccttatccaggaagatatcattcggaatgtatttttcacctagaggaagcgcattttcaatgatcggatgtctggcttcttttaaatcgatcgcatagccatcattcagcacaggctttgtatagctttcagaaacagccagttcagacaatcctgcggctacatcgagctgggcgattatgttggagttcccctgaatctgatcaatataaaccatagtttctccacatacatttctgtagagcgaagtttccagaacgcctattttttcttcagcaccaagaatctggttttcgtattccttcaattcttcagtgatatatctttcagcattcaccagggtttgttttcttacccaatcatcaggaactttatctttatgtgtattccgaacttcaatatagtatccgaaaacgttattaaaatcaattttaaggctggtaattcccgtcctttcaatttccctctggcacatttcatccaggaagccacgtcctttattctgaagatttctcaatctgtccagctcttcagacacgccttctttgatgatatttcctttcgctatacttaccggaagctcttcattaagatgattctgcaggaatttaatcaattcttcaaggtcaaacaggggctctaaccatgccagcacatctgcatgagggtgcaataaagcttttattttatgaatattaatcaaactttggcgcaaatacccaagttctttcggagaaattttttctgccgccagttttcccatcagcctgtcaagatcagaaattgatttcagaagctggcagatctcatatttcagatgatcattttcatttaagaaatcaatcagggaaagccttctcatgatctcatccacagattttaaagggagaataattcttcttctcaaaagccttccgcccattggcgtagacgttttatcaataatatccaataatgatttcccctgcggattgcttggatacacaatctccaggtttctcagggtaaaattatccatcatcaggtaatcttcctgaggaatgatctgaagcttagtaatatgggaaagcagattgtgatgggtatcttccacgagataagcaaaaatggctcctgctgcagtaatagccaacggaagattttctactccaaaaccttttaaggaattggttctaaagtgattcgttaatttttcgtaggcaaaattatactggaaggcccagtcctcaagcttaaaagcatttttatttttgatctgttccggaatctgtgtgcttctctggaagataatctcactcggatcaaaagtattaacgatatgcaatagcttttccaggtttccttcacttaccagaaactctcctgtagagatgtctactaaagcaattccgtatttctctttttctttatgtaatgaaagaagaaaattattcttttttgaatttagtacctggtcattgaaagtaacgccgggagtaaccagctccgtaacccctctttttacaattcctttcaccattttaggatcctccagctgatcgcagatcgccacacgcattcctgccctcaccagtttaggtaggtaagaatctatggaatgatgcgggaaaccagccagttccacacttccttcaccgttatttcttttggtaagaacaatgcccaggatctgagatgttttcactgcatcctgcccgaaggtttcataaaagtccccaaccctgaaaagcaaaagcgcatccggatatttacccttgatggtattgtactgcgtcattagcggggtttctttctttgattttgccatagtaaaaaatgagccccaaatttaaaaaaataaattcagggtaagagaattgtttcggggttaatcttccctgtttttctttatcattaattaatcgtattttcactgtcaaatcacattattttatggaatttcctgttttaaagacagaaagacttatcttgcgccagcttacgttcaatgatatccaggaccttttcgaatatttttctctggatgaagtcatggaacattatgatctggacactttcaaaacgcctgatgattcacgccgcattattgaacattttaacagtgaatttgaaaaaggaaaaggattcaggtgggctctggagctgaaatccagtggaaaagtcattggtacatgtggctaccacaactggcacagagaacatttcagggcagaggttggctatgaacttaatccaaaattctggcagcaatcctatatgaaagaagctcttcttcccattctgacctatggatttgaaacaatgagacttcaccgtgtggacgcattcattgatccttccaatatttcttctgaaagactgttgtcttctttaaatttcagcaaagaaggaacgctgaaagattatttttttgagaaagggaaatttgtagacgcaacaatctttggacttatcaataaataaattgatttaaatctaacgctaagaagcaaagaaaattgatattgattcttcttattttcgttcgcaaaggcatttcatttagcaattgaagtgctttactcgctgagtgaaacgcctttgcgaacctttataatagattagctttaaacttgcgttcaatgcgttaaaatggtcaaaagtataatatttatttttctgaaaggtgcttttccaaagcctcagaacttttcttataggcccatttttgcttgtagttcacccatttggctttaaaaagttttcgcatcagcttatctgtatacctcataatgaaaacatgatacagcatattggcaaagacattgggtttattcggaagtgctcttaaagaaagagaaaaaccaggctcaagatatctgttgaaatgccagaacgctccgggaataaaaagagcatcaccatgttccatgaaaatctcgtagccttttgcatatctcaatgcgggaaacttctcataatccggattttcataatccagttcgtaaatggtatgaacagataaaggaactttatataaaaacggggactgtttctgatcaaaaagcaggattcttttctttccttcaaagtgaatatgcataaaatcacccagatccacatcataatgcattaaaacatgggcttcacttcctccgaaaaataaagtcggaagtctcttaaaaaacttcattccaagatccggataggtgaaatttttcagcagttcgggaagcctgtctgtgatgatatagaaaaaaatacgaaggtctgaaggcctactttttatggtatcaatatattccttcattttcatatgggtcaccggagcatcagaacttttagaggcatcggccggtttattatcatacaaaggaacttcctgatcacctgccttttctctgatatatgccagattccatttatcgaaggcatcccagcggctggcaaaatttttaatcaaaagaggcttctgctttttgaaataattcttctgaaaatcttctttactgatatcagttacaatatctacattttcgaggatcatgtattttgtatttaatgcgaaataaaaatagtgtttttttgaaacctgagaaaattaagattaaaagagctggaagaaggaagatggatgctgggagttcatatttgtctgcaaacgactatacatcattccataaaaagattttatggaaaaacatagacctccttcggcttcaataacatctcttttccaacttcagacttccttactttattggcagagctcggatgaaaaatttatatttgtagtaataagtgaatttatgagagtctacaacaccaaacatttccttaaaatcctgttcagtctccacaaaagcgataccctgaaaattcttttcccaagtatgattcttgtaggattatactcatggggaattcagtatctggaggtagaatatctccatcttacttcaaaatcaggaatcagcaatgtggggatgattcactctctgctgggctttgttctttctcttttgctggttttcagaaccaataccgcttatgacagatggtgggaaggcagaaaactttggggcaaactggtcaatgacacccgaaattttgccataaaaatcaataccattcttggcgataatcgtcaggatgctgagcagattgcaagatatctgaaattctttcctcactttttagccaaacatctttccaaagaatctacaagactggctctggatgaagattattctgaaattgaaagctccttaaaaaatcatggcccaagtgaaatgattattctgttaagccataaattaaatcaattaaaaaaagaaggaaaaatatctgaagttgaaatgttgtatctggatacccagctttccgggtttctggatgtatgtggaggctgtgagcgaatcaaaaacactccgattccttattcctactcttctttcatcaagaaatttattatcctgtacgtttttgccttgcccattgcttacgtgatcaccattggtcttttcatgattccgcttaccgttttcgtatattatgtactgatgagtcttgagctcattgcagaagagattgaagatcctttcaataatgatgaaaatgatattcctatggaaacattggctcagaatattgagaagaatgtgcatcagattatgatcagaaaataaaaaatcaagcttttaaagcttgatttctttgagttcgccgtcctgttttatctctacaaatttgctttccctgttggcagcagaatatccgtagaaaaatgtactgtatatcggggttgaatacagatacgctccatagccgttataggcatcagaagtcccggtctgttgctgataacttgccgtagctgtaaaattgacgatggtttcaagataatatttccccggcttcagcttttcgaatttaaaccttccgtgatcatctgttaaggcttctactctgtatttgaaagcttcttcagacatatataccgtcgtctttttattttcatacttccttctcatgtcgtaaaactcctgaaaataaggcgttacaggaaaaagcatgacaacagttcctttgggtgcgtaatgcttttctccaagcaatggcttaataccccagttgtttttttgttttgtggaagccacaccttcaatggtagaattcccgaacccaagcatttctcttgccagttttttatcgaaaaaagcctgaggataataggtattttgtgcttccaggtaaataaatccccacattaatatgaataaggtgaataattttttcatagtatatttttgagtcaaatataagtattttactatttttgaaataaaaatagctatgaagtacatctttttattatttttttccgcttctgctctcattatggcgcagaaaccctgcggatataaagacggtttacaggagggagcctgcaaagagttttatgaaaacggacaggttaaaaatgtggtggaatggaaaaaaggaaaactggacggcgatgctgttttttattatgataatggaaaaatacagtccaaaggcgaatataaaaaaggatacaaggtaaaagaatggtcctattttgacaaaaatggcgttcttacgtctaaggaagctttcaggaacggagaaaagaatatttatgacaacagccttaccgctactttttattctcctgccggtaaaataactgaaatttcgaattataaattcaataaattacagggagaaagcaaaaccttccatgaagacggaaaatcggtaaaagacattggccagtatgacaacggtcttgctaccggaaaatggaaagtgttctatccatcaggaaaattacagcgtgaaaccgaatttgccaatgataaaagaaacggcacccgggttcattaccgtgaagatggaagtatagaaaagacagaggtctacaaagacggaaaattaatctcaacaaaataatacaattggtacagaaactaaaactggaagaacttaacagaatagatgtagaaacatttaagaaggttgaaaaaattccgttggtcatcattttagataatatcagaagtatgcacaatgtaggtgcagccttcagaacagcagatgcatttttaattgaaaaaataatcctctgtggaattacgccccaaccacctcatcgagagatccataaagcggcgttgggagctacagaaagtgtagactggtctcatgaagcagataccaatactgctgttgccgatctgaaaagcaatggttatgaaatcatcggaattgaacagactacggacagccagatgattacagattttacgattgataaatcgaaaaaatacgccctgattttaggaaatgaagtagagggaatcagtgatgaagttcttcctaatattgatgtatttttagaaattccacaacttggaaccaaacattctcttaacgtaagtgtatgtggcggaattgtaatgtgggaatttgcaaaagctttaaaataaaaaaactgcatatgtccttagtagacagtgcagtttgaaataaatctaataaaaagtaaaaatgaaaggcgacaaaggtactttatttttttttacaaacaaattttgacggcactttttttgttccatcttaaaaaaagtactgttttcagaaaaagtttcatttaattttttataaattagcacaatgtttatcaaggactatatctcaaaagactttccgtgttttagcctgtctgactccatagagtcggccagaaatatattggaagattttggatattcccatgttttcatcaaaaaatcccaccacttctatggtgctattgccatggactttctgtatgaggaagagggaggaacactgaaagatctggaacatcagatagagcgttttgccattctggaagatagtaatattatggacagtattcgtctgttctatacattcagttccaatataattccggtgatcaataaaaatgaaaaatatcttggctatattacctgtgaagatgtttttcaggacctttcccgctatcctctgttttcagagacaggagctattcttactgtagaaactcctgccagaaagtattctatgacggaaatcaccaatattgtagaaagcaacaactcgaagttttacggcgggtttataagctttatgtctgatgaagtggtccagatcaccataaagatcagtaatgaaaaccttgcctcgatagacgctacttttgaccggtacgactacagaattgttgaaaaatactattctgatgagaaatccgatctgtttaaagaccgattcggttttttacaaaaattcatagaaatataacatgaaggcagccatatattctcagaaaaaagatcttgatacttttttatatttaagcaagtttatctctgaacttgaagcaagaggtgtaaaatctgttctgtatgatgaaatggctgaggctcttcagttttcaaaaatattcgaaactttcaactgcaaacaggatcttctggataaagaggtagatctgttcttcactttcggtggtgacggaactattgtaaattctttaaccttcattgaagatcttgaaatcccggtagtaggagtaaatacagggcgtcttggatttttagcctttttcactaaggaacaggtgtttaaagaactggattctatcttaaaaggagatgtaaaaacaagccgacgttcagtaatagaagtggtttcgcccaagcttgaagggtcttttccttatgcgttgaacgatgttaccgtgtccagaaaagaaaccacatccatgatcaccgttgattcttatattaacgatgaatttctgaatgtattctggggcgatggcgtgatcatttcaacgccaacaggctctaccgcatactctctgagctgcggaggaccaattatctctcccaacaatgaaaattttgtcattactccaattgcacctcacaacctgaacgtaaggcctctggttgtaaatgataaggtagaaataaaattcagggtggaaagccgtgtacctcaatactccctttccttagactcccggctgatccatatagaaacagataaagaaatcattatcaaaaaagcaaaattccagcttcttctggtacagcccaacagtttaagtttctacgaaaccatccgtcagaagctactttggggaagagataaaagaaattagcaatttcttaaaaatgattacctttacacgaaattaaaaacacctaataaatttataacaaaaagtaaaacatgagcagaatttttccggcaggagttgccacaggtcagttggttactgatatctttcagtatgctaaagaaaacaaatttgcattacctgcagtaaacgtaattggatcaagcaacgtaaacgctacgatggaaactgcagcgaaattaaacgctcctgtaattattcagttttcaaatggaggagctgcgttcaacgcagggaaaggattaagcaatgacgggcaaaagtctgcaatcttaggagctatcgcgggagcaaaacatattcacacgcttgcagaagcttacggagcaacggtaattttacacacagaccactgtgcaaagaaattacttccctggattgatggtttgatggatgctaacgaagaattcttcaagcagacaggaaaatctctttactcttctcacatgttagacctttctgaagaatctttagaagaaaaccttgagatttcagctaaatatttcgaaagaatggctaagcttcagatgacccttgaggtagaaatcggggttaccggtggtgaagaagacggtgttgacaactcagacgttgataactctaaattatatacacagcctgaagatgtagcttatacttatgaaaaattaaaagctatttctgataacttcacaatcgctgctgctttcggtaacgtacacggagtttacaagccaggaaacgtggttcttactccgaaaattcttgacaattcacagaaatatgttcaggagaaattcggaacggctgctaaaccgatcaactttgtattccacggaggttcaggatctactttagaagagatcagagaagcgatcgattacggagtaatcaaaatgaacattgatactgaccttcagtttgcatacacagaaggaatcagagattatatgatcaacaatattgaatatttaagagctcagatcggaaaccctgaaggagaagaaaaacctaacaaaaaattctatgatccaagagtttgggtaagaaaaggtgaagatacattctctgcaagattggtgaaagcatttgaagatttaaataacgtaaatactttaaaataagaactgtacaattgtatcaatgtaaaagtattcataagaaatagatttacattgatacattttacatttatacattaatacaaacaaaaatggcattcgactggtttaaaagaaaagcaaaaaacattaccacttctactgatgagaaaaaggacgttcccaaaggcctgtggcatcagactccttccggaaaagtagtggaacatgatgaactaaagagaaataactacgtttctcctgaagacggatttcatgtgagaataggaagtgcagaattttttgacatcctttttgacggtggtaaatttaccgaactggatgccaatgttgagagtattgatatcttaaacttcaaagatacaaagccttacaaagaccgtctgaaggaagtaaaagctaaaacaaagcttacagattctatcagaaacgcagtaggaactgtaaaaggaactgaaatggtagtttcctgtatggattttgctttcatcggtggatctttgggttctgtaatgggagaaaagatcagaagagctgtagactactgtatcgcacataagcttccgtatatgattatctgtcagtccggaggagcaagaatgcaggaagccacatattctctgatgcaattggcaaaagttcaggctaaattagctcagctttccgaagcaggacttttatatatcgcttacctttgtgaccctacattcggaggaatcacagcttctttcgctatgactgccgatatcatcatggcagagccgggagcgctgatcggttttgcaggaccaagagtaatccgtgaaacgattggtagagacttaccggaaggattccagacatcagaattcttacaggaaaaaggatttgtagatttcatcgtaaaaagaactgaaattcaggatacggttgccaaaacagttaatttattggctgtaaaagcatagtatctgtaacaaaaacaatacaatctctctctaattagggagagatttttatttatgaggacttttaagatatttttcaatgccatcagaagtatgagttttaaaaagattatgcgtcttttatcactcatccttccccatcctcttttcgctttactaagtttttatgctacagtaaaggcattcaccattgcacagaaaaaattccctgaaacagcctccaataatgggattggaaatgctttcaggcatgctctctggtgctgcttcattatgatgtactgctgtaagatttcctctcctaaaaaagcgcttgatttttgcaaaagaattacagacatgcatgaagagctgttcccaaatgagcatctggaaaccaaaatggatcttcataacaacaaaatcggaatggattatttcatggaacttttaccgggaattcaccgtcagttttttgaaaaaagcttctttgtagatgcattaatcaaaaaaatggatgatgccaaagttcttaaaagcctggatgacaattttgaggggtatcttgtttatctggaagagtaaatcgttttaagttttaaccgccagggagcgcagggaaaatctaaaaacttaacgtatattttttgttcgcaagagcatttcattcagcaatgttccctaacttaaattctctttgcttagtgctaacgcctttgcgaacgaaaaaatcaaacgtcatcattaaaaacctttgcctacattgcgttaacaatatactttaagattagaagccatcattagttctctttaacaccagaataacaaaagactttagttatttttgtggtttaaagtattttcgataagtttaaacaattaaatcaatcagatggttctcagcagaatttggtcggctttcattatcattgccattgccattgccagtataaaatacgtttcatcaggtaattacaaaaccattttcaatgatatggtggtaggaaaaggtggtgatacagtgaagattgcttcccagcctatgaacagcctctcccctgttgtaagagacagcctgatgaaaaaaaatgattttgcagacagcagaatccactataaaacagattctttaaaacagaatgtaaatgtttaccgcgttcaggaatcagacggagtaatcgggacttcagaaaccgcagttaaaatctgccttggccttatcggaattatgaccctgtttatgggattcatgagtattgctgaaaaagcaggaggcatcaaccttttaagccgtctgatacaaccctttttctctaaattatttcctgatatccctaagaatcatcctgcattcgggcacatgctgatgaatttcagcgccaatctattagggttagataatgctgcgactccttttggtttaaaagcaatggaaagtctccagactttaaaccctaataaagatacagctagcaattcacagattatgtttctgtgccttcatgccggtggtatgactttgatcccggtctccattattgcgatcagagcctcgatgggttccaaaacgcctacagatattttcctgccttgtatgattgccacttttgccgctacactggcagcaatgattatcgtttcattatatcagaaaatcaatcttcttcgccctgtagtgattgcctatgtaggaggaatttcagccgttatcgctttattggtgttgtacctggttcaattgagcaaagatgagctggatgatttcagcaaagtattgagcaatggactgattctcttcattttcctggctattgtattgggtgccgtttataaaaaaatcaacgtttttgatgcctttattgaaggggcaaaagaaggttttacaacctgtgttaagattatcccttaccttgtcggaatgctgattgccatttcattattaagaacctccggtgtttttgatgtgattatcgacggaatgaagtgggtagccaacgttgccaatatggatcctagatttgtggatgggcttccaacggctttaatcaaacctttatccggttccggagccagaggaatgatggtagacacaatgacaacatttggagctgatagttttcagggtaaattggcagcagttcttcagggaagctcagatacgacgttttacgtgatcgcagtatatttcggggctgtggctgttaaaaatacaagatatacggtaattgccatgcttctggccgatctggtgggcattatcacttctatcgcactggcttatttatttttcgcataatgaaaaggtgcaggttgaacaaagctattaacttaaaacattaaacttaaaactttacatccattatgattacagataaagaatttacactaagactcatccgccaattaacccaggcgttggaaaaactgattctggacaaacccgaagaaagtttaatgcagaaagagctggattttgatacgctaatgagagatattttcaagatgaatttcaccgaagtttcctcaatgactaaagaagaaatgattgccctggtcaatgagaggcaggaaagagatcataaagattattatgaaatgcttgggaaccttttctactttaaaagcagagaaggccagaataaagattttcaggataaagcaaaaacattctatgagctgtatcttcagaccagcggtatttttgccctgcctgttatcaacagaataaatgaattgaaaaaagcacttgaataaagtgcttttgtatttttagaaagtaattttataagtaccggttgaagaagtattggctttctccgccttcacatacttcttaacccaggctacggatgtagatgacacgcagggatccgaaatacctcctgatcttcttgctgacactacatttcctgctttatctacggtgtaggaaatcgtaatcgatccgcttgctgtacagctgtgagagggctgcgctcctcctcttcccattgttccgggaatataaccgactaatttcctgtcgattccaaccttgctgtcgccatttccgtcaccccctaaaggatctccagcatttccgataccatcacctgttccctggcttccagctttcgttcctcttcctttgatcaggtttcctatggctgctgttccttttccgtccccatttcctgtttttgaattggctgtggcagcgcccgattttttggtatttttagaagcacttgtactggttgcttcttttttctcagctttttttgattcttcttttttagggactgttgtttttgagttattcccagtgattaccttttccttcacttctgttttcttaggttcaggagtaggtaaaggctctggtttcacaacagtttttgtctccggaacaggtgtttctgcagggtcaggtgttacttcttctgtggctgcggcaaggcttcctggctgctcagcaggctcttcgatcccttttccgtttctgttgtctccaaagttcaccagcattgtggtaaccacttcagggtctttatccagttcgggttttaatttatataaaaaaacaaaaagcaggatagcagcccagatcagaatagaaagcagtgcgctttttaccctgtctttattttcttcgtttctgtttgctgtatagcttctcatcttaaaaagtaaatctttccggaaatccggctatgttatttatctttaacggttgcaatcgcaatgttaaatttatgtttttcagcaatttccattacaaaaacaacatctttatgtaatgtgttttcatcagctctgatcgtaaacgatttattggtctgacctgctaatttatctacaataatcttctcaagttctcctttattgacaggattatcatccacaaagaatgaaccgtcaggcttaatactaacagttaaaggattaggaatattatcgtcaactgctccggctttcggcagattcacatcaatagcactctggttggctgctgaagaggtgatcataaagaaaatcagcatcaacaggataacgtctgtcatcgctgctaaactgaattccggattcgctttatttcttctttgaattttcatcgtaagaaaattataaaggtttattgataaggtctaaaaattctccagacatgttctgagccttcagtacaaatttatcaatccttgtcaaaaggatattgtaacagaagttggcaggaattgctactgccaaacctacagcggtttgccctaaagcggtataaataccttctgaaagtgttttcggagagaaagaccccgtggcatgagataaattaaagaaagcaataatcatcccgattaccgtacctaaaagtcccagcattggtgcaatacttggtactacagccaaaaggttcaggtttttttccatattggcaacctctacctgtgcctgtgcttccatggcacttacaatatctgaaactggacgccccaatcttgaaattcccttttctaaaattcttccttccggagaattctgggttttgcagtaatctgttgctgcctctatttttccagctttgatgaagtcctcaatattgttcatgaagtttgaatctgtttttgaagccagtcttttaataaagaaaaatctttcaaaaaacagataaagagaaaacactcccaacagtaatacggtgaccatcactattttagcgaaagctcctccatggaacataattttccagaatgagaactctaagttgtctgcagcaactgcaggtgtagcgatttgtgcaaataaaatctgagaaagttccgttaacagcattaaatgtgaattttattaaagtttcaacgacaaatgtagtagaatattatgaattgaactcttaaaaattgcttaaaaacaacttaaaatttgttacagttctacaaacagcaaatttctttccaaaaataattctgaaaagaaatccggtattaaaaaatgaagttttcggttagtcttcgtctacttcaatatcatcctgcttgaattcgcattttaatctaaaaggaatcggggtatctgaacccgtatagaaatcatcaatagttcctttccagataacctgaagttccccttcttcatttttttcaaaaagaagctcattatcataaatataggcatcttcgtcatcgaatagatctacttctgtataggtctcttcatcagagtcattgatggtgatggtttttccttctatttccgcagagtcgatagggaaatcgaaaatttcaagtgaaagctgcggaaagttgtactgtagtgaatcatcatctacgtgatccaaactgtcatccgtaatcacttcaacctctaaaaagtgttgctggttgctgtaaactgctttacaataagtatttctgatattgtattttagcgtttcttccggatggtaaatttttaaaatccctttcattttttcttaaaaaagaactgtaataatatgattgttaaacgttttagacaaagatagaaaattgattcaaagttgaaaggattttgaaaataattttttaaaatcaatgcataccataagcctgaatatcccaataatacttacttttgttttcataaagattctgaaaatgaaaaacattttatcaaaaggtattctggcactgggattgatgataggtcttgcttcctgcaaaaaatcggactctccccttacaaaagtgaccccaagtaatctggattctattgcttccaactattatgagcaatatcttaagctatatccaatggacgctacagcacagggagatacaagatataatgaccagcttcctattaatattgataaagactttatctcaggagaaatagcattctacacttctgtacagaaacaactggaaaatgtagattataagaccctttctgatgaggataaagtggtatatgatgttttggattacactttaaaagataaaattgaggcttatgcctatcatccggaatatattccgtttacccagtttggcggtcttccgcttacttttcctttatatggaagcggacagggtaaccagccttttaaaacggaaaaagattacagcgactggctgaaaagaatggaaaaattcccggaatggatggatgctgctgcagacaatttccgtgaagggatgactaataaaatggtccttcctaaaaagcttgttgttaaaatgattcctcagatgaaagccgaggaaatcacaacttctgatatggaaaagaatattttctacggcccgatcagaaattttcctaaaaatttctcccaggctcagaaagataaattttcgacactttacaaagaagccattgcgaaaaagattatcccggcctatattaaaatgggaacgttccttgaaaaagaatatcttcccaaagcaagagataccgatggatacaacagtcttcccaacggtaatgaaatttacggctattatgtaaaaagctggaccactaccaaaaaatctcctgaagagatcaataagatcgggttgcagcaggtagctatgcttcgtgcggaaatggaaaaagtaaaacagcaggtagggtttaccggaactctggaagaattcatcacatttgtaaaaacggatccaaaggcgatgccttataagacttccaaggaggttttaaatgcatttaacggcattttaacaaaaatcactccgaagctgaaaacgatgtttaatgtaacgccaaaaacaaagtttgagatcagacagacagagaagttcagagaagcaagtgccagcgcagaatatatgcctggaactccggatggtaaaagaccgggtatattctatgttccgctgccggatccttccaaattcaatgttacttcaggaatggagtctcttttccttcatgaggccatcccagggcatcattatcagatgtctcttcaacaggaaaatacaaagcttcctaaattcatgagattcggatggttcggagcttatggtgaaggatgggcgcactattgtgaaacattaggacctgaattcgggttgtatacagatccttaccagaaaatgggctacttaagcgatcagatgctgagagcggtaagacttgttgtagatacaggacttcataccggaaaaatgtcaagagaagaggcgatcaaatatttcttaagcaacatttcctatgacgaaggatctgctactgcagaagttgaaagatacatggcaatgcctgggcaggctttaggctacaaaataggctctttaagaatccgtgagctgagagaaaaatatcagaaagagcttggaaacaaattcaatctggcaagcttccatgatgaggtattaagtcagggatgtcttcctctggatgttctgaacaggaaaatggagctttgggctcaaaagcaaaaatagtttcaatgaaactatttttatttttttccggtattttattgatgactttgagttgtcaaaaggaactaaattttgaaaattttattattgacacaaacttacctgataatgatactattctacttctctctaaatatccggaactgaagctttacaatagtgaaattgttgaaagtaaatcaagaacagcacatattgttcaggctgctagttattcagatggttttcgtaaaggaatatttctattcgacgattacaaatgcaaagctatcactcaggctgatacgcttaatattaaattgaataattacaatggatattttggcaacgggattttgattaaggtatttaacaatcagttttatataaaagatattgatcctaaaacattaaaaggtgaagaaaaattcaaaaaggtccgtgttttaagtcagaaactgattctaaatagtaacaaattcaataaaaatgacagcatttatggcttcatagattataaatgcagtattgacagcttagtttataagcgctttagaggatattttaaaactataatactataaaaatcaatatgatcacagaaagcctcagatctctttacagcagagatttaaataaattaaaagcagaaatagaagcttatcagaatgaagaaaatctttggaaaactgataaaaacatagccaactctacaggtaatctaacacttcatcttgtcggaaatctcaatcattttctgggaacacaccttggaaacacaggatacgtaagacagcgtgacctggaattttccttaaaagatattccgaaggaggaacttattgaaaaggttacagccactgcaacaatgatagattcagtactttcccaattgtccgatgaagacctgaaaaaagaatatccattggttgtttttgaaaatgcaatgacaactgattactttctgatccatctgcttgcccatcttgactatcacttgggacagatcaattatcacagaaggttattggacatttaatccatccataaaaaactcaaataacgcaacgatcacaaagtaattgttgcgttttctattagttggcaagggcatttcacttagctaagaaaatattgcctttgctcaacgaagtgcccttgcgaaccttttcaatctaaattatcataagtacttgcgatcttagcgttaaaaacaaggcaagttatttctcaaataacattttcgtaataaaatccttttctccttttcctcttgccggagaatattctcttccatagaaaatgatctgaaggtgaagcttattccatacttcttcagggaataatttcttggcgtcacgttctgtctctacaacattttttcctgatgtaagcttccactgtgtcatcagacgatgaatatgggtatctaccggaaaagcaggaaatccaaaaccctggctcatcactaccgaagcggttttatgtcctacgcccggaagagcttccaattcttcataagtctgcggaacgataccattatgacgctccagcagaagttctgccattcttttaaggtttttggctttggtattggacagtcctatttctttaattaattccttgatctcaaactcttccagcttggccattctctgcggagttcctgctacggcaaaaagatcaggagtcacctggtttacttttttatctgtggtctgcgcggaaagcgctacggctaccattaaggtatatggatcggtatgatccagcggaataggcgttgtgggatataatttgtccaattctctctgaacgatctcagctctttgtttttttgtcatgtaacccttaaatttgaacaaaattaaatcattatgctgaaagttggagataaattacctgaatttgaaggaatcaatcaagacggagaaaccgtaacctcatcacaattaattggaaaaaaactggtagttttcttctatccgcaagcgaatacacccacctgtacggtagaagcctgcaatctgagtgacaattattcaaagcttaaaaaagcgggatttcagttattgggagtaagcggtgattctgtaaaaaaacagaaaaatttccatagcaaattcgctttcccttatgatcttattgcggatgaaaaccgtgatatcattgaaaaattcggggtatggcaggagaaaaagacgtttggaaaaacgtatatgggaattgtaagaactacttttatttttgacgaaaatggcgtttgcacaagagtgattgaaaaagtgacgtcaaaaactgctgctgagcagattctggaaggataatttttttgaacacagatatcacaaatattttcacaaatagcacagatacataattgtattatttgtgaaaatatttttatgattgatcttattcggtttcgtaatagttgagctcttcggtttctccgggcagtatgacgtgctttttaaacctcaatcccagcttttcaatgagcttctgtgaagaaatattatccttggaaataatggcggatatttttgttaatccaaagtcatccatcccaatagatttaaccttcttagcggcttcaaaagcatagcctttgccttcaaattcttccaataaagagtatcctatatccacgatatcaagcccctctctttcgaagattcctacggctcctactttttcatttccttctttggtcactaaaagatagtttccaaatcccagtctttcaatctgtggagcaaatctgttcagaatataattttcagcatcttcaatagaattaacattgcggttaccgatgtactgaataaatttaggcctgttgtaaagctcaaagataaaatctttatcttcacgggacattggacgaagaattaatcgctcagtctcataagtattatctgcgcttggatgttttttggggctcatctttctttggttcttcttttttttcgatttttaaaagtctcgggttattagcacatttcttattgtaaagctcaatataggttccattatcttttacattgcttacagtacctgtagatttacttactgttacagtataatgtgttttctgataaggacattcctttgaggttagctttccaagatcaagatagtaattcgactgatcttcatggtaattaccagcaagatccttgaactcttcatctaccatgtatccgtctgcagctaatataattgctgcctcttgggcattatcaattctgtctacaaacttttttagtccgtcggcatcagttacatagtttactttaccgccttctgaataggcaatgtaataaaaactgtcttcgctgggaaaaagattgaatcctgagaactgaggagtataatttaccttacccgaagtctttatttcctctcctttcccatagctgttgtataccagcacccaggaatctaccctgctgcccgggatgatctgctgtaaaatagcaggaatgctcgaaaatttctttttctcctgagcatatgctgagattcccaaaagcaggaatgtaagaattgtaaatcgggttgcagttttaatcataatttaaaaatcaccagaaatataccaaatattacatgaacttctcgcctttcttaaagttttttaaatcaagaacataatctttaataagctggtcattgtctctcgggcagataagaagtgctttatctgtatcaacaacaatgtaattttcaagcccgtcaataattacggctttgttattattctttaagcggatgatattcccttttgaattataagagagtaagtgcttcagctttacagcgtttccgtctttatctttttccgtattttcatatacagatgtccatgtacctaggtcactccaacctaaatctgatggaataacgtatacattttttgctttttccaggatcccgttatcaatagaaattttctgaacttttggataaatggtttcaatacagctgttttctttctctgaattatactcacatgccataaaatgctgcatcatttcaggaagataaagatcaaaggcatggtgaatacttttcacattccatacaaaaattcctgcattccaaaggaaatcaccactttccagaaagctttgggcaatttcaaggataggtttttctgtgaatgtttttaccttaaagtattctgaaccttttttttctacaaactgaatgtaaccatagccagtatcaggtcttgtcggggtaatacccaatgttaccagataatcattttttgatgccagctcgaacgccagctccactttctccaaaaacacatcttctttaaggatcaaatgatccgccggcaatacaatcatcgttgcatccggattgatttcagcaattttattagccatatacaggttgcaggccgctgtattcttcataagcggctcacccacaatattttcttcaggaatttccggaagctgctgatgggaaacagaaacatactctttattcgtaattacgaatatctgttctttaggaattaccttgctgattctgtcataagtctgctgaatcattgtgcgtccggttcctaaaatatcctgaaactgttttggaaatttttgcgtactcatcggccagaaccggctcccgattcctcctgccattatcacgcaatatctatctgaatttaacattcttagctacatttttctaccctcgctaaaggcttgaaagaatacttccttccagtagccaggttcttacaaagatagttttttttaaccagaccttccaataaatacttttcgttgcgatagataaaaaattctccctttttaagttcctcgataaactgaagggtatcatcttgtttttcagtatgaaaatatcttaccagatcggggctggccatgaaatttgctttgggcgattttgaaaattttatgataatgggttttagttcttcatcataaatttcaaggctttccaggagcatatttctgaatgtttccttccactcatttccgtgaggagagattcttctgccgtatttttcgaacgcaataagatgggccagctcatgagtcagcacaaagaaaaaaagttgtggagtaagtgtagagtttaccgtaatttcatgtgaattgtccggaagttttctgtaatctcccagtttcgaattcctgtttcttgtaacttttatatgtatataataatctgaaaaccagatttttaaatatttaagtgtattttgaggtaagtatttttctaaagattgaattggcattttacaaacttaatggaattcctgcatagaaattcaatagtttaagactaaaaaggtaattgtattttgcctgcgctactgatccctgtgcatttgcataattatttctcgccacgtttacgtcatagatggttgttcttccggcagcatagcttttatcggcaaaatcaagagccagtttggagcttttttcagcttctaccgccgccagataggtttcataattggcatcagcatcaaactgagctttctgtacattctgtcttactgtctgcttctgctgctccaacgcatttttggctatactttcgtttattttagattgttctacctgtaattttgtttttcctttattaaagattggaatattaagcgacaaccccacattttgtccgaactgatctttatattgttcaaaaaaagttccctgtattgtacctgggataggatcaaattgtctgttatagaaagtattaagaccggcgctggctgttaatgtaggccagaatgctgttttggttacctcagtttgtgcctcggcagatcttattctgctttctgctgctttaatctgaggttgtatctcatatgctgttgtaagtacttcatccacggaattaagctgtaaatcaagcttatccggaacatttacatcttccacatcaaaacccttataatctgacagttgtaaaagctgaacgatagcaaacaaggcacgtccaacgtttacttctgctgttttaagattttgcttttctctagccagcgctgcttcagcctctgctaaaaccgtctgtgcagtggttccaacctgagttgtgattttagctctgtcaaactgtttctgagcattgtccacagcactctgagagattttaacgatctctttattcagcaaggcggtcagatattgttgagcaatctgaagggaaatatcatttttaatggtttcaatatcatactgacttgcttctacatcaaactgggcttttctgatattcttctctaatcttccgttattatagagcaaaatatcggcacccagaccaacactgttattgaatctatcgtttctaaaacttccggcacctaaggatccttgtccgaaactcaccccattcgtcatacttgccgatacagaaggcaaatattctttttgggcagctttaagattatattcctgattttgtttgttatactgattttggataacctgaagattatgctccactgcatagcttacacattcttttaaggaccatttcttctgagcgcttacccccagataacctaatccaaaaacgatgatccaaacttttttcatatgtatatgtttatttgttttttaatggcatatgcaatcgtgtcatgttcattcagtactgtaacctataaatcacagcgatttcatattaagatttttcaatattagacgaattaaatataaaaaagttacagattgaaaaattatattttattttaaaaaaacttttgggaattttgcaccatgacaaatgaacaatatcaggaagctatcgactggcttttcgtacagatgcccaactatcagatagatgggcagaaggcttataaacccggacttgataatattacaaagctttgtgctttctttggaaatcctcaggagaaaataaagtgtattcatatcggaggcactaatggtaagggttcttcaagcaatatgctggcatctgtccttcaggaagccggttacaaaacaggattatacaattctccccacctgatcgattttacagagcgtattaaagtcaacggaaaaaattgtgataaagaatttgtctttgattttattcagaaactaaaacaacttcctgaagatattcgtccttctttttttgagttcactactatcatggcttttgaatatttttacaggcagcaggtagattttgccattattgaagtcggattgggaggaagactggattctaccaatattattacccccttgatttcggctattaccaatgtacagctggatcatcagaatatcctcggagataccattgaagaaattgcaatggagaaagccgggattatcaaacataatattcccattatttcaggagacgagaatgaaactgttcaaaatatcatcaaagagaaagcagcgaaggaaagtgccccattgatagatgctactcttataaatacagatctggaatctgacctgaaaggagattatcagaaaaaaaacatcagagtagtgatagccgctgtagaagaattaagaaaacttggagtacatatttctgatgaagatcttgaaaatggtctactgaatgttcatcagaatacaggatttatcggccgctggtttgagttctcaaaacacccgcttaccatttgcgacacaggtcacaatcaggcaggtctggagtatgttttttcacaattaaattcgattgaccgtcacaagcatgtcattttggggtttgtaaatgacaaaaaaatagatgacgtgatgaaattacttcctgaaaattctgaattctatttcgcaaaaccatccatcaacaggggaagacaccccgaagattatgaaaacctgcttcaggaggcgaaaattttttataaaatttttgattctgtacaggaggcgtatctgtctgcaaaagaacgatgtacaaatgaagaaatgatttttatcggcggaagtaactttgtagtgggagattttttagaaaaaaatttggagattaaagaataagtcgtatatttgcaccactctaaacaagagaacaagtctagagggttcttagctcagttggttcagagcatctggtttacacccagagggtcgggggttcgaatccctcaggacccacagaaaaggaaacgaaacctttcaaaaaaattcgggttcttagctcagttggttcagagcatctggtttacacccagagggtcgggggttcgaatccctcaggacccacaaaaaatctctcagatttctgggagatttttttatttttaacctgattaaaccttcctttctacttttcctgatatttatttacctttgtctgcatcggattaattaaacgtgaaggaactccatattatatcattcaattatccctaccctccttcttatggtggaatcattgatgtatattataaaatcaaggctttatctgatctgggaataaaaatccacctgcactgttttacagaccaggttccttcaataattgatacagaaattaaagatattacggaaaatgtatttttttaccggaagaaaaagaatcctttgctttatttctcgccagttccttttgctgcagccataagaaactctgatatccttcttaaaaatttagaaaagaataaagctccgatcttgttcgaaggcttgcagacaacgcatattataaggtttttgagagatagtgaacacaaactctatctccgttatcataacaatgaatctgagtattataaaggcctctcattatctgaaaaaaacatttttaaaaagatcatttataaaattgagtccttaaagtattacggatatcagaaaaaacttttaaagcaatttgaaaccgtattctgtctttcggagaaagaatatcaggaagtaaaagcctgttcggagaatgcgcagcttgttcacatttttcacggtaatacatcagtaaaggtattggatacaaaaggaaagtattttctttttcacggcgatcttactaccgctgataataaaagagcattgaatgagaccattgacttatttaaaacgctgcctcaatataaactgattgtagcctcagatcgtgccactgaagatattaaaagaaaaatttcggcagttgggaatatcactctcactcctatccaaacgacagagaatctccaccagcttctggaaaatgctcatgccaacattctgatttcttaccagaactcaggaactaaagtaaagcttttcaatacactttacaacagtcgttttgtcattatatctgaaaacattacagatgatcctgttttgaagagtttatgtttttttggatccgatatgaaggaaatccgccagcagattatcacctcagcagaaaaagagtatcatgataccgaaaatagaaagaaaacattagaaagaacccactccgatatagctaaagccgaagcgatggtgaagattatttttaaaaattaaccctatccacgaccttctggatattaaactcctcaagacaagcccaatctcccctgtaacattccttatctccaaatacagaacatggcctgcagctaagatctttcacctgaacaacatcttcttcactctgcccgaaccctaaaaatccggcataaggatgagtggctccccagatagaaacacatctcgttcctacaagactcgcaagatgcatattcgcggaatccatagaaatcataagctcaagttgagaaatctgatgaagttcttcagtaagatttaattttccggagagatttttggtatttgggatctcactttcccatttttcaagagtttctgtttcttttttaccacctccaaagaaatacacagtatgttttctagcgagaatcctggccagctcatatgatttttccagaggaagcattttccctttatgctgggcaaaaggtgcaaaaccgatccctgatttattcattgaaacaggtctgagttgatgtgaaagctctactttgaatcccatatctcgaaaaacatccgcataacgttccaccgtttttttcagctgtaccttttccagattccagacatccgtaagatgctctttctcttccttacctttatcaattttgaagaccttaaatccttttctcctgtatattctgtctaaaaccttggtccggattacatcatgaaggttagcaatacagtccggattaaactcacggatcagttcattactgagttttctcaatccaaaaaaacctttgtaatcatccagatcaattcctttaaaagttacattaggaattcctgcaaacaaagcctcaaaatttttcctggaaaccataataatttccacacctggattctgctccagaaattctctgaaaacaggcacagtcattgccacatctccgaatgcggaaaaacgatatgctaaaattctggtcaccgttatgatttcagttggtaagcaactgcataaaacttaatctgcttcgtcatcgccatcagtccgttggctctggaaggagaaagaaattcctgtaatcctatttctgcaataaaatcaaaatcagaatccaggatttcctgagtggaatgcccactgtaaatgcttactaaaagcgaaacaattccttttggtaaaataccatcagaatctgcattaaagaaaagtttcccatctttgaattcggcatcaatccaaactttgctctgacagcccttaatcaggttttcctccgtttttctgtcttccggtaagcctttcagttcttttccaagatcaatgatgtactcatacttttgctcccagtcttcaagaaaagcgaattcgtcgattatttcctgctgtttttctttaatggtcattttaaatcaatttcttgtgcaaagataaccaattttgtaaaatttattgccgggatgctttttcaaaaagctgcaggatttttgcctcttcattctcccagcaaaagacgtctgcggccttattcagctcactctgataatgtagtcttcctctctgaaggactagatttatcgctttttcaatggtctcaggctggtgatcaggaacaatttctcctacatcaaactgattttttatcctttgcatctccgggaaattaatcatcacaagcggtactctcgactggatataatcacaaaccttattgggaagtgaataatagtagcttactccgttattctcttcgaggctaaaccccacatcagcagttttggttatctctctgagattttccggcttcagtttgccaagaaaaaatactttatcctgaagtttttccctgatgacaagttcttcataatctttctttttcggaccatcacccgctattttcagaacagcatctttaatgtgatgcatcgccacaatcattttttctattcctctggattgattaatcgctccctggtacaaaataattttaggatgattttcagaaatttcaggagcagaaagaatttttctcgggatatttcttaccactaccggattgacattatattgttcgtgaaaccattcagcatagctttcactttctgtcatcataagattcatgtgaggaaccagctttctttcaagtactctccagaatttctgcgaaaaccggttctgaaccgatggcatttccgtgaaaatttcatgactgtcaaagactaaaggaatattcatttttctggaaatgagataatttggcagaagtgcatcaatgtcattggcatgaagaatagtatctttgtccgcttttttcttcagttctttatataatttccagttgaattcaaaataagcagtcttcagacttttagatttcagagcaatccttgaaaatggatatggacgctccattttttcattcccttgccagtcattccctatcagatctatggaatatccgttatcaaaaagggttttgcacaccttttcgatcctctggtccgtatacagattactaaaagccgaagtaattatttttttcctcatgaactcttcttacctagtattaaatgatagatctgaatgaagcagattaatccgtttggaatgataaccggccagagcggtccgctgaagaagccataaatgacaaaacaaatgcagccaatcatattgacaattctgatttttcttacatctttcagtatgaaactcaatacgataaaaagagaagcagaatagccgatgtaagtcgtaagttcaggattcatggggaaaatttaaggatacaaacttaatcattttcaataagataataaatttttttctgccataaagtcattaattgatttttggtaaaatatttgtaatttagataatgaataaaaggtaatgttgcctttgttctaatgagatatattatggattataagttttcacaaggtttgagccaggtgttcaaacaaagcaaaagcgaagctaaaaggctgaaaagtgaatttcttaatacagaacatctacttttaggtattataaaaacggaaaactctgcaaaagaaatccttcaaaaccttaatgcggatttaacacaaatcagaagaaaaattgaaactttaaatacagcaagtcttaatcctatttctgaagaggttaccaatatttctttcaccaagatggcagatcatgctattaaacgtgcagagttagaatgccgacaatataaaagcaatgaaattaataccgttcacctgcttttaggtattctatataaatatgaggaccctacttcaaatattctgggagcttatgacatcgactatgagggagtttcaagagagtaccagactatgcttaaaaattcaggtcaatctccacagatgagcgcttacgatgatgatgacgagagagaagaatttgagcaaatgagaaagcctacaggaaatctaggttctgcaaaaagtaaaacacctacattggataactttggtagagaccttacttctttggcaagagacggaaagctggacccagtgatcgggcgtgagaaagaaattgagagagtttctcagatcttatcccgcagaaagaaaaacaaccctcttcttatcggagagccgggggttggtaaatctgctatcgctgaagggttggcattaagaattcaacagaaaaaagtgtccagagttctttacggaaaacgtgtgatcactttggatctggcaagtttggttgccggaactaaataccgtggtcagtttgaggaaagaatgaaggcgattatgacggaactggaaaaaaacagagatgtcatcttatttattgatgagcttcacaccattgtgggagctggaagttctaccggaagtttagatgcttccaatatgttcaagcctgctttggcaagaggtgaaattcaatgcatcggggcaaccactctggatgaataccgtcagtatattgaaaaagacggagctctggaaagaagattccagaaagtaatggtggaacctacttccattgatgaaaccattcagattctgaaccagatcaaagataaatatgaagagcatcataatgtaatttacactccggaagccattgctgcgtgtgtcaatctgacatcgagatatattacggaccgtttcttaccggataaagcgattgatgcgatggacgaagcaggatcccgtgtttatatcaaaaacatgaaagttcctactgaaatcattgattttgaaaagaaaatcgaagagatcaaagaactgaagcagaaagcggtaaaagctcaggattacctggaagcaagaaagctgaaagatgaagaagaacgtcttcagatggaactcaattctgctcaggaaaaatgggacaaagatgtaaaagagaaaaaagaaaccgtaacggaagaaaatgtagcagaagtggtttctatgatgagtggagttcctgtaacaaaagttggtaagaacgagcttgacaaattagcacagatggatgataaactgaacggtaaagtaatcgggcaggaagacgctgtgaaaaaggttgtaaaagcaatccagagaaacagagccgggcttaaagatccgaaccgtcctatcggtacctttattttccttggtacaaccggggttggtaagaccgagctggctaaagtaatggcaagagaattatttgattctgatgaagccttgatcagaattgacatgagtgaatacatggaaaaattcgcggtgtcaagactggtaggtgctcctccgggatatgtaggatacgaagaaggcggccagttaaccgaggctgtcagaagaaaaccttatgctgtagttcttttggatgagattgaaaaagctcacccggatgtattcaatatcctgttacagatccttgatgaaggtcacgttacagatagtttaggaagaaaaatcgatttcagaaatacgattatcatccttacatccaatatcggaaccagagatcttaaagatttcggagatggtgtaggattcggaacatctgctaaaaagtcaacttcagatacaagagcgagaagcaccattgaaaatgcccttaaaaaggcgtttgctcctgagttcttaaacagaattgatgatatcattatcttcaactctcttgtacaggatgacatcaagaaaatcattgatattgaactgaacaaattgtacggcagacttgaaaaattaggatataaagtagagcttacagacgaagcgaaagactttatttctgaaaaaggttgggataaggatttcggtgcaagaccattgaaacgtgcgatccagaaatatattgaagacttattggcagaaatgctggtaaacaagcaattatctgaaggagaaaccgtagttcttgaccttaacgaggctaaagacggactgattggaaagacgcagaaagcaaagaaatcagccgctgagaaatcttctcagtcttaatgaaaaataaataatttaattcaatagaaaagcatcgggaatattttccgatgctttttgtttttatcagttttggctaaagccaatggtattttgaatattgtactgaacgggctgaagcccgtccctattgatgcatcaggttttaaagccccaccacaaaaccgatagtcggaaccaggccacttgaaaacacactggaattctgcttccagagcacattatacattaatcccagctgcataaaagaattatttccgatccgctgcatatatcctccacccagatataatgcattttcttccgtattatatttgtaatcgtaatatttgtcattataatcaatgaaataatgttgatagttggctcctaggtaaaatgatctcgcaaaataataattgacaaaaggacctaccccgaacattgttgatttataataatcggaagtctgccaggaaacggttcccactactcctccttccagatcatcagtgagcctgtaacctactctgggtgaagcagaaaggttaaaagcactgttgcttccaaatcctaccccgatgcctcctccgaaggtccatttgctgttttcctgtaccggtgcacctacagaaacctgggaaaatactgatcctgaacctatcagcatcacagaaataataaactttttcatatttagatatatattttgtttgatgatattttattcatccggcatacattataagccggttagataataattctgattactatcgtttttatcaatgtttaaaattatggtttttttacgactttattagttgtatttttgccgcatcaaactaagaactcccgttaagagtttcgtaaaattgaaatacaatgaaaatagtagtaggcctctccggaggtgtagattctagtgttacagcttatttgctgcagcagcagggccatgaagtagtggctttattcatgagaaactggaacgatgcttccgtaacattagaagatgaatgtccctggattgaggacagtaatgatgccctgatggtggcacaaaagcttggaattcctttccaggtgatagacatgagtgaactttacaaagaacgtatcgttgattatatgtttgccgagtacgaaaaaggcagaactcccaaccctgatgtattgtgtaacagagaagtaaaattcgatgtttttatgaagaccgcaatgtctttgggtgcagataaggttgcaacaggacattacgcaagggtaacttccacttttgatgaaaacggtaaagaaatttttcatcttcttgcagggaaagacaataataaggatcagtcttatttcctttgccagctgagccaggatcagctttcaaaagcactcttccctatcggagagcttacaaagccacaggtaagagaaattgcgaaagaaatagggctggtaacagcagataaaaaagattctcagggattatgctttattggaaaagtaagtcttccacagtttttgcagcagcaattgaaacctaatgaaggcgaaattgtagaaattttcaaagattctcctcttttttcagaagaaaaacctgaattttcctctaaagaagaagagctggaatatttatcgagaaaaatcaattataaaaaatccgacggaaaagttatcggaaaacatcagggagcccagtttttcacgatcggacaaagcaaggggcttggcataggcggacacaaagaaagctgttttatcatctccagagacatggaaaacaatatccttttcgtaggagaaggaagccatttcccgggccttcataaaaaagcattgaaaattgataattcagagctgcactgggtacgtgaggatatgaaacttcagaatggagaatctatgaaagtaatggccagattccgctacagacagcctttgcagaaagcaactttataccagtttgaaaatgccttttacattgagtttgatgaactccagtctgctattgcagaaggtcagtttgcatcatggtacattgatgaagagcttatcggcagcggggtgatttcatgagggtttttgagtttcgggggcgcaagttccttaatgaagaggttttaagtattttaaaagaaaatgatttttaaaatttttctgtaacgttttttaagttatcgtacttactcagtaaataacaataaaaaatactactatgaaaacatcttcaaaaaatcagtatgcttatgcaaacaatatcctgattactcttgtatctgcggtttttggttataatctttatcaggccattgtacatccggaaaaatcaaacatcatactggccttaatgctggtaattctgacttccgttatggtcaggaaatatggacaccaaccgaccaatgaaaagaaagatatttaatatcaaccctacataataaagcccggaacattagtttcgggtttgtttttataaatttttatttaatctttttattaaaatgaattaacataaaaaccaatgtaacaatgcattctgctattaaaatcataaccagaaatcctacaggtttttccaatacaattcctcttatcagctttatgattaaagccgttaaaataaaatgtcacttctgaaatcttttctctaaaagaattgagtataaaagtcgagatatagaaaccaagaatcagtaaaatgtagaacttcaggaaatcgggtcctttaagcgcgacaggattaaatgtctgataggttgtccaaagccatatgaggctgatcgcaacaggaactgagtgtatgatgatctttttcataatcattagttttatccgccacagcctccacatccaccgcagcctcctccacatccacctcctccgctgcagcttgatccgccacagcttcctccatcattatctgccttcttttttccatcggggtctgatgcttcatgatctccaatggcagatacaaccactcccaaaatgaaaataactgcaaatacaactcctgttatgagcaagcctgtaaatccattgccttcagtacatgagaacagcatcaataaaatgaaagccggagcaaaggaagtaatcttttttacccaggtctgcactttagatttcttctccggcattttccagatttcttcgggagcttcctgctgaaatactttcctgtaggctgccaaggtatcttcaaaccaatttttatgtttttctctttctgcaattcctccgttggatgggtgatgatgaagtggttttttcagaatattccggcaaaattcttcccaatagttcttggtatagatcagatgcatatgccataccttatctacaattttactgggagaagccccgttgggaagaatacaacagaggtaaacaaactttttatattcttctattgcctttcttacaaaaccagggctccagttttcctcttttgccagcttttttgaaaagggaaaatcaacgccgggagcatccagagaaaactcctgtattcgtttccaaagagattcgtcttttactatcatttttgtttccattgttttactatttgttttctattcaaatatcaatggattacaaaatataaaagtctttcataaatcttttttggtttgataaaaatcttaaattagtcttataaaattaaccaatgaaaaaggaagatattctgcatctcgaaaagcttatgaatttcctaagcaggcagtttttaaagaaaaaccattgggaagatgttaccaaaactgaatggtcttatataagtgctgagctgaacgatctgattgtaagtgatcattctgaaaagaagataaaaaaagaacctgatcttctgggaacaaattatctgtatgagcatctgattatcaataagctgaaaaaattcagacagaatgaaaatgctgttctgagcagaccaaatcttgccaaactcagccttatcgtcaaagtgctgggttattctaattatatagatttcattaattctaatacggaatcattcaattttaatgacctgagaattgaaatgaacaatgtcaatctgaatacagcactattagaccgtttggtgggctgctggtattcttataaccgaaatctgcctgataatcctttgatggcgaaagaagaccgtatatggcgttctgcgatggaaatttataagtctgaaactacgggagaatattttattgagagaagcggcggtgatcaccataaatattttggaaaagtgaccgcctactcagattatgttttcatcatcatgaacagcaatacttttatccgccagaggcattttatttcaaggataaaagatattaaagagaaacttaaaaacccggactataaactccacgaaatccactttataagcacttgtataagcttcaaccaggagccgattgcattatttgaaattttcagaaaagcagacaggaaaaattttatttccgactccatcagttttccgattgatagtgatgagattccggaatctattgtaaaacaacttgaagatacagaatccaacaggattgattacagatagttaagacatacagatctaccaaatggtgctatatgttggcttacattatatttctcttatgcctggaatacatttaatcattcaaaaccaacagattgctgcaataattctttaacttgatagttcataaattacgaacccctcaatggcaccgttatggaatattgtgaattgtatgaagtattgaagagtcattttgattcaggaaaaagcacgattgaaataaaggagctgaatgtaaccattgaatcagttccttttgagtctaaagtttctgaccttctgtacggttcggaacatcagcattgcaataaacatcagcagtctctggaaatcaatgaaaaaggatatcttctttatcatcatcctacggtagacatcaaagattttgagattgaatgcaacaaaaggtttgaatattacattctgaagagcgcagatattgaaaaagctgatggatgcatttttttctttcatggcctgaatgagaagaaatgggacaagtatcttccgtgggcttatgaactggctcaaaggacgaaaaaagccattatacttttccctatcgcttttcatatgaaccgtgcagagcctatctggagcgatcgccatcacatgatggaagtagtacgtttcaggaagaaaaagtatcctgaaaatatgaattattcttatgtaaatgctgccataagttcccgcctggaggctcatcctcaaaggatgttctggtccggccttcaaacctattctgatattaccgaagtggtaaaagatatcaaaaacggtcacttaaaaagtatttcccgggatgcaaaattagatttattcgggtattctataggatctttcctttccatgatcatcaaaatggctgatcctgatcattacttttcagaatcgaaagttttctgcttttgcggtggaatgacgatcgaccggatgtttcccatatccaaatacattatggatacccaggcaaccgtcaaaatgcagtctgtttttacggagcttctaagctcggattttaaatcagattccaggcttaaacattatcagaccgaggcattacatccacaggaaagctggtttaaaaagatgctacgttataattattttcagaaagaaagggaagaaagaattcaggaaatccaggcacaaatcaaagcttatgtactggagaaagatagtgttgctcctccaatggaagccctaaatacgctgcagggaggttacaggaatatcaatgttgatattgaaatcaaagattttccgtacgaatattcccatatggttccttttcctcttagccataagcacaagaaggaagttacagatgcctttcaccattttataaaatctgccagcgatttctatggcagttgatcattctctttttttagggataaaaaatagaaagaaacagtttaaaaatcaataatacaagatccatggtgtttgttttttatgttaatttttatcagctgaccagccaatccttgaagtctttcacccggtctctgctaactgtaatttcatcttccggctgaaaatccagatccactttataatatggtgaagtgtgaatgtttttgatataatccgaactgataataaactgcctgttgacacggaaaaactttttttcatccagtacgtcttccagctcatcaagtgtaaaatctgatggataagtacggtcttccgtctgaaggtaaacgattttgttctcactgaaaaaacagcttatttcgtgagtctgtataattttaaggttataacctattttaaccagaactctggaaagcgttgatttttccttcctgatcagctgtttgatatcctgagaagcattggtatcactggcaggaatgaatgatttgaacttctctacagcgccctcaagatcttcatcaaggatgggctttaatagataatcaatgctgttcagtttaaatgctttcagcgtgtactggtcaaaagctgtcgtataaatgatgaaacctttggtaggtaccttttcaaagatatcaaaagagagaccgtctcctaaaacaatatcggagaaaatcagctggggatgttcgttttcagaaaaccaggcaactccttcttctactgattctattttagcaactatttcaatttcaggaaagttacccagcattctttctaatttccttgaagccggtttttcgtcttctataatgacagttttgatcattgagctttacttttggttttcagattttgggaaataaaggtagataaaagcgcagatattttaatagcctatcggctttttctcttttctgagttctttttcaatcatttccctttcccattcggaatcaaaaagaaacagctttaaggcttttacaagaaggataagtccccatattccaagtatggcatatctgtcgaataattggattctgatcgttttttcatcaaaaatatcgtctggagcaataaggaccgcaacgaccgcaaatataaaaatgcttctgtagaattttttaatgttttgagttcttgtgtacgcagtttgataatccatgattgtataatttttttagttattataggttaaaatgtttttatttttggcttttcttctttatccatcagttcttttattttcctttcttcccattctttaccaattccatatacgttaacggcatgaaatgcaagtccgattccccagcccaatgcaggccataaaaaccataaatatcctggagcggtaagaatattcagtacagctaaaaagggaattacaagacagtaagaagtaagatttccataaaactctttcaattcttttactcttcttgttgcttttctgtaagcaattgtttctttatcaggtaaaatttccataatgttttgttttaaaggttaatttgtttttttcttaagtcaaaggtagttcagaaaaaagcctcccatcaattttatattaccgaacggtagaaaatgatacctgaatggtaagaacttcaacttaatagataaaagggatcagctttttagtactttttctgtaagcgatatattcttctccaaactgctccaccaaagcctgctcttcaattttaatcctgtaggcaaaagctaaaaaaggaggtacaaaagcaaagagtaatgaaagccagttattgagatacaagccaagtccaagtgatgttagcagggaaaaagcataggaaggatgcctcacatatttataaaaaccctcttttttgattttatgatcctgtctgatggtaacatccaccgtaaagtattttcccaaagacctgataataatgtacctgaaaataatcccggcaagaatgaaaaactcaccaaggtaaagaatccagttatctttaatgatcggcaaacgggtattataggataggattactgaactcatgatggaaaagggaatggccagccataagatattaagagtagatctgtccttatcttttttatcttctttaccggatttcagcatatttttatacaatatctctgtaagaaaccaggctgccattgaaatataaaatagaatggataaagtattcatttccgttaggtttttaaggttaattttcaaatgaatcacatagtgttctgtttttttaatgatcctttttcttatcaattatttcacggaatttatcttcctcccacttttttacagcaccgatttttggcaagaaaacggaaagtgcatgaaccagaagtccgattccccaaaaaatggcagtgaagaaatttttaaactgaaaataactttcacccggttccagatgtgaaatattataaaaggcaataatgatgtttactgccacataaacgaataaatgtccataaaacccggtaagttgttccacctgcttttttgcctgctgatagtgaatatcattttcatcaaatttttccattgcttctgttcttttgttgattcataatttctctgatcttcttttcctgccaggactccccgattccgaaaatcttgaaagctctgaaagccaaaaccattccccacactaatgccggataccaaaaccaatactcccctttacttgtaaaaagattgacaaagaataaaaaaggaataataatacagtacgtaatcagactggaataaaactttttcatttccctaaccctcttttgagcccttttataagcagcagcttcttcttcaggttcttcattggaaacttgtggcttaactaaaagcatcggaagctttactttaaaatgatcctcagacttttctataaagacattccgttctgtaagcagagaataacgctgtacaatattggcaagaccaatcccggaactttctttgatctgctctcttacctgcagattgttttcaatgcaaagagtatttccatctgaaaaaattctgatagtaagtggttttgatgatgtcgcaaaattatgtttgatacagttttccagcagcagctgtagagaaagcggaaccacatatttctgataatcttccctgggaacatcaaaactaaaatccacactgtcttcaaatctggtttttaaaagttcacaataggtttttgcaaactctatttcatcttctaccgtcaccatctctttatctttctgttcaagtacataccggtaaatctttgacattgaagcagtaaatttctgtgcctgtcgtggattttcatcaatcagggaacttaaaacattcaatgaattaaaaagaaaatgaggatccagctgattctttaaactctcaaactgtgcattggcagatttggcaataagcttctgttccaccacttcttttctggaagtcttcttcagctcctccataaaactttttgcatgcagaaaagcagagatcagcaaagcaatattgatcataaaccaattggtaactccatattttgatgagaaaaactcttctgcagtggctgttttctgaatgacaacatagttcatataattacagaaatagaccagaataaagtttccgatgataatagaaacaatacttaagacagcccttgtgcgggtagcttccgaccagggaaattttttattgagaaattcattgataaatccgtttccaaatcccaggacaaaagaatacattgttgataggagcagcgtaatcaaaaaggtccggaatgtcttttcatcattaaaaaataaaaagaaaaacaatgtggttcctaacgaagtccaaagtaatgtggtaaggtatttacgcttcatgatctgttttcttgactcaaaattagtttttattaaaggtatcaaaaattaattcttaccgaagggctgattttcttttctgaatggtataaaaaaaccttcacgaatgaaggttgattttttacgtaaaaaaaagaaaactattttgctttttctgcaggcagactcaggaaataatctgcttcagcttttccccagttaggatctaaagctgttttgggtttgtaggctttaaattttgcctgagcatctttaaacatttccaatcctttcgttttgcttcccccgtactgttcaggagtaaaataagtatcttctgccttgatcagcgcaattctcggattggaaggatctaatttttctgcaacattaagctcttcagcagctcttgctccgtctgtcatataacgctgtgcaggatttaccatcattctcagggaataagacatttttctcagcagatgaatttctgcattatcagttccggcaagattctgagccattgaaaggtgtttctccgcctgatcagcgataacatcaagctcctgcattttaccctctctcatcaggactcttcctttctgaattaaagaaaaagctgcatagtatgccggaagccatttcgtgctttctttgcttcctattctctggaagtcgttagacagagcctggaaatcttccggtgttttacaggtttcaattctggcgattttgtcagacattattttgtcataatctgcctgtgcaaaagcagttaagctcataaaagctaaagcaaagcttaaaaggtattttttcatgattcaaattttaaaagttagtgatgtttgtgggttctaagttatgtttttataaattattattgatagcatcgtccgttttgtctactccgaagcttatgaatgctcctatgaatacaaaagtattgaccggcggcacaattgcagagcttctggagccatttgctgaaaagttatagccatatacattttttgatcctaaaatattactgatactcagtacaaatacaggaaaagatttcgcatcctttttaccaatattcggaagataattgatactgaaattcaatgcgttgtaatcttttaatctgccttcatttcggataaaatttacggcttctccatttttaaatgtagaggcaatatcgtaataaggacgacctttcgcataagtataagacaggtttacccctaatttccattccggaataaatctttttgccactgctgaaagtgtatgttctgcggcaaaacctggctgcaggctcacaggataattcaggaaatctctttttgaatccagatacgagtaactgatccagtaatcaatattttcaaatgttttcttattatctctccagaaaaactccagtccttttgcatatccgtatccattattgttcaatgcagtctggatctgctgattctgctctttatcctgggtaatattgaaggttttgatcaactgatcatattttttgtaaaacgcttcaaatcgtaatgttctgccttctgatgctctctggacctgaaagatataatgctgagatttctggaaaccaagatttgcagggccattgatgtatttactttccggattctgataaaaaagtccgtaagctaacgaagtggtccaatcttttgccagacggtatgcaattgcaaaacgtggtgcaatattgctttttcctaaaaatgatgaatgttctgttcttactccaattttcgctgacaaagcattgctgaaaccaagatctgtttcaacaaatgctgatgagatcaaatctttataatgcttatttacggcttcaaaattcagattttcatcggtattattaagctcaaaacctcccctcaccgcactgattctgttgatttttctttcaagaactgctttaaaattcaggtaatttccatcagtcagaagctggctcctgttggactcgatatcattggtttctgtagaaaaatgaagatccgatctgttataagagtaagaaccacctacattcagcagatattttccaaatttttgtttaaaagacagattatgaaaagtgtttttgccattaagctttaccaggctgaaatcggatccgggttcaagactttccgactttacacccattctattggaattgaacattccgtaatatttaaaaaatcctcctgactttgttttaaatctgaaattcaggtctccgttaaaaccttgtggcgcttcaacaaaatctgtattaaaattaaaaactttctgcataaggcttaaaagggaataccctgctgtagctccgtaggaatagtttttattatctgataacttctgaaatccggcattcaggaaaataggtgaaatcccaacattataagaagtttcatccggaagatctacactttccagcatcaatgctcctgaaagggcttggccatacagcgcagaatagccaccacttgaaaatatatttcctttaaaaagagaggtattgaactgatctcttcctgcaattcccggaaccgagttggaaaaataattgttgataagacttccgtccataaaaattttagactccgttcctgtacctcctctgatgaaaagaccttccgttcctcccactttttgtaccccgggaagataagtcaatgctgaagaaatctgtccatccgcccctgctgtggtataaatatcaatgggagtaagcaatgctgttgctcttttcttatcgctggcttcaatagatccggcagaaacgacaactgcatcaatttcgctgatctgttctttaaggtctacattcaaagagacatcctgattttcaatagagactggtctttctacattttcatatttcggatgggtaaaagtaatgatatgagctcctttttctgaagtttcaaatgtaaaattaccttgtgcatcagtggttgtaccgtcgtaagtgtctttaagtgttacatttacttcggcgatccctttgtttttgaaggaaactttccccgatattttcacctgagaatatcccatgatggaagcgatcaggaaaaaaagaaccagtatgttttgtccttgtgttttcatttttattgttttctggatcaaaaatagcacagtaaatgccttcctgtaaaaaaattgttaccgaaaggcattcttttgctaccgaatggtaattaatgaaccgggatacaaaaatccacaatcatttttccttccggatgttctttaaagtttgagtgataaatttcgtaaggaaaggttctcctgaacatataattatgctcattcatccataaaaacaaagagacccagcattgctcaaagtcatccaaagtaacttcaccgcttcctacaatgtattttccggcttgtagagtttccgcaaaaacttctccttcctgctgctttaatttttcatccagaagcatacaggcgtgaatcctgactttatcaagaggtgttattttgcagctgtcatgataaacggaaatcattttcacattctcttcaggaaaaagattcttctttaccgcccagtctgctaatacattgaaagaaggttctacattggctattccaaggctcattacagatgccaggtgcatttccggcatttcttttacttcgatttttaaattcattttcgtccagtttaacaggttttcaatgttgcaaatgtattggctgaaaaccgtatcaacttgtccgttcttgctctgcttctgtaaaatcctgtgaaatttttccggtgccgacctcctgaattccgtaggtgctaatccgtaatattttttgaatgttttgcagaaagcagaatggctggaaaatccgagatcccagtagatatcccttatttccatagttttatacaaggcaagatagagagcactcttttctgttttcttcctgatgatatagttctgaagagtttctcctgtaaccagcttaaatattctatgaaaatgaaacggagaataggcacttacctctgaaactttctccagagacaaatctgcatcaagatggttatcaatatattgaagtgtttttacaatccgctttttatattcttccaattcaaaggtatatgtgcacaaagatattttttcaggctggaatttgtttgtctgttattgctattctcagaaatttctgcatcatcagttataaaacagcttcttcccaatgtttaaagagaggaacagctcttttaatttccggatctgaagaggcgatatatccatggtagtcttcatgaataaaaatctctctggtaaagaacctttccccttcaataacacattcgttactggctatttcgaaagattccaggggaatcatcattccggctccatgcgctttgattacagcttcctttcttgtccaataggtgaaaaatccttttattttatcttcagtattttgaatttcaagaagttctcttgctgtcatctgaaatataaaatccagataactgatcttcggatcattgaattccacatctattcccaaaggatattctgcaatagcacaggcaaccagatctttggaatgcgatatattaaaatgaagttgccggcccttcagataaggttttttgttgggaagaataccaacttctatatcggagatattataataagttttcactccgtattgtaaaagaacttttcccaataaagaaagctgagcatcctgccatcttctgtatttcaggatagcctgttgagtttccgaagaaaaaccggacagatatctgtccagaagagcctgatgcttttcttcgctgataaaggtgtacagaatgaccatttttatgcctataataattcaacgttaaaaataagctttttccgggctgtttttaaagccgttaacaatctgatcataagttgtatgaaccgggattgaaagagaaggaataaagctgtaatacgcagcatcttttgaaaaaagaccggaatcataaagcgcattggaaaatcttttttatttttatagtaaaatcactttaaatcatttaaaaatgaaagtacaaacattagcattactggcagggtgtgcatttttagctgcatcatgcggaactacaaaaacgtactctataaatgccaaaagcggaacacagacaggaggaacagcaaagtttacccaaaacggaaatgaggtaacgatgaagttggatgttaccaaccttactcccggaattcatgcagtacacattcacgaaaaaggagactgctctgcagcagacggaacctctgcgggcggacactggaatccttccaagaatgatcatggtaaatggggagctgaacatttccatatgggagatataggaaacctggttgctgatcagaacgggactgcaacattgactttcaaaacagataaatggtgcttaggctgtacagatgagtctaaaaacattatcgggaaaggccttattgtacacgcagcagcagatgacttccatactcagcctacaggaaatgcaggaggaagagtgggatgtgtagaaattaaataatttactttattcaataaaaaaccgctaatctttttgattagcggttttttatgtttaggatttagctcccatatctgatacaatattcattgcttcctgcaggtaaagatcttttttcagattcttgatccacatttcagattttttcttgaatgcttcatcttttttctctctttcaatctcacttggatacatgataaactgaagtccgttctcaaattttgtcaaagccttgaacttttcgatctgagattttctgtttttcatcagttcgttgaacttcgttatattcagcgtaatgttctcttctttatccagtttttctctccattgagcagattctaataacaactgataattgctgtttttagccattctgtcagcacttgctttttccaaagcctgaatattgaaatagttcagtttctggaattttgtaggggaaattttatcccatgccaatgcataatcatcatatcgctctccaacctcagcgtaagtaaagaaatctttcatctgaatatcagatacaattccttttctctgggtagattctcctgtaattctgtagaatttctggatggtcagttttaaggacccgaaatcatcctctgtattcaggaatctgttcaggtctacaaaagtctgaacggttccttttccgaaagactgaggagacccgatgatcattgctcttccataatcctgcattactcccgcaagaatttctgaagcggatgcggaaagttcgttttgcatgataaccaacggaccagtccagataggtgtttcatttttatttttaagcgtctgtatttttccgtttccgtcttttacctgaacataaggaccagcttccatgaaaagccccataatatctcctacttcagttaaagatcctccaccattatttctaaggtcaagaatgattccttcaatattctgcgccttaagcttaacaatctcattcttaatatcatcagaagcatttcttccttttgcattttcaaaatccgcattaaagcttggaagattgatgaaaccatatttcttaccgttcggcgcattaacaacaatacttcttgcaaaagtatcctcaatagcaacctcctcacggatcatggttacatctttaatggtaccgtcttttttctgaaccgttaaggttaccggtgttcctttttctcctctgatcagccttactgcctcatcagaaagcattcctacaacatttaccgcatcttccttcggtttggatcttactttcaggattttatcaccttctgaaagctgcttagacttccatgccggtgcaccaatagtaagagctcccaggtaaaggtttccttttttctcctgaatcaatgccccgataccgattacttttccggtaaactgggtatcaaagtcttctttatcttttggagaatagtagttcgtatgtggatcaaatacttctgtatatgcattcatatacaccgtaaaccaatccattttctttctctttttgaatctggtaaaggtatcttttacaagatcttttacttcatctgtagcttttttgatcttttcgtcctgagtaagcaccttcagtttgatggtatctttcagtttgaatttctgaacagaatctttcttttccttctgcgcttcttccttactgttcatcgattcaacttcctgaagaatattgtatttgatgaattttttccactcgttatactgttcctgtttgttggcaggtacttttttcagttttggctcaagggtaagggtttcatcttcctgaagattgatcggtttactgaagatatcctgtgtgattttatcgatttcatctactctctggtataatctgtcgatagtaagtttgtaaaatgtcagatcaccttgtcctatataatcatcaagctttgtttcatgcttgctgaattcgtccatatcagattgcaggaaatatctttttgccgggtctaccaattcgaaataatgcttataaacgtccttcgaataggcatcattgatcgttttcgggctgtaatgcagataagaaagtgtgttttttacgctcaccattattgtctgcatcttttcatcgtcattctttggcgagttgaaacaaaacattagactggttaatggaatcaggagtaaaaatttattcagtttgaaatttttccacataaattgtctttatttattaatttttttaaaataagtatagtaattagtagcagtaagtttggtactgttacaaatgatcaaatttaataccttatttacaaatatcgacagttttgatcatttttatttaaagagatttgcaaataattaaaacagtgttagccatttcctgatgtcaggcagtttcaatccaaaaccagatgataatatttctttttacaatgtttttccaatttttttcactaaaaatcacaaaacaggtaccacaaaaatctgttttcaaccataaaggcataaaatatgatggtattgatgtatacaaattcaaaatattacgttatgaaaagtttactatggttagtcgcagttatctgcatcgttgtttggcttttaggaatgttaggaatagttccgggtatgagtaccggctatttaattcatgtcttactggttattgccattgttgttattctttataacattatctccggcagaaaaccacttgattaattctttttcaaatcacttaacaaaacatctttacaggtgcttttccacagaattcaaaacagactcctgctggaaatgcatctgtaaatttttaagatcaacttaaaaaattctgtctttttcaaagtaattacttattttattactttttctgaacattgtatttcaccaataatattcgtttcccatctccttttgtattcaaaaaaaatgaaactcaattttggttgtaaagaaatcaatacttcatctgctgttttatcgcgtcttatttttacctacatttgatgtgttgaaaatctatctgttccattctgaaaatgaacagactcacaatactatttgaataaaaaaattaaagataatttatggaaagaccacttattctggtgactaatgatgatggaattacagctcccggtatcagaaatctagtaagttttatgaacgaaatcggagaagtagttgttgtagcacccaactctcctcaaagtggaaaaggccacgctattaccattaattctaccctaagctacgaagaagttaatctggaaggtcctcaaactgatttttcatgcagcggaactcctgtagactgtgtaaaaatggctcttgataaaattctgaaaagaagacctgatattgttgtttcaggaatcaatcatggtgcaaactcttctatcaatgtgatctattcaggaaccatgtctgctgcagtagaagctggtgtggaagggattcctgcgatcggattttcattacttgatttcagctgggaagcagattttacccaggctaaagaatttattcagaatatcgtaagaagaactctggaaaacccaatgccaaaaggaattgtactgaatgtcaatattccgaaactcccggcagaagaaataaaaggtgtaaaagtctgtaaacaggcgcatgcaaaatgggaagaaagctttgatgagagaatcaatcctcatggtaaaaaatattactggctaaccggatatttcaacaatatggatgattctgaggatgctgacgaaacagcattggctaacggatatatttcgattgttccggtaaagtttgaccttacagcatacgaatacatgaaaacgctggaagaggtgatgacttttgaaaatgtaaaagaggtaaaataaccaaagaaatagtaaaagcgtgaaatcagatttcacgctttgtttttatactgttaaaataatactttatcatcttttctgagctcttccagataagcctttttctcatccctgtaaaaaaggttcatcgtttcaaaagggattaacttcagatctttattgacaatatgtacgcatgacttcttaacagctcttacatcaaaatcatgagcatccataaagttcatgataattattctgaacaggttatcatagtcaagatccggagcacagacttcaggcagacagcacagtaactgattgactttaggctgaactttatctacggaaattccggtactgaatatatccagcagctgcatatgcaatcccttatcctgttcgtaaacaatggtattccttgattcattattcagaagatcggcaggattgatgtatcgggttaaaggaattgtttcgccctgaagttttaagatatatcccatagcaagagcatccgggttacaaggaacaggaataatatcatcagaatttaataatggaaactgattgataatttcctgtcttacctccgttaaggtaattttttcatgggcagaatcttcccggtttcttccggcaatttcaacaggctggaaggtaattcctcttacacatttctgtttcagggcaaattctataatttttcctatttcatcgatatttttccctttttgaaggacaatcaccagtgtggtagaaagattaagttcattgagtttttccagtgccttcattctgactgcagtaagatccttccctctgaaatcttccagaacttcaggtttaaatgaatcaaactgaaggtatatttcaaactcaggagcatatgttgccaattgttcagcaaatcccggatcattggctattctgattccgttggtattcagcataagatgtttgatcggttttgacttggcaatatccataattttgaaaaattccggatgaatggtaggttcccctccactgatctgtacgacgtccggttccccttcattttttacaataacatcaaacatagcctcaatttcttccaggcttctgtgacttccataatgtggtgaggacattgcatagcatgtaggacaagtcagattacaacggtctgtaacttctacaatagaaagacagctatgctgttcatggtcaacacataatccacaatcataaggacagccatattccacatcagtcccgaaatgaagaggcatttccgaggccttattatagtttcttatatttttataataatgtacatcagaagctatttttgttttgaaaaatccatgatccggacatcttttggccataaaaacagtttcatcctcaataatgattttagctcctacccttttaagacattgcgggcaaagactgatggtataatcgtaataggtataatttcttactggcatagcaaattttttaaagtcctccgcaaatataaccgctgatcagtccacagatcagaagggatataagcatggtctggataaattgttttctggtaaatttccgatctccctttctttcgtaaataagttttgtaataactgtgacaatgagggaaagaaacagtgcagccaaaataattgcgccaacaatcactaccactactccagccagattgatattgccttctaaaatagttaatgttttcatcttgaatattttaaatataaagatccggtatttttaattttataaatgtagtaaataattacacagatacagacccattgaatagtccccatatttcccaggatttctatccttggttttataaaatccaaaaagaatctgaatgtaaaatagctaatcataaacagctgaaatataaagccggaagggtatttcttacgattctgaatatacttcaatcctatccaaagaaagattaaaaaagctatttcatacaaagcaacaggatgcctgagatattggtcccccaaatgcataccaaaaacagaatcagtaggaataccatatgtttcttcaccaataccggtaagaaagcaccctattctgcctataatcatggccagcatcagtggaaaaacaataagatctcccgtactttctttatgatgtactatcttttttgccagctctacacccaataagccaaaagccagccctccgacgatggtattgtttgaccagaactttctgatagaaaaattttcaaataatgtataagggttttcaagattaccgatcagcttggaacctattaaagctccggcagtagcacctattaaaaccgcagcagaagtattgaaagaaagtttttccttggacttacgtttcagataaaaataatatctcatgcccaaaaacattccggcagcctcaaaaagcggatgcgcaaggattgttttgccgaaaatatgaaaggttacaggaaaatccattatttcaaaaatacactatttcatattattcactacctttattctgacaaataattacaaaatgcgtatagaatatgacataaaactggggtttaaggatgtaatgttccgccctaagcgttctactttaaaatcccgttcggaagttgatctccaaagagaatttacctttaagcatacgaagaaaaaatggacgggagttccggtaattgccgctaacatggatacggtagggacttttgaaatggcagtagaactggccaaagaaaaaattattactgctgttcacaaacattatactcccgatgaatggagccggtttctcaatagccagcctgaaagtattcaccagtatattgccttaagtacgggaacaggaaaggcagatgaagaaaaaataagacagatcctcgaaaagcatccaaaaattgagtttctctgtatagatgtagccaatggatattctgagcatttcgtcgaatttgtgaagaaagcaagggcaaattttccggataaaattattatcgcaggaaatgtggttaccggagaaatggtcgaagagcttcttctggtaggagcagatatcataaaagtaggtattggcccgggatccgtatgtactaccagagtaaaaaccggagtgggatatcctcagctttctgcaattattgaatgtgctgatgccgcacacggcttaggaggacatatcattgccgacggaggctgcaaagttcctggtgatgttgcaaaagcattcggtggcggtgcagatttcgtaatgctgggaggaatgtttgccggacatgatgaaagcggtggagaaatgattgaagaaaacggtaaaaaataccgtcttttctatggaatgagctctaaaacagcaatggacaagcattccggaggtgttgcagaataccgtgcttctgaaggaaaaacagtgaaagttgcctataaaggtccggtttctgaaacggtaaaggatattttaggaggtgtccggtctacatgtacttacgtaggggcttcgaaactgaaagagctttccaagagaactacttttataagggttcaggaacaggaaaatcaggttttcaaagattaaaaaaacaaaggctttagaattatgatctaaagcctttgtttattctttcgttctgatgtattttttattgaaatatttctgaagctgatcatttacgtaagtctcctgttcttttacagaagccatttcatccatatataaaatcctcggaacctcctttatcttatccaccacaactgagtctttaggagagctactgatggtatctattctttggttcatttctctttcatattctttcagatctgtattcagaacttccattattatattttcattattaaaatcaatattaaagtaagaatattttttggggaaaattttgagctccggaaggaatacaatgagtagggaaagccaccagagctttttgatcttttcccatttgaaacataatagcagtgaaaaactaagcagaaaataaaaaaggatactttcaaactgtcttgcaacagaggtgagaatatagcttgtaaataataaaggaaggaaggaaactgaccagaataaaacagcttgcctatatgtaaccttgccagcaatctttttgagttcttcttcaaaaacctttataaataatggcagtataagaataaccttaaatactacatatacactatctgccccaaaaagagcagctcttttcaaccatttaacaattccgctttccacttcgcccattctgttgaaatttccgggtgcaagaaaacaaacaagcagaaatacggttcccagcagtgccagaatcaggctttctttattgcttttctggtaacaggctactaataaaagtccttcaagaatcaatgccagaatctcattagatcccatcagaataatgatcagcaaggctgaaagataaaaccatatcttcctgtctgcatcttcatattttttgaaaaaataaagtaaaatccctgataaaacaacaggaacaaaataaatattggaccccgtaatccagaagtaatgctccggtaagcttaccagaaggactgtataaaagaaaaacaaaagaaatccttttttaacggattccttcagagaatagttgaaatactccttaaagtttaatgctgaaactccaataaaggaaaggattaacaagacaggatatattttcgggacaatattattgctgtcataaaagacaggattaaacatattgatggaatatccgaaataccttccgccccattgtgtataggtatctgtaaagctttgcagcaatccaaactttctggtagtataggaccagaaataatcatcggtctgatatacattaaaaaaactaatgtacgtcagaccgatgaatagtaaaactgacaagaatactattatattctgtacttttttcattttctaggttaacattccaccgtcaacgtttaaggtctgtccggtaatatatgctgacatttcgctgcctaagaatacacatgcattggcgatatctgcaggctgccctcctctcttcatcggaatttcttctctccatccctgaactgttttttcatccagaatagccgtcatttccgtttcaataaatccaggcgcaatagcattacatctgatatttcttgatcctaattccagcgccacagattttgtaaacccgataacccctgctttagaggctgcataattggcttgtccggcattccctttcactcctactacagaagtcatattgatgatagatcctgatcttgctttcatcatcggcttgataaccgctttcgtaaggttgaaaactgaatctaaatttactttgataactttatcccaatcttctttggacattctcaataacaggttatcttttgtaatccctgcattgtttaccaaaatatcaatctgcccgaactctgccattacttcctccaccaatttttgagcagcatcataatctgatgcgtcagactgatatcctttaatttgggttacagaacttaaagctgcttctaattcttttgctttgtctacagagccggcgtaggtaaatgctacttttgctccctgctgagcaaacatttcagcaatccctttaccgattcctcttgtagctccggtaattagtgctacttttccttctaatattttcatatctattgacaattattttcttttataactcattcagcttgtgacagctgactcttgtagtctctacaattcctttccggaattaaacggtttgcaaagatattataaaatgttattcaacccattcaaattgtcaaaatactcatctttttttgatgattatttgatattttactaaagttgagtggaattatttttaaacctggtgaaatagataaaatcagtttttttattttggtccagcttcaacacctctttctgccagaaatatttatcgtacacaatttctttcagaggctcattctggaaattggaaactccgaattttccttcttttttcactacaatctcattttcagcattcccgaacgttataatatcttcgtaaacaaagggtacaatttctgttcctttcccatccagaataccataaagattatcattattcctgcaaaccaaaggtttggaatactggttaagaggattaaaatattcaacatcctcattctttatttcagttacattttttagtgcgatcaatgactgatccgtcactgaaaatctgtaatacttaccttcttttccaataataaggttatcaggatagaaaccaaaaatatgaactccatctcctacaatattcttaagatctttatcaagaaatttctcttcacttccttttttaaggtaaataaagtctttcccggaaatggtaaaacttctggtgaaatcatattcctgagggaaaataacccttcccccgaggtctatgacaccatatttctttgtcttatcattgtaagcactgaaataatgatccggtaaaggagtcagatattgataaggcagaggatacagcttcctgtctttcttactgaaaacagttgttttaccatttttactgaagtatatatattcccttcgtccgaaatattcaggagtgatatcattaaaaatttcttcagcaatggtatttccgtctgtatcgatcaaaccatatttacctgtgtttttattttttgtaatcagatagggataagcgctgatgctgatcacctgttgagaaaatgtatgtaaggtttggccattacttccaatgatttcgctttcaccatcctcattaatgatgagtgctttatcctcttcaaaattgtaatcttctttaaattccctggtgctgagctgctttccgttgagatcatacaggaaccacttattatcttttaaaacaaagaacctgttctttcctgaaaaacggatcttttccgaataaggaatgatttgttttccgttaaaatcaaaaacagcttctgcgttctgttttgatgaaataatccgctccctgctccaccacggtgtattaaattcctgattgtctagtggaataatctcatttcctttttcgtcaataactgctgattttcggctgtttccttcttcagaattcaggataaagcggtttttgaaaatgtgaaaaacatttcccctgaaaggagattcaaatgtaatattgcccaaagaatcaataatgccctgttttttagatctgggatcgtaggctgttccgtatccttcagaataagaacttacctcttttcctgtttttttcgacaggatgactttcatatattgattggtctgtgctgtacagactacagaacataatacaaaaactaattttttcaaggaaaattaaatagaattattgacaataagaacaatctctccttttaaagttttactcttggaaaactcaattaattcattgattgtcccacgtttggtttcttcaaatttcttggaaatctcacggcttaagcttactttggtttcttctccaaagaactctttaatctgctccagagtagtgttgatcttatggggactttcgtaaagaacaatagtctttttttcctcagctagctgcttcagcttggtctgtcttccttttttctgaggcagaaaacctgcgaatagaaattcattattaggcagtcctgaaactacaagagcaggaatcaaagctgttgctccgggaaggcagatcatttcaatattgttgtctgcacccgcttttgccagcagatatccgggatccgaaataccgggagttcccgcatcggtaacaatagcaatattctggccgtttttaaggtcagcaatcactttttccgttgcctggtgctcattatgcaaatgataagattttaaaggcttggagatctcaaaatgttttaaaagaacaccggaagttctggtgtcttcacataaaatataatcaacttctttcaggacgtttattgccctgaaggtcatatcttcaaggttcccgacgggtgtgggaacaaaatataggattccgctcaaaattataagaatttattttccaccaatatccaaagcctctgagcatattcatccactttattccattttctttcatagtacagatcgctcagatattctttggcttcatccagtgttctgaactgattcagctggtatacggtatcattaagatctgcctggcttccttcaaaaagcatcttcgtgaaggcaagcctgtcattaagatccagcttaaattcaggtttcagtttgtctgcttccatgaagttggttggaatattggatttcagaatacttcccgtgtcttctttcacagccggagccggtttttcttctttaggaaggtctctttccaggtggtcgtcatcaaaaagcgactgaacagccttcattcctttgatattggctaattttatttttttctcccgatggtattcttctaaattttcgaagctctcatcagaaggatttttatctgtttcttcgcgaacaggtttgtcaatttcaacaatttttctccggtcatacacttcggcaaggatgctttcttcttttgtttcttctgctgaatgatcattttttatctcactcagaatattttccacattggaagtttctgaagccatctctccctgctctatcgaaacatttgaagctacaaattgttcttcattttcttcgatcagtatttcatcttcaagtgtttcactttcaaaaatacttggaattgtttccgttatttgtggtttggtatcatttacaattgcagaatcaatctctttttttgattcctgttcagaaatttcctcttcgtcttcaatctcattaagctgattattgaaaatcgcttcttcctctgttacttcatggtaatacaggtcttcattaagatcttcatccgaatccggtgtggaatgtgcgagaattttatcttcatctacaaagttcagaacagctctttcttctgctgatatttctgcttcatcaatttcattaaactgatcatcagacaccgtttcttcttcctttatttcatgatcaaaagtctgttcctcagtattttcagtataactttcttctacaaagctcacaatattttcatggaattcgttttcaacaatttcattcagctgactattgaaaacggcttcttcctcagatgcatctgggaagatttcattctcgtcaatttcgttgagttcattattgaaaatagcttcctcttccgtcacttcatttgtatcatgatgttctgcttcccctgaagcaaaagagacgtattgactgtccgggttctgcaccggattgtctgctacgaagtattcaatatttttttccagcagtttcaaaaaagaaatcctgttagcaagctcatccacaagatcttgcttagaaagtaattcgtctatgtgacttattttgtccagattatcaatgatattcatggattcaaaaaaaatcttttcctttaaatcttggatattctgcataataagattcttattaaaattgcttacttttgatgttaaaaatatacggctaatttaacaaatgtttttagaaaatacaattaatcattccaaacaaagcggttggatggaagtgatttgcggctctatgttttccggtaaaacagaggaacttatccgcaggttgcgaagagcagaaatggcaggacagaatgtggaaatttttaaaccgaagctggatgtacggtattctgaagaggatgtagtttcccataaccagaacaaaatccgcagcactgcagtagaaaatccaaatgaaattcttctgctggcatccaattgtgatgttgtaggaattgatgaagctcagtttttcgatgaaagcattgttgatatcgccaatcagctggcgaatagcggtatcagagtagttattgcaggtctggatatggattttctgggccgtccgttcgggcctatgcctaatctgatggctactgccgaatatgttacaaaagtgcatgctatttgtaagagaacgggtaatctcgccaactattccatgagaatttcccagggagataatctggtagaattgggagaaacagaaagctatgaagcagtaagccgccgtgtttttattgacgaagtactttcaaaaagaaaataactggaaaggcaaagctgctgcattatcaatcagctgttgctaaagccataagaatatatttaacttaatataaaatgaaaagcgaaaaagctctgtaaaatatttaaaaaggaaaaaaaccggatgatgttataaatcttagcccttttactattttacctttttgcgatttcgctcaaaataaagcagaaagggtaccaatgaactatacagtacaacacattgcagagatcaccaatgcacagatcattggagacggaaatttattgatcaaaaatatagcgtatgacagcaggataatttattctatcaagaatacagcttttatcgcaatcaatactcataagaattccggggaaaaatttattgaatctgcaatggacaggggtattaaggtcattatttctgagcatcattatccggagtttgaaaatataacctggatcattgttgaaaattccgtagcgtttcttcagaaattagcaaaatatcatttcgaaaattctcatttacaatctatcggaattacaggaagtaatggaaaaaccattttaaaagaatggttgtatcaatgtctgtggaatgaatttcgtacagtcaaaagtccaaagagtttcaattcccagatcgggttgccattatctctacttcagatcaatgattctcatcagttgggtatttttgaagtaggaatctcaaaaccgcacgaaatggaaaagcttgaaaatattttccatcctcaggtcggattgcttacccatattggaactgcccatgctgccaacttttcttccgaggaagaattgattgatgaaaaaatcagactttttaaaaattctgaggtgatcatttacaatggcgacaatgatttggttgatcaaaaaatcaaaaattcctattctgataaaaaattaattgcttacggtttcaaaaaagagaatcaggttttcatcaaaagcaatatttccaaagatgaaaatatcattgttgaatattttggcgaagaaatcagttttccggcccaccagagagacgaagcgacgataaccaatgctatggcgcttatcactgtcctcaaggaactaaatatcggaaataaaaagatcgtcgaaaaaatcaaccttttaaaggccgtcgaaatgaggcttgaagccattgaaggaaataaaggcaatattgtcatcaatgattctttcaaccttgacctcgattctttgaagactgcccttcagtttttgaatgaatataataaagcaaaaaaatctctggttctgacagacatcgtaggagtaagcaccaatgccaaagaattgtatgaagaagtagcagaattggtgaatgatcagaattttgattctgtattcctgatcggtaatgaaatttcaaattttagtgaattatttaaagctaaaacctatacttttattgatactaaagagctcattgaaagtaaacatcttactgaaatagaaaatcagatcattctgctgaaaggtgccagaaaattcgagatcgaaaaacttaaagatatcctcgaactcagaaagcatgatacggtcctggaagtaaatcttaatgctatacttcataacatcaattatcataaatcactgctgaaaccaggaactaaaatgatggcaatggtaaaagcgaatgcgtacggattgggtagttttgaagtatcagaatttctccagcaccatcatatagattatctaggtgttgcttatgccgatgaaggtgtagagctgagaaagaaaggaattaccactcctattattgtaatgaatcctgaacagcatagttatcagactatcatagagtataatcttgagcctgaaatttacagcttcagggtattggaattattttatgaagccgttcagaaatcaggatatgataaaaaatatcctatccatattaaactggaaacaggaatgcaccgtcttggttttaaagattttgaactggatcagttaagcgaaactctaagccacaaaaatgtaaaggtccaaagtatgttcagccatttatcttcttctgatatgcctgaagaaaaagaatttactttgaaacaactggaggtttttgataaaaattcaagttgccttattgaaaaactgggttacacacctatccgccacatcctgaattcagcaggaattaccagctataaagatcatcaacatgatatggtgagaattggtattggtatgctgggagaatcagcagatcctgaaattcagaagcaattgcggtccgtcgtaagctttaaaaccgtaatttcacagatatcaactgtggaaaacggagaatctgtaggttacagcagaagatataagacagatcatcctaccagaatcgcaaccattcccgtaggatatgcagacggaattccaaggctgataggaaatcaggtaggaaatgttggtgttaacaaaacactggcacctatcgttggaaatatctgtatggatatgatgatgattaatgtagatcatattccgaatgtaaaagaaggtgatacggtaactgtttttaatgcacacccaagtttaaaagaattcgcaggatactgcaaaacgataacctatgaagtattaacctccatttcaccccgggtgaaacggatctatataaaagactaacttatgagaaaactcctgattctgcttttcatattcccgctgttattgatccattctcaggtaaaaaaagatctggtaattcctaagaatccaaggatcgggctttcccttgccggtggcggagccaaaggtttttcacatgtcggagttctcaaagtattggattcgttgggagtgaaagtggattatatagcaggaacaagtatgggcgccattgtaggaggattgtatgccgcaggatactccggaaaagaaatagaaaaaattgtcatggatacagatttctattctttgattatggacccgaaatcacggcaggaagccagctttttcaacaaatcagtagataaatatcttttatccattccgcttaaaaacgggaaaatcaccctcccttcttccatcagcaccggccagagaaatgtttaccttcttaaagaactttttaaaaatgtttccaatatcgaagatttttctaaaatgcccattccttttttatgtgttgccaccaatcttgaaagcgggaatatgcagatctttgaaaaaggagatcttgtacagtctatcatggcaagttcggcctttccttctttaatggatcctgtaaagattggcgacagtatttatattgacggagctatgaccgtaaactatccttcaaagcctttaaaggacaaaggaattgatatcgtcattggtgtggaccttaatcaggatctttcaaaaagagaggatttaaacaacattatagccattctgaatcaggttatcgatttcggaataaaaaaagataccagaagacagtataaatatacagacatcaatatcaagcccaatctgaaaggaatgtctgccacaagctatgatgataaaaagaaaattctggacagcggctatgtggaagggctgaaatatacccagatacttgaccaacttccaaagcggccttttgaccgtctcagacagcgtgtaaacccaatttattccaacgtatataagatagacagcatttctattgaaggaagtaaaatctatggaaaaaactatacacttggtaaaatgggattgcgcctcccctctctgcagacctatggaagcatcaataaaatgatagataagcttgttgctacaaacaactaccgttttattaactatgatatcgttcaggaaaatgatgccaattatctgaagctttatgttactgaagatgaagcccgccattttttaaaattcggtctgcattatgatgaagttttcaagaccggacttttattaaattactctgcaaaaagacttttatttaaaaattcaaatctttccctggacgttgttgtaggagaccgcttgaggtactacctgaattattttatagataacggatatatccccggatttgggctctattcatccggaatgagctttgatattaagaatgtggataattacaatatagaccgctgggaatggctcagaaatgaagcttatatacagtctgtatggaaagataaattcgcgatcggtggcggtattagccacgactactttaaagcagaaaacccaaatggtgaaaaccaacgctacagtcgttttttaaacccttatatttttatcaaaaccgacactcaggatgataaagaatttccaacgaaaggggtttattttgctgccgaaggaaaagtagtagatcttttaaagtccgaggtagacaaacgaatcattcagattaaagctgatctaagacttaatattccgcttggcaaacacttcagttaccgtctgaatttatttggaggagttaccattggtgaaaatcttcccgtttattatcaatacagattaggtggaatttttgaacagaacctgattaatttcaaaagcttcggaggattttatttcgcccagctttatacaaataatgttatactggcctctaatgatatccagtttaaattcaataaaaactattttatcagtggaaatttcagctttgctaacttatcaaacgatatcaagtttgaagatgcagttaaagtaaattatagctcactgggaataacggcgggttacaaatctcctttcgggcagataaaagtcaacttcagccactcacttaaaaacaaccaaaaaggtatattcagtgtcattttagggcactggttttaaaaaaatgatacagttcttttacgaaaacttaccggagtcagtaagtacagattacaaaaaatggctggaagaccttattctttcagaaggaaaaaaactaggagaaatcaattacattttctgtgatgatgaatatcttcttaagatcaatcaggattatttacaacatgattattatacagacatcatcacttttgattatgtaaaagggaagacaataagcgctgagattttcgtatctttgcagcgcatttctgataacgcctctaccctttcccgagattatgaagaagaattaagaagggttttagcccacggaattttacatctggcaggctacaaagacaagacggaagaggaagaaaaagagatgcggagaatggaagatctgtacctggataaatacaggaatttaaagttttaaaattgaacaatcacttaaagtcctatatctaaagtattctattctagcaacaatatacatttacctagagtgcattctccaaaaatgtttcacgtgaaacattggttataaagataaggtttaaagcttaaaacaagcgagataaaaatgatttcagaaatatatgatgtaatagtagtaggtgccggacacgcaggttgtgaagcagcagcagcagcagccaacctcggttcaaaaactttacttattacaatgaatatgcagaccatcggacagatgagctgcaacccggcaatgggcggaatcgcaaaaggacagatcgtaagagagattgatgcaatgggaggatattccggaattgtggcagataaatctgctatccaattcaagatgctgaatctttcaaaaggtcctgcgatgtggtctccgagaacccagaatgatagaatgcttttcgccgaagaatggagactggcattagagaatactcctaatcttgatttctttcaggatatggtgaaacaactgattgttgaaaataataaagtaaccggagtggttacctctttaggaattgaaatcaaaggaagatctgtagttcttaccaacggaacttttcttaacggtttaattcacgttggagataaacaattaggcggaggaagaatgggtgaaccaagagcttttggaattacagaacaattggtcactttaggtttcgaagcaggaagaatgaaaaccggtactccaccgagagtggacggaagaagtctggattattcaaaaatggaagaacagaaaggagatcaaaatcctcaaaagttcagctatctcgatacaccgaaactgacaaaacaattaagctgtcatattgtatatactaacgaaacagtacacgacattttaagagaaggcttcgacagaagtccaatgttcaatggtacaatccaaagtttaggtccaagatattgcccaagtatcgaagataaaattaaccgttttgcagagagaaacagacaccagcttttcgtagagccggaaggatggaaaactgtggaaatctacgtcaatggattcagctcttctcttccggaggatgtacagatcaaagcaatgaaacacattccgggatttgaaaacgtaaaagttttccgccctggttatgctattgaatatgattacttccctcctacccaattaaagcacacacttgagacgaaaataatcgataatttatatttcgcaggtcagatcaacggaacaaccggatatgaagaagcagccggtcaaggtttaattgcaggaattaatgctcacaataaagttcacgaaaaagatgaatttatcctgaaccgggatgaagcgtatatcggagttttgattgacgatttgattacaaaaggaactgaagaaccttacagaatgtttacttcacgcgccgaatacagacttctactcagacaggataacgcagatatccgtttaacagaaaaagcgttcaatctgggattggcaaaagaagacagattaagacgcgtagaaactaaagtatctgaaagccaatcacttgaagaatttcttcgagaaacttctttaaaaccaggtattatcaacccagttctggaatctatcgaaagcagtcctgtggaccaggcttacagagcggctcaaatccttaccagacctaatatgacattagaaaaactggatgaaattgatttcattaaagaagtttctgagcaatatagcgatgaagttagagagcaggcagagatcaatatcaaatataaaggatatattgagaaagaaaaagaaaatgttgctaaattaaatcgtttggaaaatattaaaattcctgaagactttgattatagcaaactttcaagcctttctgcagaagctaaacagaagatgtctaatgtacgtccaaaaacaattgcacaagctggaagaataagtggagtttctccagcagatatcaatgttttattagtatatctgggacgttaaaaaaatgtttcacgtgaaacatcaaaaaataaaaacaaaaattaaggtatttacaagcataaaaaacttatgaatatcttaatttttttatcatataaaagatatttacttcaatgaaaataaaagatcattttctttcacaggaaatatttgaaattaaagaaacagaaacaaaaggagtcttcaaaacctcccctattccatctgacatttcaagatattatgaaagcgaagattacatttctcatcaccaggattccggaagtttaaaagaaaaactctacaagtttcttcagtcattcaatcttcagtacaaaaaaaacatactggtagacagaatcaaaaaaggttcaaaagttcttgattacggatgcggagccggagaatttgtaaaatatattgaaaatgattttgagactttcggttttgaaccggatgcggatgcaagaaaagctgcacaaggaaaaataacaaaagcttccattgtggatgatattaataagattgaagaaaacagcctggatgctattacactctggcatgtatttgagcatatagagaaccaggacgagatgctgaatatttttcataccaaattaaaagaaaaaggacttcttgttatcgctgttcccaaccctacttcatatgatgcaaaacattataaagaatactgggctgcttatgatgtgccgagacacatctatcatttctcaaaaaatggaatggaaaatttaatttctaaaaaccgcgactggaaattaagaaaaataaaacctttagttcttgactcctattacatctccatgctgagcgaaaaatacaaaaaatcacccctattttggctaaaagcagtgatctacggaacgatttctaacttaaaggcattattttcgaacgaattttcaagtttgatatatattatcgaaaaaagatagaaaatcgatttttgacccatttatgaaggtcaattttcagcgtttttgattaaaaaataaaactcaggggaaaaatctctgagtttttaatttttatgtaagctcatttttttggttcttgaagtcttaactaaaataattttggttcattcaactctccattgaaatttagtaaggctcccctactccattttaaaaattcaaaaaacaattcttttgtaaacgtattcaaatttgactttactacctgtaaatttaatacagtctaaaaaagtcaaaaaaaaacaaaaaaaatggttttacaatttgaattcttacaaaaacaaagataatttccaataaaaatataataacataagataactcattaaaatatagaaagtcgattttaggtatatttacgaaggtcgatttttaagtatatcttatcaaaattgtaagacagacaactattctctatcctttatatctatgcccattagaaaagaaccggagatataagacaaataaaatataaaactcccctactcccttaactgaatttttaagcagcctaacatcttataccggattcataataaatgtaaagtaaaatgatagtactggaaatctttcaaaataaaattgcagatcaaaacctaaaaatcagtagaagcaatttgaaagtactatcaaaataaaaagtcaatactaaaatatctcaacatttgttttagaattcattattactgcaaattagataaataactttataacctattcattttaaattacttaatactatataaaaattaaaataaactaaataaaaataactttattaattgataatcaatataatacaaaatactcacacatatatgaaataaaataaatataaattacttataagaaatacatttaaattatttccagaaacaaataaagaattgctctgtttaaggttatggattataaaatcaggaatcaaagttgatcctttacaataattgatcaggctaatctcaccctagagcatataccagaaaaaaaatcgcaatgaaagcataataaatgtttctaaaaaatggatctttcattgacaacactctggtgaaaatcgagccatatattttcaaaaaaaaccaggaaagaacaggaagagatttttaaaattacagaattacagagaaaaatacagacaaagaaatttcaatagaacacaagtaattgataaagaaataaacattactctatataaccataagttatatctaaaatacattggaattaccgatgaataaaggattttctttacgttacggagataaaaaaagcctgctaatataattagcaggctttaaaatatttatttatttgtattaattgttgattgcagctacacctggtaactcaagtccttcaagactttcaagcattgctccacctccggtagaaacataacttactttatcagcatacccgaattgcttaacgaatgcaacactgtccccacctccaactaaagagaaggcaccaagcttagttgcctcagcaatactatcacctaaggcaacagttccacccgcaaagtttgacatctcgaaaactccaattggtccgttccaaagaatagttcttgaatttaacaatacgtcattgaactgatctctagacttgtgacctgcatcaagtcccatccatccttcagggattgtatagatatcagcttcttttctttccgcatcattactaaaactttcagcaataattgtatcagacggaagataaactttcactttatgctccttagctttacccaaaatctctagagctaaaggaagcttgtcttcttcaacaagagaatttccgatctttcctccaagagccttaataaaagtaaacgccatacctcctccaatgatcagattgtctactgcaggaagtatattttctataatggtaattttagttgaaaccttggatcctcctaaaatagctgtaaccggtctttcaccgctttttaatactttatcaattgcctgaagctccttagccatcagtaaaccgaaatatttagttgatggaaaatactgagcaattactgctgtggaagcatgagccctgtgtgcagtaccaaatgcatcatttacataagcatctccaagcttagcaagtttctctgcaaaagcagcatcacctttctcttcttcattatgaaaacgtacattttccagcaacaagatctctcctggtttcagttcagctgcagcctgctctgctttttcaccgatacattcatcaacaaactttacttcacgtcctaagacattggaaacttcgcctactatatgtttaagagaaaattcatctttaacctcaccctttggtcttcccaggtgggtaattaagatgacagaaccaccatcattaaggatcttatccactgtaggttttacagcaacaattcttgtattgtctgtcactttcagttgatcatcctgcggaacattgaagtccactcttaccagagccttcttatctttaaaattaagatcattgattgttttcataaatagatttatttttttctaagccttatgaaaccgccgtgctcaaaatccgttctagcttccggtaaaatctcgcaagagcaatttcataaatttcactgaatttttgtttcacaaatgtaaggttttaaactttttcaacactttgattaaaataaaagttttcaaaaactttccccgaacccaatcacccattaatcaacaattttttctcttttaaaaaaaagaataatgtagttgttgttgagtattgttagtttcggggataagtttcaggctaaaagttggtaacactcaacttttattcaattcatatttaactcacaatataaatccttgtaaacccgctgtttcacacacttattaacaaatgttgataactttgaaatgatgccattcttagttattttattatggaaaagactggggatagctgaagaaaacatctggaaagttgtggttaaattttgcggaaacgttttctattacgaaataaattgatctttaaaaatagaaagttgataaaagttttccacagttattcacagaccttttcacaattaactcccggtttactaacacgaattgttattattcttacctttgtaaggaaatagaatctaaaaaagcttaataagagtattatgaaaagaaaaattgctgttgcagcggaccatgcaggctatgaatataaggagattgttaaaaactacctttcagaacattttgaagttcaggattttggaacgttttccacaaacagtgtggattatccggactttgtacaccctgccgcaacttctgtggaaaacggagaaaatgaactgggaattttgttctgtggaagtggaaacggagttcagatcactgccaacaaacatcagaaaattagatgcgcactttgctggatgccggagattgcaacgctggcaagacagcataatgatgccaacatgatttcgataccggcgagatttatatcaaaggaactggccattgagattgtagataaatttctttctacagactttgaaggcggaagacaccagaacagagttgataaaattgcattttgctaatatataataaggcttgtaaatcatttacaagccttatttattttttattcgtacatttgcagtgtccaatagaaataacactctattattctctaaagccttttttatattggaaacatatttaacagaaggtttttctcttttcttctccagaattgtattaaatttatacaaaactaaagctcccgttgttagcaaaccgaaagataatttctgatgatatacggaaagaatctatgatgaaattgaataaccttatattaaggaataaaggaagatttagaaaaaggttttatttgaattgagataaaaccaaacatttaaaaaagaaaattaacatgccaaaaaaaagaaaatatataagtcataaaaatgatttaaaactgatggagatcggaaggctgatcctccgttttatgaatgcaaattcatccaaaatttataattacaaacaaatcgctgatggtatagattacaaaaatccgagacaaagggaacttgttatccaggcattgcataaacttcaggcatctgaaaagatcaaagaagtggagcgcgggaaatatattgttaacctgaaaatagcaggaacattaaccggaattattgacttcaaccaaagcggaaatgcctacgtaaatgtggaaggaatggaagatgatatcttcattcatgccaaaaatgtgaaggatgcactgcagggagataaggttcttattataacttatcattataaaggaaagaaacttgaaggctcagttctggaagttttggaacgtaacagaacagaatttgtagggacatttcagaaggtggctcacaaagatttcgggtttgttgtttgtgataagaaatcaatcaatacggatatttttattccgaagaccaaattcaataatgcggaagacggagataaggtgatcgtaaaaatgacagagtggaaaccgggggataaaaatcctgaaggtgaaattatccaggtactgggtgctccgggtgaacatgaaacagagatccactctatccttgcagaatatggtttaccgtatgaatttccacaggaagtagaagctgatgcagataaaattgaaagaagcattactgacgaagaggtggcgaagcgttgggatatgcgtaaaatatgcacttttacaattgacccgaaggatgccaaggattttgatgatgccttatccataagaaaactggaaaacggaaactgggaaatcggggtgcatattgcagatgtatctcattatgtggttcccggaactattcttgatgatgaagcctatcagagagctacttcggtatatcttgttgacagggtggtaccgatgcttcccgaagtattgagcaacgatgtctgttccctgcgtccgaacgaagacaaatatactttttcagcagtctttgaactgaatgatcaggcggaaatccagaaacagtggtttggaagaacagtgatccattctgacagaagatttacctatgaagaagctcaggaacgtatcgaaaccggaaagggagatctggcggaagagattaatacgcttgataagctggcaaaaatcatgcgtaatgaacgtatcagaaaaggggctattactttcgacagaagtgaagtaagatttaacctggatgaaaataatgaaccggttggggtttattttaaaataagtaaagattccaatcacttgatcgaagaattcatgcttttagctaacaaaaaagtatcggaattcgtatcgctgacaaggaaaggtgaaatcaccaacaatacatttatttacagggttcacgacgatccggatcctgcaaaactggaatcactgagagactttgtagctactttcggatataaaatgaatcttgccaataccaaaaaagtggctgaatctctgaataagcttcttcatgatgtaaaaggtaaaggtgaagaaaatatgatcgaaacactggccatgagaagtatgagtaaagcggtatattctacagaacctatcgggcactacggattaggatttgaatactacagccacttcacctctcctatccgtcgttatccggatttattggcccatcgtcttctccagcattatctggatggtggaaaatctccaaacagaggtgagcttgaagaaaaggcaaaacactgcagtgccatggaaagattggctgcagatgcggaaagggattctatcaaatacatgcaggtgaaattcatggaaaaacatttgggagaaactttcaaaggtgtgatttccggtgtggcagaattcggattctgggttgaaatcccggaaaacggagccgaaggtctgatcaaactgagagatcttgttgatgattcgtacatgtttgacgctaaaacacatgctgtatatggagtaagacatggtaataagtaccagttgggagacgaagttcagattaaagtggtgaaagccaatctgattcagaagcagctggatttccagattgtgaagtaatgacgagaatagataaatacattgtatttagtattttaaacgtaatattattgataacagttatttttaacactgttatcaatttttttctgtttgtacttgttataatcattcttgtagtcacatgtaatattttgatcaaaaggaatattattaatattgataaacaagggaagaattacttttttggagttacatttccacagataattaatggtttttttttgataaactatcttacaggaatgaatcctaccaaagaaacatactgttttaaaaacatgatttcagaggttggaagtgtacgcagccatgagaaaggaaagacaacttacatctatttaagcggaaatgcatatgaatattcttatatgacaaggagttttctcattgattataaaagaatgttgtttaaaaatcagatcacttacacctttgaacgaggaatttttggacttaaaatcagaaaagactttgagtttgtttttaatgaaaattgcctggaaaaataagtgtgataaatcatcagaaaaatataatgcaaaaagattattccaataaggaacaatctttttcttttttaaggaggtaaaggatgggctaaaattattttgggatctgttcgtattttggactttgtattcttgctcctctcctatttcttaaaatttttatattaaactctgattaaaatccacttgatatatcacaactttattgaataattaaatcataaagtctaactttgtattaaacgaaatgaatttttattcattttaaaacaccacttaatgctagaacttgtactatctgccatcatattaggatttatgctgagcctggttttcataggacctatttttttcctgttaattgaaaccagcttttcccgagggcccagacatgccctatccttagaccttggcgttattacggcagatttattatgcattgttgcggcttactatgccagtacagatattgtaactctgatagataagcatcccggattttacaggattacttccattcttattttcatctacggaattgtgatgctggttaccaagaccaaaatgcatatgcctggtgaagaaaagatcattggccagaattatatcaagacatttttcaatggttttttctttaatcttctcaatgttggagttatccttttctggctggtaacggtaatttccgtaaggaatcaatatccggacaccagcagttttattttatacatcagcatagtgctggccacttacctatctatagaccttgccaagatatttcttgccaagcagtttcacgataaattaacacaaaaactggccaaccagatcagaagagtggttggctgtattcttattatcttcagtttctttattttcctgcagagtttcaaaaagttcaaccaatttgacagacagctggaggaagcagaaaaaaaagaagtaaaatatcagaaaacaaaatgaaaaagatgatctttcctaagtctcttaaaaaaggagacaaaatagctgttatttcccctgcaggagccgtagatgccacacaattggaaaaagggattgaaatgattaaaagtagaggttttgaacccgttccgggagaacatctttacagtaaattttcaaacggatacaattatgccggaacagaaaaggaaagaattaaagatatcaactgggctttaaatgacaaagaaataaaagctgtatgggcttccagaggaggttatggatgccagcacctgattcagcatctgaaactgaaaaactttacagaaaacccgaaatggtatatcggttattcagataatactgtaattcaaagttaccttttgaaaaaaggtttcgcttctatccatggacaaaccatcaaaacatcaagttttggagttacggatgaaagctatgatcttattttcggtatcttaaaaggagaaatgcctaaatacagccttaaatcccatcaatttaataaagaagggaatatcaaaggtgaattggttggaggtaatttagccctgatctatgcccttctagggaccagatattcttttgattttaaagacaaaatcctgtttattgaagatattggtgaaaatttttatgctctggaccgtatgattatgagtctggaactggcaggagtttttaacaaaattaaaggactcattgttggcggtatgaccaatatgggagatgaaaaagaaaacacaagctatgaaaaaagctttgatgagctggcgtacaaactgatttctgacagaatttcaaaatataaattccctgtggtatttgccttcccgaatggacatattaaggacaaccggccattaattatcggaagcgaggttaagctaaaggttgatgataaagtaagaatagatttttaagtggtatcactctcctatctccagactcttaaatactgaatatggcaaaccataatgattttggaaaaatggcagaggatttcgctgttgaacatctcaagaagtgtggctataaaatcctggtcagaaattttcgttttcagaaagctgagattgatgttattgctgaaaaagataatcagattatcgttgtggaagtgaaagcaagatctacagatgcctttatgctccctcaggaagctgtcaccaaaacaaagataaagtctattgtttctgcagccaatcattatatggaggaatttaataaagataatgaagtaaggtttgatattatttccgttcttcctgacggaaacaaaaatttaataattgaacatattgaagacgcttttgaggcgtttgatgccaattagatatgtattatctttgagtataaaataattaaaatttactacatgccctttgtaagaattagcctgcctaaaacgctgaaacaagaagagaaagatcagatttctatttctgtacatcaggctcttatggacgaatttaatatcccggctgatgattattttcatgttatagaagaattggaatcacaccaggttaaatttcctcaaagctatcttgacatcccgcatacaaaggaaatcatctttatacagataaccgcaggaaaagggagagatttcgaaaagaaaaaaagattatatgcttctattgcagaaaaaatagcagcatcaactacaattacaaaaaataatatcattattgtgttaactgagaataacggacaggaagactggtcgtttggaaacggtggaatacagggagcaaagcatatcatttaagaagataaaaatatgaagacaatattgatcaccggagctacttccggtataggaaaagccactgccgaacttcttgcaaaacaaggaaacagaatcattatttgcggaaggagaagtgaagtgctggaatctgtaaaaactgaactttctcaatttaccgaaatatttagtttaaaatttgatgtaagaaatcttaacgaagtggaatcagccatcaattctctcccggagaactggaaagatattgatgttctgatcaataatgcagggaatgcccacggattagatccgctatcggccggtaaaacggatgactgggattctatgatagacggaaatgtaaagggattactctatgtttccaaaatgatcattccaacaatgaaaactaaaaatttaggtcatattataaacatcagttccgtagcagcaagacaaacctatgcgaatggagtagtgtactgtgcgacgaagaaagcagtagatgttatttcggaagggatgagactggagcttactgaatttggtattaaagtaaccaacattcagccgggcgctgtagaaacggatttttctttggtaagattcaagggagacagtgagagagcttcaacagtgtatgccggctatgaggctctgaaagcggaagatattgcagacgcaattgcctactgtgtgaatgctccgaagcatgttaccatttcagacatgacgatctatccaagtgcacagtcagaacccagaacgatttatagaaaatagtccaaaataatggagtaaatttgcagaagattaaaagcggtttgccttttgtaattttgcaatttagtttaaaagaaaaaaatgaaaattctatatctggaaacatcatccaaaaactgttcagtagcagtttcagataatgagaagctgttatgcctttgtgaagaagtttccgaaaattataaacagtccgaaagtttacacacctatgttgaatgggcattgcaaggagcaggtatttctcttaaagagattgaagcggtttctttaggaaaaggtccgggatcctacactggtttaagaataggtgctgcttcggcaaaaggattttgttacggactgagagtccctcttgtagctgttaattctcttgaaagcatgatagagccgtttttaggcgataactacgatctcgtagtgcctttagtcgatgcaaggagaatggaggtttatacggccgtttatgacggtaaaacagggaaggagttatcggagacagaagctaagattttagatgaagcttcatttgaagaattcaaagataaaaaagttctgtttgtaggggatggggctaaaaaagcaaaagatatcctggatcttccggatgctgtttttaaagacgatgtttatccttctgcacaatatctgatcagaaagacactggaaaagatagatcaaaaagaatttgaagacatggcttactttgagcctttttatctcaaagatttccatggagtaaagaaaaagaaaagcgaagaataaatcttcgcttttttattttattgaggtcttggtggtattttcgaccctgattttgtttcgtttgatttctttggattttgctgcccgggacttgattgcggagccgtattattcatattaggattctgagcactgtccagcttctggattttcccgctattcatttgcggaatacctgtattctgggcattaggctgtacaggaactcctgatggctgctgaggaatagcatttcctttattatccgttgcctggaaactcaggtcgcttttcaggtaattcagcatttcttttgctcttacaccttccggtgttttggaatagttcaacgcaatctgttcaagctgaagaatcattacttccttaccactggatttcccggcattgaaggcattcaaaaggtaaagtttaggaaccagtgcatccttcgggaacttctggatggcctgatcaatgacatctttactttccgtaaacttttccgactcaaacagggcatatgcctttttatattcgttttcaacttcctcagttgattttacaaacgacttatttttaggatttcttgcaaactcggcataagaagtataaggataatccgctaacagaatttgttttgctctttcagaagcctgaggatttttttcataattcatggcaaaaatctcatacaatgcctgtaacattaccttttcttccggctttacatctacaaggtcataaagcgttttagtcgccaggggagtattggtaaaatagttctgatacataataccaagtcccagtgaagcggtatccctgtccttttttaactgggacaatttgccctgatcagtaggaatctgttcgatataataagcaggctcaaaacgtcttggattaggtgctgaagtaactcccaaagcttcattcttcatatcttcaatagacgccatcttcttagaagaacgccagttgtcagcaagagcacggtctccccagatctgcttaaatgaagaagttcctttgcttacagttcctgtattgctgaagtagaaaccttttgttgttaccccaaaatcttcaaaagaattaccactgttggcaaaaacagaattggcgctgtaatctcctgtatcaaaacctttacttctttcagcacgtcttctttcctgttccgccttttcttctttgatctttaattttgcaatatattttgtgaaataatcggtcttctgagcatcatccattcttgccagagaaagaatactgtcattctttttgatcagatagtagtttttggaaatctttttaatgtattcggactggtctttcaataagatttttgaaggctcataagtcattactgccaatgcagaatcgtaataacttcctgccccgatataatcattcttatccaggtagtttttccctatttcataataagtcagtccacggatctggggatcagaaactttctcaaacagtgattttctgaagaattgctgagcttcatctttttttccagccttattagccatgagacctaaggcatagtaaaattcattctttctggaaccataagttcctttcttactgattccttccagataattcttcgcgccggcatagtctcctttaccgttaaaagttttggcgattgcaatctgtgattttacttcaaattcgaaatcattggcatatttgtatgcggcagcgtagctttctcttgccttatcattctggttcagattttcataaacctggcctctcagataagcaattctgcttttcagttttctgttgttattcagttcaaaagcattgtcaagttccctggcagcctcttctttttttcctgcatcaagcaaagattcagaatagtaaatactcaggagctttgcgtagcttttattaatatcgtctcccttcagttttgcaaaagtttcatgcgctctgtggtaatccttgatcttatcataagcaagcccctgataaattcttgccagtgcaatccttttatcatctttcatgtgcgtgaagacataattaagcgcatccagtgcttccagggatttaccacggtaaattcttgcctgggcaagaatcatataggcatcaaaaatctgcttgtttttctcttcaccatttctggttaccgaatatttattaatagcttttaaagcttttgcttctgcaatttcaagggtagtagcgcctttgctctcctcaccgtcaggtcttgatggtccgcctcccggaggcccgccaggaatattaggaactcccgaattgcctcttcccgaaggtctgttggctacttcagccatcttcatagaattttctgcaaaagcttcagtctgtccaaggtcacttcccaaaggctgttcttcataagtcagaataggaatataaggtgcatagaaattatccttatgtcctttgtctctggttgtaaattcactgtttaatgcatctttcgcattaaaaagagtattataatatgtggaaaatcctttcaatactcttgaacgctgctccggcttttttgttttggtagcacaggaagcaacaagacatatgactaaaaggaataatatattctttttcattattcaatataactcgctaatctgctttttattatcagcagtttgatgattttgtaaaaataataaaattttataatgaataatatttatatttccgcaggaaatattttatttcttctttaacagatatccggaatcctaaaaatcgtttaaatcaaagcggtttctttcaaaattttgtaaacgagatgagtaggaagccccataatcgtataaaaacttcctgtaagacttgtgatctttgccattccaagccattcctgaataccatagcttcccgctttatcgaaaggcttgtaattttgaatataatagttaatttcttcatctgtaagcacatccagtgtcacatccgctacatcagtttttgtaaaagattgattggcagttttgatggtaattcctgtatacacctgatgcgttcttcccgaaaggctctggagcattttaaaggcatccgcttcatctttaggcttaccaagaatctgatgatcaatagctactacggtatcggcagtaagaagaacttcatctgcttccagacttctgaatgcatcagattttaaatcagaaagataagatgcagcttcttctattttaatgtgctgaggaagtatttcttcacaatctattttgacaacttcaaattcaaaaccaaggctggaaagaagctcttttcttcttggtgattgtgatgctaaaagtaatttcatgccgttaattatacagattgggtattatcatcatgccagttaccctgaactttcatcacctgttctatcacgtcacgaaccgctccggttcctccttttttaggagaaatataatcagagattccttttacctcaggaactgcattttcagggcatgcagcaatagctgaactttccataatatgaatatccggaagatcatcacccatggtcagaatttcttcatttttgagattatattttttcttaaaatcttcaaaatcatctattttattgtgggatttcggatagtaatcctgaattccaaggtaattgattctgtgttttaccatttcatcatttcctcctgtaataacaccaatcagataattgttttttaatgccttcactacagcataaccatccagtacattcattaccctgcacatatttcctccgggaagcagataaacgcttccgtctgtgaaaactccgtcaacatcaaatacaaatgccttaatatcttttaatttctctttatagctcatacattttctgaatagaatgattcattgttttataaatcttaaggctctcgtcctttaataactgttcatgcagctgtaaaatcctgacatcatttcttacggcaggtccggtttgtgcttctttaggctcaattgtatggattttctgaaccgtttcatcaatcagcggtaagaaatagtcaaacgggatttcctgagagtctgaaatttccttggcccttgaaaaaaggtgattcacaaaattgcaggcaaaaacagccgtcaggtggatatattttcttttttcatgagtactttccattaccctttccgaaatttttgaagcaagatccaacaacagtttttggtcttcatcattttcagcctctacaaaaaacggaattttttcatattcaagttctttggattttgaaaaggtctgtaaaggatagaaactggatttccggtattcgccggtaagaatttctttaggaagagatcctgaagtatgggcaaccaaaaagtcttttccgggtatgatctttgaaacttcttctacagagtgatcacttacacagatgatgtaaagatctgccttttccagacgatctgtggaataaggaatatttaattcttcggaaattttacttaattctttttcgttcctcccaaatagctgggccacgggaatacctttcaaagtgaaagcttttgccagatgataggcaacatttccggaaccgataattacaatttgcatataacaaatataagattttaagccgagccgggaaaggaagatcactttgaaaatcctgtacttcaatacaggcacgtttattgcgtaagtgtctcataatatttttaatatttaaattgaaaattgaataattaatttaactttcagttatttttgtaatccaaaacaatgtaaggcatcttatgaagattaaggacgcggaaattatttcgttgatgcagaatccacggacccaggataaaggtgtccgtgccttgatggatgcctatcaaagcagattgtactggcacataagaagaattattgtggacggagatcttgcacaggatactttgcaggaaacttttattaaagcttatcagaattttcatcagttcaaaaatgatagccagctgtatacctggttgtacagaattgctaccaacgaggcactacagcaggtcaataaaatgaaaaagatgcagaaaactgatgaagacccggattatcacatgcagaatcttgtagctgataatacagatgatgatgctgaagaaatacagattttactgcagaacgctatacagagcctgcctgagaagcagaaactggtatttatgatgcggtattatgatgatttgccctatgaagaaatatcaaagattgtagatatgtcggtagggactttgaaaacgaattatcattatgccaaacagaaaatagaagattatattaaagaaaattacgaaaaataatttttgatccaacaaagatgaaagagttcgacatagaaaaattagaacgtaaaaacatttacacagttcctgaaaatttattcgaaaatattcaggagagcgttatgaatgacataaagacaagtaaaaaaggacctgtctttaagctgaactggatgtatgcagcggcggcatcactggctttgatctttggagcaacttttgtttttaattcagataacgattctacggaacaaatactgaactccaaaacaacgtatgtggccaataacggagaacccaaaacagaaagtgaactggcctatgaaactttaaaatctgatttaacttctgttgaaaataatgatcaaacagttgaaaatcaaaaaaataacaattcatacgcttcaaaaagcgttcacgaaactgaaaaaacaacagagacaccaaaaccggtgaaaactgtaaataaaaaagaagaaacacgaatgaatgactatctggattcgttttctaattctgaaattgcagaattagcaagtaattcgacccaggacgtttatttggatatttataattaaaagaagatgaaaaagatattattgacgtttttgattatttacggctttggattaaatgcccaaagaacagattatgattggaaaaagatggatcctaaacaaagaaaggaagtcatcaataatctttctcctgaagagagaaaagaacttctgaaaaaattcagaaacaatatgatcatggataatctgaatgtcgatccggaagataaagccgaatttacacaattgtataatgaatatctggatagccagaagcagataaaaagtcagtttaattcaaactttgatccggaaaccttaacggatgaggaagctaaggccaaactacagcaaagctttgaagtgggacagaagctgctggataacagaaaaaaatatgcagacaaaatgcagcaggtgataccctgccaaaaagttctgaagctgtttcaatcagaaaaaatgatgaaggataaaatggatgaaagaagacctcatggaaacaataataatgcttcaggaccaaaacaaaacccataatagtttatttttttaatgttggacggctcttacagatatttctgtgagagccgtttaattttgcttcaaattcctatttttgctgtagttaaaacatgaattatgagaaacttttttttccttttacttatgtcagtttttgcatcagcgcagaaaatagaaaccattgatctttcaaaatctattaaggatggcaaaaattctatcaagagtcttacggtaatagatcaaagggaaaatcaggaaattggaatggttatgcaccataaggatgaggtgaaaattattttcgaaaacggtgccagcaaagacatacaggattggttttataaatacaatccggtaagaggaaatagtgatatggtcattctgttggagaagttaaatatttcagaagataaaaaagaaaagtattctatcggaaagctagaattaaaggcaagtacatttattaaaaaagaggacggatatcattttgttgacagaaaagataccgtagcaacagtttcatcgcgtataacaccttatctggcacaaagtctggcaagaaaagtaactttaattcttactgatctttttaaagaatcttataaagcaacaccttgggaacttagtatttcagaaaacgagctttcagactatgttcctatattaaaagaaaaacttagtattctgaaagcagatgaattaaaagaaggagtttataaagactattacagtttttttacacacaatcctgaacccggatttactttgcagattaatgataaaggaatcgttacaaaggccgtaaaaggggaagaaaaaacggcaataaggcatttttatggttttgtgtataaaggcattgcatacaaaaatatccccgtgggttacactgagattttcaaagatgatattggtgtttttattgaggtgacaaaagcagaattatttcctgaaacggcaacaacgggggttacaattggtgctgctgcaggaggtctgattggtggtgttattggtgcagtgatagatgtcagtttatcaggcaaaagaaagaatactgtaggacctaaagtttatcttgatccttttaccggaaattatgtgttaccggaagactttggcaaaacaaaataatatttgaaaagggggaaagttttgcctctcttcttattgttatctgtgtttcagttaaaagaaagaattaagaatgaaaaattctcctgcattttcttatctttgcaaactacaagattcttaaatgaaaaacatacgaaatttttgcataatcgcccatatcgaccacggtaaaagtaccctggcagaccgtctgttggagtataccaatacagttacccaaagagaattacagtctcagacgcttgatgatatggatctggaaaaagaacgtgggattacgattaagtcgcacgctatccagatggattatgaatataaaggagaaaaatatattttaaaccttattgatacaccgggacacgttgacttttcctatgaagtttcccgttctattgctgcctgtgaaggagcgcttctgattgtagatgctgcacagagtattcaggcacaaaccatcagtaacctctatctggcattggaaaatgatctgacaatcattccgattctcaataaaattgaccttccgtctgccaatcctgaagaagtaactgatgagattatgaatctgatcgggtgcgactatgaagatgtactgagagtttctggaaaaacaggagaaggggttcataaccttttggagcagattgttgaaagaattcctgcaccggaaggagatcctgacggtccgcttcaggctttgatcttcgactctgtttataaccctttcagaggtattgaagcgtatttcaaagtagtgaacggaagcattactaaaaatgaaaagatcaaattcttcgctacaggaaaagaatatggagctgatgaagttggaacattaaaacttaagcaggttcctaagaaaacaatccattgtggagatgtaggttacctggtgtcggggatcaaagatgcccgtgaagtaaaagtaggagataccatcacttcttttgacagacctgcagcggctcctattgatggatttgaggaagtaaagccaatggtatttgccgggatttatccgattgattctgaggactttgaagaactgagattctctcttgagaaattaagactgaatgatgcttcccttgttttcgaaccggaaagttctgccgctcttggttttggtttccgttgcggattccttggaatgcttcacatggaaatcgtacaggaacgtcttgacagagagtttaatatgaacgtgatcactacggtaccgaacgtatcttattttggatactccaaaaaagaacctgaagttccgattctgatcaacaacccttctgaaatgatggatccgtctataatggacagagtggaagaaccgtttatcaaggcttctatcattaccaaatctgatttcgtggggcctgtaatgactttatgtattgaaaaaagaggagaaattgttaaccaaagctatttaacttctgaaagagtggaattggttttcaatatgccgcttgctgaggtagtatttgatttctatgacaggttaaaatcaatctctaaaggatatgcttcgttcgattatcatccaatcggattcagagcttccaagcttgtaaaaatggacatcctgatcaatggtgatatggtagatgcactttcatctttgattcatgacagtaatgcctatcacattggtaaaaaaatgtgtgaaaaacttcgtgagctgatcccgagacaacagtttgatattgctgttcaggctgccttgggtacgaaagtaattgcaagagaaaccattaaagccttaagaaaagacgttaccgcaaaatgttatggtggagatatctccagaaagcgtaagctattggaaaagcagaaagaaggtaaaaagaaaatgaagcagattggtagagtagaagtaccgcaatcagcgttcatggctgtattaaagctgaatgactaattcattataaaataaaaaccgcttctgataatgaagcggtttttttgttgattttatttcttacgggtatattttatttccatggttttgtactcttttcctgttttggagtccgggccgtacatttccagcttttgggtattgtcatccacaaaggtgaaaacttccctgaaatcacaatcttttccaggtcttgaaggatctgtcatttttcctttaaattcaacagattttgttgaaggattccattctccttcaccatgcatgattccggttcccatattgtcaatccatgtactgataaatttctttttggaattgtcatatcccacaatgctcattccttcgaaaggcattcccataaagttgcctttatggttactgatctgataacgtccgtcatacatcattttattggtagtctcagatttactcatcataggctttcctccgttttccatccacatggtggtttctcctgtccatattccatcagattttgccagcattttatgcatttctcccggagtagagtactccatccacgctttcatagctgttgcagaatctacaggcttccatttggattttgcggctgtagaatcggctttatcagcactgttggctgctgttgtttttcccttctcacaagccgttaataaaaaagctgcgacaagaattgataataaatttttcataatggtttagttttaagatggttagaatgataacttaaagataggaacttttattatatccctgattatttttttactttgcacataaatcgtaactttgtgtattcataacgcaaatcaatttatggagtctccaaaaaaattacaggatataaaagtggctgtagatgccgtcatcttcggatattttgataaaaaagaccttcagatccttctgattaaaagaaatattgaaccttttaaaggaggttgggcattgcctggaggacttgttcttgatgatgaaagtgtggatgacgcagtaaaaagagaactgtatgaagaagcaggtataagacccgattttctggaacaactgtatacatttggtaatctgggtcgcgatcctagaaacagagttgtttctgtagcctatcttgggcttgtgaatccatcttatcatgaactttttgcagactctgatgctgaagatgcacaatggttcagtattaataaactcccttctttggctttcgaccacaaaacaatcattgatacagctttaaaaagacttcgtacaaaaattcagtatcagccaatcggcttcaatcttctcaacgaagaattccccttttctgatcttgaaaacctttataaaaccattgttggacaggaaatcgacagaagaaactttcgtaaaaaaattatgagctacgggctgctaaacgaaaccaataacgttaaaaaagaaggcagcggcagacccggaaaactttttactttcaataaggaaaaatataaagagcttgaagagcaaggcttttatttcgaaattaaatagatttctaaacacaaacttcacaaatgttttgacaaatattcactaatatttatgacattcttgaagccacagtataaaatatcaattgaaaacattcaataggaacgggctttagcccgtttttttatatcatctcattcaactggcttcaacctaaatgcatcaaatttgtgtcatttgtgatcaaagtctgtgttatctgtgttgattgaaattaaatttttatccttgaaaatcaattaattataattattagcgtaaaaataacgcaaaaaaatttggttactaaaatgatattcttttaaatttgtgtcaaaataacgcaatcatgaaatacaccttacaaaatattacggaacgttttcagaagaaagaaaagttaaaatttctgtttttctggggtcacacggcgaaagataccattaccaaatcatgtttcagccagtggttccccggaaagtttgaagaaaatggtaccatttacaaaacagcagaacattatatgatggcgggaaaggccagattgtttaatgatcctgaaatagaagaggaaattttaaaagcaaatacacccaatcaggcaaaagctctgggtagaaaagtaagaaactttgatccgaaacggtgggacgaacataaatttgaaattgttacccggggaaatcttttgaaattctctcaaaatcagaaatttaaagactttcttttgtcaaccggagacaaagttctggtagaagcgagtccttatgacagaatttggggtatcggaatgctggaaacggacagcagagcagaaaatcctttgctatggaacggagaaaacctgttaggatttgctttgatggaaataagggatgaattaagaaggtaaaaacacaaccagacacaaaatattaattatggaaaaaatagaattacacccacagatatttctgattgaagattttctgaccgaagcagaatgtgatcattatatcagtctttcacaggagaaagtttttgaagaagcaaagatcaatgtattcggccgccagcagatgaataaaggaatcagaaataatgaccgattgatgatttttgatacaacaattgctgaagagctttttaacaaggctgtagagtttctgcctcaggaacaggatgaataccaggtccttaactttaatgaaatgctcagaatttataaatatgcgcccggacagcagtttaaaatgcacagagatggaagttatatacggaatgaaaatgaaaaaagcttttacacctttatgatttatctgaatgaggattttgaaggcggagaaacagaatttgagaacttatttactgtagctccaaagaaaggaacagctcttattttttatcatcccctgagacatgaaggaaagactttgatcagcggacagaaatatgtgttgagaacagatgtaatgtattcaaaagtataaatcagccataagagagaaggcattactatgtcttgtttgattagcgtaatattaacacaaataaaaatatttgatcatggaagatgaattaaaacccagatttatcgaatcattacaaagaaataatgatcagatcagagaagaccgggcaaggatcatcggagcagattccgaattgatctatagacgaagagttgaagatattgaattaaaaatcaaaagactcgagcatgaacaggaagggcttattgatatcagtcctttggacaggaacagtctgacttttgtggatttcaatcccgaagcattcgttcagaaagacatggaattatcattaacaatcagaaatctgaatattcagcttgaagtaacccaaaagagatttgaatatttatttggaaaaacattatagtcatgggaagtacaagatatgatttagacgctcgttatgacagagctagaaaagcaggttacggaacaaaatccgcaggagaaattttcacccagaatgccaaaagaatggctcatgaatcgatgaatccacatggaatatctttcagggaatccagagactcggaagttcatccgaattcggttccgattattttagggctggatgttaccggaagtatgggccatattccttacgagctgatcagggatggattgcctaaactgatgggcggaattatccagggaggtgttcccgatccggccttattgttccttggaatcggagatcatgaatgtgatggctacccacttcaggtagggcagtttgaatccggagatgcagaactggatatgtggcttacgcgcacttatattgagtcaggcggtggcggaaatgctggtgaaagctatctgttagcatggtattttgctgcatttcatacgagaacagatgcttttgaaaaaagaggtcagaaaggattactgtttactgtaggtgatgaaccttgtttaaaaacactttccgcatctgctatcagggaaattatgggaaaagggcagcaaacctacacccattctgagctgctggaagaggcaaagaaaaaatatgaagtataccacatcagtgttttgcattccgatcaggcattgagagcggacaggggctggaaagaattattaggacaaaactgtgtatctataacagatcacagagaaattccgaatgttattaaaaacattatctgtgataagtttaaaaatcaaagtttcggaacaatgggaacaggagggttagatcagtttcaaatgctttaaaaatctgtcaatgtcatgagcaaataggaatgacagagacaaaagattaaaaaaaataaaagtcatgaaaaaggcacaaatagtaataggacttggttttggtgatgaaggaaaaggaattactacagatttcctggcttctcagaatccggagaccattgtgatcaggttttccggaggccagcaggcagcacatactgtgatgattgatgatagaaaacatgtacattccagttttgcgagtggtgcacttcgtggtctgccttcttatttcacggagcattgtaccatccatccggtttttctgctcaatgaaagagaagaattaaaagcaaagaatggaaatattgaggtccatattcatccactggcgaaagttacgactccttttgatgtatggcagaacagaacgaatgcaagaaacctcgaacacggaacctgcgggaaaggaataggagccacgatgaaaagacacgaaagcccttataaactatttgctgcagacctgatttcacccggagaaatgctgatggaaaagctgaaaggaatagcctattattatggctttacagatgaaaacgaaattagtgaacttttacagccttttttagaagctattgatagtattgattggagaataaatgattatacctggttggcttcattcaatcaccttatttttgaaggaagccagggtattttactcgatatggatcacggtgtttttcccaatgtgacctatgctcataccacttcaaaaaatgcctacgaaatctgtaagcttttaaaaattgaagacattgaaatgtattatgtcaccagaacctatgcaacccgacacggaaacggctggatgagcaatgaaaaagaaatgaacctgagacacaatgaagaagaaacctgtacatttaatgagtatcagaaagaattcagaaccggggaaatagattacaaactgcttaattatgccttaaagctggatggagcatatgtatttccgactaaaaagaatttagttgttacctgtctggatcagattgatgagcaatttaaattagaaaatttgagtgttgaatttaatgctgtttacggatcctattctccgtattcaaaagattttaaacagattttttaatttcaaaagggaatcaggaataagataaaaaagcattagttttatatcgaatgataggatagagaatgattaatgattgagaaataataaccatgaaaataatacaatatataaaaggagatgctacccgtcccaatgccgaaggaaatataataattgctcatatctgcaatgatataggaggctggggaaagggatttgtcactgccatttccagaagatggaaacaaccggaaaaagaatacagagagtggtttagaaacaataaaaattttaatcttggagaaatccagatcgttcagacagaggatgatatctgggtatgcaatatgattgctcagcataaaattatcactcattcagaagttccacctatcagatatgatgctgtagaagagtgtttattaaagctcgcgcatgaagctatccaacaaaaagcttcggtgcatatgccgagaatcggatgtggactggcaggagggaaatgggaggagatagaacctattattgaaagagcactgcttgcaaagaatgtggaggtgtatgtatatgactttgaataaattaacaagcaatgaaagaatttgaaataagagcagactataaaaatgatactctcatcgtttaccaggcttataataaagccattgcacaatcagctgtggagcatcagaaatttactgctccgttttcgttcaacaggatgacctggataaagccttcttttctctggatgatggaacggagcaactatggacagaaatccaatcaggaatgtactctggcaatacatattaaaagagaagcctgggaaaaggctttgggcaaagcgattcttacttcaccagaaaaaagagtctatcccgatccccgaaattgggaaaaagattttgaaaatgcagagatttatgtgcagtgggatcctgaaaggaatattaaagggacaaaactgaattaccgttccattcaggtcgggattagccggtcgctgattgaggaattcaatgaagaatggattgtaaaaatagaggattatactcctttggttaagaaaatcctgaatcttaccaaatcgggagaatttgacaaggcaaagaaactgctgcctgtagaaaaaaactatcctctgtcagaagaactggctcacagaattggagcttcagtgtaaaaaaagaaaaaatcatgaaaacaacaacattatacagaccggtaggagaaaaggaaatgatattgattatggaaagcggatttaaaagtttccccccaagattagaatggcagcctattttttatcctgttcttaacgaagaatatgcttcagaaattgctgaaaaatggaataccagagatgaagccggaaactatcttggttttgtaacccaatttgaagtgttggaagaagtcgcagatcaatatccgatacagaatgtcggggccagaaaccataatgagttatgggtcccttctgaagaattaaatagctttaataaagcaattataggagacattaaagcaaccaaagtatttataggtgataattttgaaaaaacagaaaatactgatttggaagaattgatgttaaacattaaaaaactaactatgaccaataaaggaatggcaaaagataccttggatatccttgccagaaaatattatatcaacaaacataacgaaaaaataaatatagaaaacgaactggaaatcagtaagaaagaaaccattcttttcactccggaacacctttccgagatgatagaacttccaatgccggaaactgattttgaaacaaaaattgaaacctggaactgcagttctttaaaagctattttacaattggcaaaagaagaagatcagcacaaactcatgtgtctgaacttcgcttcagcaaaaaatcctggaggaggatttattaacggggcagaagcgcaggaagaaagcctggtaagaacttccggactgcatgaaagtctgcttcaagcctgggattattacaaaattcaccgtgcgatggaatcctgtttttatactgacaccatgatttacagcccgaaagttccggtgttccgaaaagacaaaggagaattactggataagcccgttctgtgcaattttattacttctcctgcagtcaatgcaggtgtggtaaagcgccaggaaccggaaaaagctcatgaaatacttgatgcaatggatctcaggatggataaaatgctttcccttgctttgcatgaaggaaatgaggtattaattttaggagcctggggctgtggcgtgtttaaaaatgatccaaaagaaattgcaggattatttaaaaagcatcttcagggtaaatataaagataaatttaaaagagtggtttttgcggtacttacgaaaaaagaagaaatgctgaaaccgtttgaagaaatacaatgaaaattgaattaataaaaggggacatcacaaaaattcagtcggatgccattgtcaatgctgccaattcatcattacttggtggaggtggagttgatggagctattcatagagcgggtggtcctcagattttggaagaatgcagagagataagaaacagacaaggcaaatgcaaaacaggtgaagctgtagttacaaatgcagggaatttgccggcaaagtatgttattcatacagtaggctctgtttggaacggaaatgaagaaaaggaatctaagcttcttgctaactgttactatacttccttgaaattggcagaaagtcttggtgtgaaaatcattgcttttcctaatatcagtacaggagtttatagatttccgaaagaactggcaggaaaaattgctgtagatgaggtcagaaattttaagtcagatatcattgagaaagttatttttgtttgctttgatgatgaaaatgaaatgatctataaaaagctattagattaaacctatgaaaaagctaaccatattaagcggtgccggaatcagtgccgaaagcggaataaaaaccttcagagacggagacggtctttgggaaaatcataatgtaacggatgtggcaagtccggaaggatggagaaaagacagagcgttggttttggaattttacaatcagagaagacgccagcttcatgaggtaaagcctaacgaagcacatcaattactggcaaaactggaaaaatattttgaggttcagattattacccagaatattgacgaccttcatgaaagagcaggatcttccaatattcttcatctccatggagaactgttcaaatcatgctcatgcaacaataaaaacctgatttatgaacaaaaagatgatattaaaattggagataaggccgaagatggggcacagttaagacctttcatcgtttggttcggagaagatgttcctttgtatcatactgcacggaaaattgtcaaagaatcggatgttttactcgtaataggaacttctttgcaggtatatccggcagccggactgattcatgatatcaaagacgattgtcttctaattgtgatcaatcctaatgaaacaggatttggttacggacagagagctgttataatgaaagaaaccgcaacacagggaatgaaactgttgtttgataaactggtaaaccttgcctgatggaaaatatattaaaagcaggaattatgggtgtttgcatcggagacgctcttggggttccggtggaatttagaagtagagaacagcttaaacgatctcctgttactaaaatgcttgctttgggaactcatcatcaacctgcaggaacgtggagtgatgacggctctttaacgttatgtcttgcagatagtttgtgtaatggatatgatcttgaaaatatagcattgaaatttttgcaatggtataatgcagagatatggactccgcatggtcgtgtttttgacataggtattgcaacttcacaagcaatttacagaattggaagaggtgtttctcctattttatgtggaggaaattcggagtttgataatggaaacggatctttaatgaggatgatgccattattattttacattaagaatttgcctattgagaagcgctttgatattataaaagacgtttcctctattacacacagacatatccgttcaattgtagcctgttttatttatttggaatttgctttggaaattctaaaaggaaaagacaaatgggatgcatacaggacaatgcagaaaacagttcgggaatttctggaccataatccaatttgttcacaaaatgaaatggataaatttcaccggattttagaattaaaagtaggtgaatatgatttagctcctttgtataccttgcaggaggaggaaataagttctggcggctatgttctccacagtctggaagcttctttatggtgttttttaaactcagaaagctatgctgaagctgttttaaaagcagtcaacctgggagaagatacagatactaccggagccatcaccggaggaattgccggaatttactacggatatgaaaatattcctgaggagtggattgcagagctggtgagaaaggatgatattgagaagttatgtgagaaattacaccaaaaattaatgaattaaaatgcaccaaccatgaacgaaatagaaaagaaaaaaataagtaaatttttaagcctgatcttacggcatcagccggaaagtataggacttacactggatgaaaacggctgggcagatgtagaagaactgagagaaaaatctgcgaaaagaagaatacattttactcccgaagaactggatgaggtagtagataccaataataaaaagcgtttcgcttttaatgaagataaaaccatgatcagagccagtcagggacattctattgatattgacctggctttggaagccttacagcctcctgactttttgtaccacggaacagcagaaaccaatattgcttcgattctggaaaaaggaattgagaaaagaaccaggcagcatgtacacttaagtgctgataaagaaacggctgcaaaggtcgggatgagacacggcaagcctgtgattcttaccatcagaaccggaacaatgcatcaggatggactagctttctttcagtctgcaaacggagtttggctgacagattttgtagatgcaaaatatatttcaaagtaaaaatgagcagaacattagtagttggcgacattcacggaggatttaaagccttacaacaggttctcgaaagagccggagtcacggaaaatgatcaggtgatttttctaggagattatgtagatggctggagtgaatcttccgaaattataaagttcttaacagaactgtcagaaaaacaggaatgtattttcatcaaaggaaatcatgatgcctggtgcgaagattggctggcatcaggcaaaagtcctgatgtatggctttttaacggaggaagaagtactgttgatagttacaaagattatctcccggaaaatctggatcttcatcttgagttctttcaaagaatgaaaaactatcatattgatgatgagaaccggttgtttattcatgcgggttatgcatccatgcatggtcctgaaagagaggtctattccagtaattatcgttgggacagaaccctttgggaaaccgctgttgcaatggataaaaagctacagagaaactcagcattatatcccaaaaggctgctgttgtacaaagaaatattcattgggcatacgcctactcttgatattggaattacggttcctgccaataaagctaatgtctggaatatggataccggagcggcttataccggagctttatccatcatggatattaatactaaagaattctggcaaagtgatccgctcccttctttatatcctaaagaaaagggcagaaattaatactattgagaacaaacctaacaggttttcaaaacctgttaggtttctgttttaaaataattttgcattttcaatctttcacaattttgcctgccaacaggttcctgtttctcacaaaagataactacatttaaagtctgaaaatatgacttcaatgaaactgaaatatcttttattcaccctgagttccaccttattttttgcacagaaatcatttcagactccttttgaaaaagaaaatggtaatcagacggttacctacgatgaaatgaacagctactatcagaacctggctaaaaatttcaataccattcaataccttaaaaaaggagaagatgacaatggaaaacccatttatgtagtggtttataatcccttttctgaaaaagatcttgaaaaattaagaaaagaaaaagcgattctctttgtcaacaatggtattcacccgggagaaccggatggtatagatgctaccatgatgctgatgagagatcttgccacccaaaagatcaaaactccacagaactttattattgctgctatttctgcttacaatgtcagtggaatgcttaacaggggttcttactccagagccaaccagaatggtccggagcaatacggtttcagaggaaatgcaaggaattatgatctgaacagggatttcattaaagcagattccaaaaatgccagaagctttcaggaaatctatcagtggctgaaaccggatgtctttattgataatcacgtcagcaacggagcggattatcagtatacatttacctatatttctacctttaaggagcgtctgggaaatactctcggaaactatttctacaatgagtatcaggctaaaaatcttgaagatatgaaaaaactgggctatgaaagtactccttatgtaaacattcacggagatatccctgaagttggattcgcctcatttgaagactctcccagatattccacaggatatacttcccttttcaattctttaggaacggttcctgaaacccatatgctgaagccttacgacaaaagggttgatgctacctacaaatatatgctggtgaatctgcagaatttagataaggactaccaaaaaataaaacagcttcgcattgaaaacttaaaacagtatcaggctggaaaacaatacggaatccgctggaaaattgattctacaaaattctctacgatggattttaaaggctacgaaggaaaatacaagccaagtgaaatttcaggtatgccaagactgtattatgacagaaacaagccttttacaaaaaatataaagctctttactaccgcggtcccaacgggatatattaccattcctaaatattatgtgatccctcaatcacaatacagggtactggaagagtttaaaagaaaccatattcagatgaagccgattcagaaggacagtactttaacggttgaatcttataaaatcaaagatttcaaaaccgttaaaaatccttacgaagggcattatctgcattttgaaactactgtgaatgcttcagctaaaaatatgacattttctgcaggtgattatctggtttctactaatcaacctggtgtaaaatatattatagaaacacttgaacctgaggcattagactctttttttaactggaatttctttgatggaatattggcacaaaaagaatattattccgcttatattttcgaagatacagccgcagaacttctgaaaaaagataaaaagctgaaagaggctttcgatacagccaaggcatcagataaaaaattgtccgaggacggaacagcacaactggattggatttacagacactctccttattttgaggaaaaaacattcaggcaatatcctgtttatagagtgttgtaaatatttgccaatcagtaaataagctaaaaaaagacgtttcaagtgaaacgtctttttttttattttggtaaacctcttttcaaggctagctcagctcttttaatggccattttctctttccagtccatgtatttctttttgaaattggacttcataatgtcgtcaaatttacgctgtacagtaaggttccacagagagtgtgcctttactgcccatgatttgtcccatgctcgtaaagaaatagagaaacttccgtccagatatttcatccagtgccaccatcctgtaggcatgaataaagtatcaccatgctcaagatagcactcaataccttctacaccgtccagtgccgggaatttggtgaaatccgggttttcaatatcataatcttccagtgcataggttgcatacggaatctggtaaagcctttctttccacttatagtcaaaaagaagaatatgctttcttccgttgaagtgagtatggaaaatatgagccatatcaatatcaaagtgaaggaacgttaccgatcccttaccgccaaagaacatattgggatacttatccagaaaacctcccattaattctttgggagaaatataatcttccagaagtttaggggcatattttatcgggtcaaaaaggaagattctgagatcagtgggctctctttgtataaggtcaatataatctccaaacttcatttttgctgcagatgcattgatgggagcagagggatctgcctttgagctgtcatatagcgggacctccacatctcctacaacctccttcatgtattccatcgtccatttttgataagcaggccatttttttgccatatttttgatgacaacgggccttcttggcttcagatatttttcgtagaaatcttctttcgaaatatcatctacaacatctataggctttaaaataattcccattttataaattttatgttacaaaattattaaatatatattgatgtaccagtttttaatttttttttaatctatgattcaaatcagattttactatttggaacagataaaaatatcaaaatttctattattgctaagaatgttcctttactgatttaataagacaaaatacataaagattttgttacaggatttaaaaaataatcagcctgccatttttataaaattgatatgccaaatatactttttcaggaaaatcatcagtagtgtatacatctgtaaagtgatgatgagtcgattttaaatgtatattttattaaaaaaatcaaaactttaataaatataactaaatttgtagtgataatgatttaacctttatccataaaattcatctttataaaaagtgtaacaaaaaccaataaccattaactaattgagcaaataataagtatgaaaaaaaatatttccttatttctgatgcttttctttacggtgcttacttttgcacaaaaaacagtttcaggaaagatcactgatgatgacggggtggcaataccaagtgccagtgtgacgatagaagaacctggaaaagatgctattctggcctatggaattacgaattccaaaggagaatataaagtgacctttacttcggcagaatccaatgtagatctcaaagtgaaggcctttaaccagaaacctcttataaaacagatcagcaacagcgatcagaccctgaacttcaaaatgcagtctgaagcaacagaaattaaagaagtacagctgaaaaccaaaatgatcactgcaagaggagacaccatttcttacgatcttaaagcgttcaatagcaaaaacgacagaacactggcggatgtaatgaaaaaaattcctgggattgaagtcaacaatgacggaacaatcctgtatcaggggaatgccatcaataagttctatgtcaacggaaaagaccttatggaaggaggttatggaactatcaacaactctcttccaaaagatgcggtacagaaagtagaagttctggaaaatcaccagccggtaaaaatccttcaggataaagtgccttcagatcaggcagctatcaatatcaagcttaaaaactctgtaactatgaccggaagaggggaagtaggaaccggtttcggagatccgtggctttggaatgtaaaactgaccccaatgtttttcgggcagaaaagccagtgggtagttaactataaaaccaacaacatgggtgagcaggtggaaaatgaagggaatattctggcttttgggaacaggtttgaagggaaaagaattaatgcttctcaaaatgattggttaaatgtagaaaatgcagatacaccaaatcttcctgtgaaaagatatctaatgaataatgttcattatttatcagccaattatcttaccaatattgataagaaaaaggagtgggaacttaaagctaatgcaaactatactaataatgctgtaaatagagaatcttatagccaaaaagattattttggtggaacctctaatattgtaaaaatcttaaacaatttttatacagataaagcaaaaggtgaattaatattcactaagaacgctaaaaaagggttttttaaaaataccacaagtttctctcaatattggaacgcagatagaggaattgttgacagaacagatgcaaaaacaggaattcagagaagcgctaatgaaggacttgaatctcctacaacatcattccagaattcattaagtacaattattccttggaaggaaaaaatggtaaatctattgtcctatgtaagttatcaaacagatagacagactttggaagtttctccatcatcttatttggatatcccggggtttaagccagtacctaacacagaatttgccacacaaagtttaagacttaagacttttgaagctaatcattctgccaatattggcttttctgccaaaggatggacttttactcctgaagttggatttaatttcaaaagtacaggtatgatgtccgatttgtcaaatgtgaaagcgattccatctaacaatcctaacgttcaagaccccaaacctgaggcatatagtaatgatttaaactacaccacagctacaccatacggaagtttagggataaattataaaagtgaatcatggatgatctatgctaatcttccggtaaattcaaacaatattaaagcagaagatccattaagacttgtttcaaaatcggtaaataaagtaacgtttgaacctaatatttttgcacaatattcatttgcttcattttggaaagcatctgtaaatgctaatattaataataattttggggaaataaatactgcatattcaggattcttaatgacatcacctggaggaattatcgcaatggatgttaacaacccaattcctcagaataacaacaaatctgctggaacaagattagaatatagaaatccattgaataatttattcttcaatgtcaattacagatattctgatgcaaagagaaacttaatttcaaatccggagatcaatggggctggatataccataatgaaatataaagaacaggataatcacgtattaaataatggatatagtgtagaagtcgggaaatattttccaaaatttaaaacgaacgcatctcttagctatagcaacaatacgacaaaatctgatgcatttttgaatgataaatcttataccaataaaaacaatggccagtcatttggaattaaattcaataacacctatttcagttggatgagtgttgattataatgcaagtcttaccagaacaaaacaaacaagtgttggagaattaaactctaatgccaccagaacagggtttactcataatctaggagttttcttctatcctatggaaaatcatacagttgggttcaattgggatcaggtaaatacaaatgcggcaggtcaaaaatatcataatgggttctatgatatatcctatcagtttacttgggctaaaaagaaaattgattttgaattgaaatggatgaatatcgcaaacaaaaaagttttcgaaacgtatgaaattaatactacaaatattgcatatacaaggtatcaacttcgcccaagccaggttatgctaaccgtaaaattcaactttaaataaaataaaaccaatccatacggattggttttttgttgagatatacttagatattaattaaaaactttgctggtctgctgaaggcccatagcttcccggcaaaggaatattgttcagtctgtaatatacgcccagctgagccctgtgatgggtaatctggtttaaagcatgacgtatggccccgtatttactccagcttgccagttcatggccgtcattttttatggtccagcttgggtttaggtcttcttcagtactgttttccaatgctgtttttgctgactgatagtcttcctccagctttttcataagatcatctctggtggaaagaactgtaggtttgtattctcctttggcaaaatccagttcggaggttttcaaaatagtattcggccattcaaaaacttctacaagatgggtggcaagaggcatcattttcatgcttttttcatgaggagcataatcgttttttccttcagggaatcgttcaataaatttttttgtggtttggaattctccctccagttcggattttaattgagataaggtgtccataatattttgttttttagaaacttaaaggtaagcgttttaaaaatgaaaatgttttaagagaatcataattttttgtaaccgacctggtatcaaaagacactgctcaatctttaaaaataaatttcaaaaaaatgtaacaaaagaagaaataggattactaattatataaacttgctacaatgaaaaagttattctctatatttcttattgcactttttgcttttgcaggagctcaggaatctaaagaaacagccaatcgtttcttttatgaactgacttttaaacctaagaaagattcagcgaaactggataagattattaccattcttgatatcacacccaaaaaatcaatttatcaggattatactatgccggctcaggattctatcattaaagtacagatagaagaaatggaaaaaaccaaatcttttaaagacatgactaagctgattaaatggccgaaattttcttataagattattaaaagctatccggatatgaaggttcaatatgttgacagaatcagcagaaaccttttctcatatgaggatgatccaaaattacaatggagcattttgccagacaaacaaaaagtaggagaatacaatgctcagaaagcaactactgaatttggaggcagaaaatggacagcgtggtttagtacagatattccttttcaggatggaccgtataaatttaaaggacttccaggtcttatcgtaaaaatagaagatgctgataaaaactattcctggcaactgagtggaaataagaagattgaaaactacgatgaattgtcatacgcagataaaatcaatgctaaaatgggaatggtgagcaatacaataacacctacttctaaagaaaagtttctgaaatcttatgaaggatacaaggcagatcctttcgcagagtctcgtccatacatgaccgcagagaatatgagcagaccaatgcctggaacagatggaaccgtaggagactttatgaaaagacttgaaaagcaggtgaaagatttcttcggatctaacgacaatccaatagaaaaagaacagccttcagacaagaagaaaaaataagacttcatatcaactaaattatattttgaatcaccccagatacagcaatgtgtttggggtgatttctttctgtggaacggattctatgcttgactgatagaaaattttaaaatttttctgaaaaagtttgattttattttttattctcatatgtttgtgaaaactaatttaaaaattataccatgaaaaaaatccttgtcacagttctattgacaacatctgcactattatttgctaaaaatgaatctccaaataaaaatccggagcttccaaaagtaaaagaaactgttttagtcgctaagaaaactattgaaaaaacagatcaattacaaaaacctattacattatccgcagctgcagaagagaaagaattaactacagaagaaaaatgcattattgaaattgcattaggtcctgtaattgcgggacctccttaccattgtacacaaatttaatccttaaaagaaaattcttgataaaattaaatttaatcaccccagatacagtaatgtatttggggtgatttcttttatgacaaaacgttatttagattaaatttaaatagcgtatatttgcaggactaaaaattaggctttgaaagagaacggattacataaattaagtggattccctaaaaataaaatggggaagatattgggatatgataacgaccatcttaaaatgcccaataaaattattgaaatgggacttcttccggaaaccactttcagaattttgtatcaggctccgttcagtgggcctatgtatgtagagtttggaacagagaaaagccggattgctcttcgtgaggaagaaggagattacatcattgttgaagaattgaattaatgcaggaaaacaagaaaaaacagatacttttagtcggaaatcctaatgtaggaaagtcgacggttttcaatacgctttgcaataaaaagcagaaaaccggaaactacgccggcgttaccgttgccagtcactcagggaactatgtttataagaacgaagaagtggaggtgatagatcttccaggttcgtacagcgtctacccgagttcagaagacgaagctattttttccaaataccttattgacgagcaggaaaactatgcaggggttgtttacattcttgaagcattaagtttaaaaagaggactgcttctgtttcagcagattcaggaccttggaattcccatgattctgattgtcaatcagattgatcaggcagaaagaagaggcattactatagatatccaaaaattttcacaagcattaggcattaaaattattcagaccaatgctaaagagcagatcggaattgatgcagtaagagaagccgtttacaacaatgaatttgtaaaaacggataaagtttcttttgaaaccccgaatgaacatagagattttattcagaagctggcagcccataaaggttttgacaatgaatataaagcctggatgagcctctcattggggacagatctcggaagaataggctctgtcatggaacagcttaatgagcctgattctaaaagtttggttcctaaaagattacaggttcaggaaactgttaggagatatcagaatgtagacaaaatcctggctgatgttatttcaaaaaaagctcagttcaaagaattacttaccgaaaagctggataaagttttagttcataaattctggggatacgtcgtctttttagcgattcttcttattatttttcaaagcgttttcttccttgcagaatatccgatgagctggattgaagatactttctcatggctggccgcatttacaagcgaacaccttcctgaaggtccagttaattcattgatttcaaatggaatcgttcccggaataggaggaatcgtagtttttgcaccacagatcggaatcctgctgtatttcctttatctgctggaagattccggatatatggcaagagtcgtatttctgatggacagattgcttcgtcctttcgggctaaacggtaaaagtatcgttccgctggtatccggtaccgcctgtgctatcccggcagtgatttctaccagaaatattgagaatgtaaaagaaagattgctgacgatattggtaacgccatttatgacatgctcggcaagacttcccgtatacagtattatcatcgggctgattatttcagaaggaacgttcttaggaataaaatataaagcgctggtcttgatgggaatgtaccttcttggcttcctggtagcattattttcagcagcaattcttaaaagatttatcaaaagcaaaggtaaaacttatctggtaatggacctgccggcctataaaaaaccacttttcggctatgactttaaaatggttttagggaaagtatgggacttcattaccggagccggaaaaataattttcattgtaagtatcatcatctggttcctgagttattttggaccaagccagaaagcagatcagtttgtagctacagatgttcatcttgaccattcttatcttgcgaaaatgggcaaaggaatagagcctgtaattgctccgctcggatacgactggaaaatgggtgtaggaatccttacaagctttgtagcaagagaagttttcgtagggacaatgtctacactttacagtcttgaagatgacgctcctgaagtaaaagtaattgataaaatgagaagagatgtaaagcctaacggagaaaaagtcttcagctttgcaacaggaatctcggttcttcttttctacgcatttgcaatgcagtgtgtttctacactggcagtagtctacagagaaaccaaaagctggaaatggaccggctttcaggtggtcatgatgacaggtttggcatattttgtgtcgatgatagtatatcagattttaaagtaatggactcatcattaatttttcaatacgtacttatcttattaattgtagcattcgcatgctactctctgtttaaagtacttaaaaagaactttgctcctaagaaattcagttccaaaagaaccaactgtgataaagattgcggctgttcttaatattgggttcatcggataattgaaaaaaatgtagtaatttcatttttctaatgtaaattattaatttgaatttcttaaaggcaggattaccggtattattttctttatttgcccttcaggtaaaggcacagtcagatactgtcaatactaagtcttatgcagaccaggtaatgattcgtgctaatcttgatactaacattgaaagctatgttttttcggcaggagaaggtaagaacgcattcaatatggacctgtcaatcaacaataaaacaaaaacatccctttccatcgattatagaatcataagtgcaacagtatcgtttgcgcccaggtttttagacggaaataatgatgatgaaatgaaagggaaaagttcttataccgatctaagcttcaggttttttcccggaagatttatccagaatgtttattataaaaatgtaaaaggtttttatgtagaaaatatgaaagacctttcccccggatggcaggaaggaagagatccgtacattcagtttccggatttaagagttcaaacctttggcggttcaacatcctatattctcaagaaaaatttttcagcaagaagtatctacacccagggagaatggcagaagaaaagcagtggcagctggattccgtttgtggattatgatcttaccattttcaggaatacaattgacgacgtcaaaagcaaggaaatacagtataatatcgggggaaatatcgggtatttctataattgggtgattgggaaaaaagtaaatatttcaccctatctgaccgtcgggatcggaggaaagttttcaagctacacagatattgagaacggaagtgctaaaaaaaatacgcagtatgcaaccataagaatgcagggaggtcttcatataggttataataccgaccggtttttattcggaggtaaaatgaattttaagagctatgcctacgaccagaaagataaccagactgtggaaaataataacctttacggactgttgtacataggctatcgttttgcaccaccgaaagttgtaaaaaatacctacgataaaattcaaaaaaagattcccgttctataagttcaaaggtcttttaagtatctttgcgatggaaaatttagaaaaaacaaaataaaaaaacatcatgtcattaataaaaagtatttccggaattcgcggaaccattggaggaagagtaaatgataacctgacaccgctggatgtggtaaaattcgcatccgcattcggaacatggcttcagaataataaaaacaaaaaagaccttacccttatcattggaagagacgccagaatttctggacagatggtttcttccctggttactgccactttgcaggggctgggaattaatgtgatagatcttggcctttctacaacaccaactgttgaagtaatggttcctgaactgaatgcagacggaggaatcatccttaccgcttcccataatccaaaacaatggaatgcccttaaattattaaacgaaaaaggagaattcatcagcggtgaaaatggagcagaagtactggctttggcagaaagtgaagacttcaactatgcagaagtagatgatcttgggaaatatgaaacaagagatgatgcttttgatattcatattcagcagattctggatttaccaatggtagatgtggaagcaatcaaagcaaagaaatttaaagtggttctggatgctgtaaactctacaggaggaatcgccattcctatgcttttagataaactgggttgtgaaaccattaaattatactgtgaacctacaggacacttcccgcataatcctgaaccattgaaagaacatttaggagatatctgcgaattggtgaaaaatgaaaatgcagacttgggagtggtggtagatccggatgtggacagactggctttaattgatgaaaaaggagaaatgtttggagaagaatatacactggtagccgttgctgattacttattgaaacataaaaacggagtggctgtttctaacctttcttcaagccgtgctttgagagatgtagcacatgcgcacaactcagaatactttgcaagcgctgtaggagaagtaaatgtagttaccttgatgaaagagaaaaatgcggtgatcggaggagaaggaaacggaggaattatctatcctgacttacactacggaagagattctttagtaggagttgcgctattcctgactcatttagccaaagaaaacaaaaccgtttctgaactaagagcaggctatccaagctattttatgggtaaaaagaaaatagaacttacgccggagattgatgtagatgctatcttaagcaaaatggaacaggaatatcagaatgaagaagtttctaccgtggatggtgttaaaatagactttgaaaacaactgggttcacctcagaaaatccaatacagagccgatcatcagaatctacactgaagctaaatctcaggaagaagcagatcagttgggagatgatatcattgctaaaatcaagagtttaatctaaaaatacacgaagaacggacacattgtccgttcttttttatatcagtaatgtttgaacatatcaaagacaggtttcctttccccaaagaaaagtggagaaaatttataagcagcttccaacgtatggaagttcctgcgaaaactttgcttttacaggaaggagagatttcctgtaatgcctattacatagaaaaaggaatggcaagagcctggtacaataacgatggtaaagacgtaacattccagttttttcttgaaaacacaatgttttcttcccttgaaagctttaaaaaaggcttgccaagtatggtgtcgttcgagaccatagaaccttgtattttatataaaatcaacagatctgatgtagaggccttcttggaagaagtttatgaaaattctgaactcagaaatctctttatggatgctctttttgaaagaatattcgactatatgaaacatttcttttcattcataaaagatacaccacagcagcggtatttgaatctggtcaggcaaaagccggagattatcaaaagagttccgcagcattatattgcttcctatctaggtattaccacagtacatctcagcagaatcaaaagtaaaatattgaaagagagactggagtaggctggaagatggaagccagaaacaggaagtttaaaaacatgctgtataactccgagatcattttaaccgcgacgtccacaaagaataatatgtattgttgaaaacgctcgcgaaggtgttccactcagcaatgatcattccttgctaaacgatgcccttgcgaacaaaaataatatacaatatcctgtttcctagcgccctccgcgtttcagactttaaaattcatatattttaaccgcgacgtccgcaaagaataatatgtattgttgaaaacgctcgcaaaggcgttccactcagcaatgatcattctttgctaaacgaagtgcccttgcgaacaaataataatcacaatatcatatttcttagcgttctccgcgttttaatctattatcagggttataaccttccaacctccctcttccagctcccctttccaaaactgataacaaatgttatcgctccagaacattcttccctcataattttgtataaaaattaaaagaatgaaagcagcagtagtatttgaaaaaggaaatattcctcaatacacagattttcctgaacctgaagcacaggaaaatgaaattatagttacagtgaaagccgcgtctattaaaaaccttgacagagccagagcaggaggaaatcattattcaacagataatcaggagcatcagccaacgattatagggacagacggagccggatatctggaaaatggaaataaagtctattttttcagtaaaaaaggaactgtagcagaaaaagcatcagcagataaaaaaatgatcattccgattccggaaaaactggatttctctatagcagctgcattgcccaatgcggtgatgggttctgcaatggcattaaaattcaaggcaggattacaacagggtaatactgttctgatcaatggggcaacaggaattacaggtaaaattgcggttcagattgccagactatacggagcgggtaagattatcgttaccggaagaaatgaagaatcgcttttagctttacatgaattaggcgccgatgaggtgatttctctcaaactggacgaacatgatttcaaacaaaaaataaaagaaattcacagggcaagtcctatagatgttattctggattatatctggggacattccgtagaaatgatattatctgcccttaaaggagacggcaacttttcccataaaacaaggctggtcaatgtaggaggaatgagtggagataccattcagttatcttcacagattctgcgggggactgatattcagatttccggatcaggattgggaagctggaccagggaagaaacaatgcttttgttttcggaaattattcccggaatgtttcaggcagccgtagaaggaaaaataaaaatggaaacacaggacatcgatattaaaaatatcgaaactgtatggaatgctgagatacaaagcagaaaacgcctggtcataagaatttaacctcaatttccgtttttttatccacaatccttttatcggttttctttttttactatttttataatagaaatttatgaaatggaaaattcaaaaaaaagttgcaactttgcataaatatttgaatatcagtttcagatgtattattaactaatcgtttgccgaggtttgtaagcaaattcagacatcaggccgacaaagaggacactattggaagagtattttggaaatgaacttgtaaaaaagttcgaggaaatgatggaaaacaatgacgaattctacttcgataccgaagaactggaagacattattgtttattatttggagcttggtgattttaattacgcagatatggcggttaattatgggctaaagcttcaccctaattcgttggatattaagatcaaaagacttgagatccttctggagtgggaagagtataatacggcgaaagaacttattgacgaactaaaaggcgcttctatggagaatacagactttttggtttgctacgccaagtattattcgaacttaggaaatcccagaaaatccattgaaatctgcaaaaaagctttgacattagaggaagaagaaaactttctccacaactttattgcggatgaatatgtgaatctcggagatccttttaacgctcttaagcattacaggaaagcattgaaagaagatcctgcggatgaatatgcgctggaaaactgtatggtatgcttcagtgacctgaataagagtgaggaggcaattgcctttcttaatgaatatttagatgaattcccttattctgaaaccgcatggtttgaatacggacaattctacttcaacagaaaaaattatgatgaagcgataagaggttatgattatttattggcaatcaactccaattcagtgggagtatatgccaataaagcagcctgttatgaagctttgggacaataccagaaggcaatcgaaacgtatgaagaaatgctggagcttgaatatacgaaagcatttaccttctataagatcggattatgcaacaaggctttaaaacagcctattctggctttgaatgcattccagaaatcattgagagaagatcctcagttttatctagccatgatggaacagtcttatctttatgaagaaatgggaggaatgtccgaagcattgcattttgccaaagaagctacccagctgaatgaaaacaacctcgattatcagaaaagacttgcgtttttattcatcgattccgggaagtttgaagaaagcctttcatgtcttaaaaagctggtagatgcagaaccttcaaggttttacaactggtatgcttattcagaagttttgatgttggtaggagaatatgaagatgcagtgacagttttgaataaagctattaaaaggcatcacagagctgagctgttttatcagttaagcaactgttatttcaatctgaaagaacaggataaaggaatggaatcacttcagaaagcactggatcttgatccgtctttggttaaggatatgcagaaaaaatatcctttcattaaagatgaggtaaaaaaagttaaggccggtaaagtgaagaaaaagaactagatttatctgaaaaataacaaaaaacctgcaaaactgcaggtttttttattgataattatattcgtaaaaaaacttatccggaacactgctgttcgggtttccgtttgcatcaaatgattgcctgctttcttcagatggataaccggcagtattaaaagttgttgtatacttatgctgagttgttccggttgctgttcctcctccggctgtggtgctggtaaactcacccttataagtacttaagctgttttttatatttgaaaataacatgctgacgccgtcactgctttcatttccattgaatatgatcttatcaaaacctttcacatttttaaaaggataatttttatccgtgtaagtataggtttctttttcggtataattaactgcatttccatttacggttcctgtgcctgaacctacgctgcttaccatatttccgttgctgtaggtaaacacactgttgatggtcgaagaaccggcagttcctgaattcgtcttcctttttacattgatttctgtagtactggtgtaggtgtatgtaaatgaaacagtgttttctactgttcctgtagtagaatattccttaatgaccgctgacgacatgcgcccactggaatagccatactcaacagtactttccagaacgttattttcgtaatttttgatgccagtaatgtaatcatcggtatacgaaaattctactctctgcccatggttaatgttgttgatcatgctgatgatcttcgttccgttgtagttgatcttcatgacaataccatcaattgtcattttagtaggaagtatcacattctgagcggaagggtcgctgttgtcaaaaggaatatcgtctgaatcagaacaggatagggtaaacaaggctatagagccataaagtaaaagttttttcatagttataagttaaatccgcccaaatataatttaatttataatatgatgttactttttaggatttgttcttaaaaatatcagtccgcctatgatgattcctgctcctataaattgcaaataagtcagcttttcaccatctataattccccagataatggccacaatgggcattaccaaagttactgttgaagcaaaaagagggctggaaactttcaataaacgataattcatcatcatcgccagtccggttccgaaaatagataaaagactaacaaacatcagtcccaacaggttatctttcgaaaaactgaattcagaaaaaaatcctgtacacgtcaatgcaataatagaaggaaatatcaaaacaaacgagaaaacaaaagcagacaaaacagtagaggagacctccataagttttgattttacagttgttgtgctcagagcatagcataaagtagccaataagagcagaagaatcggaatcattttaaactctccgctgtcaccgcctccaaatgccaggatacagactcctgtgaagcttattagcgttccgatgatctgttttttagtcgtttcaaacttccataccagcgcaccgacaatgatcacgaaaataggcatcatggaattgataatccctgcaatgctgctgctaatctcagtttcagcaatcggaaacaggaacattggaatgaaatttccggtaaaagctgccagaatcaaccatttcagatgttttttagggaaaagcttataattggaaattgcaaccggaagtaaaatgatcccggcaataagcactcgcaaagaccctacctgaaaaggattgaaatgttccagtgattttttaatcaaaataaatgatgatccccagataatactcaggacaatcagaagaacccatttttctttatctgcgttcattattttcgtgtaagatttttagaaattcttttttaggaatcatttttgcccctaagctctcaaggtgctctgtatgggattgacaatcaatcaattcaattgtatttttatggctttctacaaaatggataaatccggctttggaagcattactcaccttggcaaacatactttctccacagaacacattcccgatctgcaatccgtaaaaacctcctacaagttccccatcctgccatacttcaacacttttggcaaggccatactcatgaagctgtataaaagaatccatcagttcatcggaaagccatgtgcctgactgccctttccgggttgccttctggcagtttctgatcacttctctgaaattcttattctcagaaaaagtaaaaacattcctgttcaggatttttctcatggattttgaaaccctcagttctgcaggaataagcacgaatctcggatccgggcaccaccaaagaatctcctctccgggattgtaccagggaaaaatccccaattgataggcaaaccaaatacgttctacagagagatcacctccaaaagcaaccactccctcatgaccgtcatacagttcagggtctggaaatgaaatctcgttttcgtctaatcggaccatttttagaaaaaaaatcccacttcaaaaagcaggatttatattgatctttattctttaattaaaaaggcaaatcatcatcgtcatcaccagcaaacggattctcatttgaaactggagaagcagattgctgaggcattgcctgagtaggttctgaagcattatcaaatactttctctactctccatcctgtaatagagttgaaatatttagtctcgccctgaggagaaacccattctctacctctgatgttgattcctacttttacgttttctccttccttaaggttatctaataaactgattttatcagataaaaattctatgtttatcggctgtggatactgttcctgggtcaaaataaccatttctcttttttgaaacccgctcgcaaatgtttgagcatcaaaaagtttctttaccgttccttgtaattccatatcgtaaatattaacgttgtaaaagtaagaaaatgaaatgtaataaaaggtgccgtgaaaaaaaaatgtggaaattttaattttttttcctgaaaagtttggtactaaaggaaattgtcctatatttgcactcacaaaaacgaagcaagctctttaaaacttacaatataaaaaaaccagcggatgtggtgtaattggtagccacgccagacttaggatctggtgccgtgaggcgtgggggttcgagtcccttcatccgcactatgcgaaaatagctcagctggtagagcacaaccttgccaaggttggggtcgcgggttcgaatcccgtttttcgctccacaccatgccctggtggtggaactggtagacacgcaggacttaaaatcctgtgtccgcaaggacgtacgggttcaagtcccgtctggggtacaagaccctctgtaatatcttacggagggttttttgttttaatagagagtgttctttaaataaaatttttatatttgtaagaaatatagctagaatctgtaaattcagatcagcaaaccagcggatgtggtgtaattggtagccacgccagacttaggatctggtgccgtgaggcgtgggggttcgagtcccttcatccgcactatgcgaaaaaactctttggagttaccgggaagattggaacttttgttcgaatctttttttttcgcccttcaccatgccctggtggtggaactggtagacacgcaggacttaaaatcctgtgtccgcaaggacgtacgggttcaagtcccgtctggggtacaaaagccctccgtatgaaagtacggagggcttttctgttttataatcttcaacctttttgcaaagtccataaactgatgctttctcagttgttgagcagatccgttttcttttccagtttttccagtctttcaaaaatgcttgtgaagatatttttctcagcagttgaaacataccctacaatcttataatattccttattgtttatagactgatggtcagttgcatactgaaggtttttgttggtgtacaccagcaaattgttaatggagtccgttttcggatctgttttattcagaaataaaatatcaccggattgatattgaggaagtggagatttttcagaagtaaattcataaaccagatcaacagatgctaatattttttgcaatattgctgagttgggattattttcttccgtttttagctgtgtttctttactgttttgaatggccagctcaggaaaaagcattaactggtcaatgtcggaaacgcttgcgagctggtttaccggcaggatttcagtcagcaattgatcaagattaaggttaaaatggctggcgacctttaatatggtttcaatcttaggctcggcgcgtccttcctcataagagcttattactcctctgtttaaatcaaataaatcggcaaaagccttttggctaagtcctttcacctgtcttattttcttaatattagttccaaagaagctcattttgtctaatcttttttgcaaagatagagaatctgaaataaataattgctaataatatttgcattttgaaaattttattttatatttgtgtagagaaaataaaacactaaaccagccattatgagaaatcaaatattcagaacggtcaaagagtggttgttagattatgagtttaacatcacgctggaagatgaagctcagagaatcttaatcattgaaaaagaatccaacgggatcaaaaacatgatcctgatcatatcagactctattctgatcatggaacagttcctttttgaaatcaaaaacccatccgagaaaatattcctgagactgcttcagaaaaacagagacattgttcacggagcatttgtattggacggaaccggaagaagagtgattttcagagatacgcttccaactgataatatggcacaaaacgaagtgatggcttccatcaattctttagggatccttgtgggggaatttacaacagaaatgctagaaatgagtaagtaattcacaaaagatatttaaaatgaacattttcaaaagattgctaacaataggaaaagcagagatccattctgtgatcgaaagctttgaagacccaatcaatttaacggaagagggtatccgtgaaatgaaagaacagctggcaaaaagcatagaagcgcttgctcagttaaaagctcttgctattcggaaaaagaatgaagcggaaacagaagagcaaacggcaaaagattattataataaggccgtcgtgattgtgcagaaagccgaaaaaggagaagtggaaactgcagaggcagaccgtcttgccaaagaagccctgaaaagacagactgcttctctggaaaacgcaaaaaatctacagaaagaacacgaaaaacaatacaatgaatgcgaaaagatgcaggccaatatcaatcatctgaaatctggtattgccaagtgggaaaacgagctcaaaacacttaaagcaagggttcaggtaagtgaagctaccaaagatatcaatcagaagatgacccaaatggataccggaagcacagtaagcatgctggaaaaactgaaagatcgggtggtacagcaggaagctcttgcggaagtttattcagatatttcaaaggcaggaaaaagtattgatgaggaaataaatgccctggtcaataataacgatacaaaagctgaagaagatttgaacagattaaaagaaacactaaaaaaaggctaaaatgacctttcaggaatttttaaatatagcattttctccggtgaatacggtgctgacggttctgctcgggctttcagtgatctattggctctttaccattcttacagggctggatatagatgtgggaattcattccgacgtagatgcggatgcagatatagacgttccggatggccatgttcatacccctgatcatgacccttcagcatggatgcacttcctgaaatttctgaatctggatattgttcctataacgtattttctcaccctttcactgctgattacctggctggggtcattttatctgaattattttataccactgcccacatgggtaggtattcttatcatatttccattattaattggaggaatgctgttaaccaaaataattctgaaaccgctgaatcccttttttaaggaaattaatcataaaggtgaattatcgtatgcttttttaggacgggaaggccgtttgaaatcaagcattcaggatgataaaataggaatgatggaagtctttatcggaagtgatcctatgacgctgatggtgagaagccaggacggcagcaggctggaacacggaagccgcgtcatgattgtagatgaagagcccgaaaaaaggattttctatgtacagcagtctataagatattaaaaataagaactaataaccatgataactatttttttgattctgatgaactatatcctggatctcatctgtcattttttataaaacaaaaaacacaatctatatataaactacaaacttataaaactatgaacttacctttaattgctggaattattgttgctgttgtagcaacagtcggattgattttctggattttatcgatgtataaaaaaaccgttcagggaatcgttattttaagaactggttatggaggtacaaaagtcttctttaatgccggtatcgtgattcccattatccaccgtatggaatctatggacatctccgtaaaaaaactggagatttcaagagagggaagagcaggcttgatctgtaaagacaatatgagagcagatattcaggtggcattttttatccgggtcaacaaatcagtagatgatattgtgaatgtaggtcaaactattggctgtcagcgtgcttcagatgcccagacattaagagaactgttcgaagcaaaattttcagaagcccttaaaacagtaggaaagaaatttgatttcaccgaattatacgaagcaagaagtgaattccgtcaggaaatccttgatatcattggaacagaccttaacggatatgtgctggatgactgtgcgatagactaccttgagcagacctcaattgataaattagataaagataatatccttgattctgaagggattaaaaagattacagaacttacagcaactcaaaatattaaagccaaccaggttcgccgtgatgaagaaaaaaccattacaaaacagaacgtagaagcccgtgaagcaattcttgagcttgaaaaacagctggcagaaaaagaagaatctcaaaaaagagaggttgccaatatcaaagcccgtgaaaatgctgaaattctgaaagtagaagaagaagaacgtctgagatatgaaaccgttcggattgcaacagaagaaaaactgcagattgcagaagaaaataaacttcgtcaggtcgtgatcgctgctaaaaataaagaacgtgcagatctggtagaaaccgaaagagtattaaaagataaggcccttgaagctacagaaagagaaagaattgtctctcttgcccaaattgaaaaggaaaaagcaatagagctagagaagaaaagtattcaggatgcaatccgcgagcgtttaaccatggagaaaaccgtagtggaagagcagcagggaatcaaagacctggaagccttcaaaacagcagaaagaaacaagcaggtagaaattaccgttgccactcaggaagcagagaaaaagctgatcgaggaaacaagagccgcagaagcccgcagattggccgcagaaaaagatgcgcagaaatacgtcattgaagcacaggcgaagagagatgcagcagaaaaagaagcagaagcccgtaagatcattgcagatgcgaaagcaaaagaagaagctacaataggactatcagaagctcaggtaatgcatgcgaaggcagatgctgcagaaagacaaggggttgcagaagcaacagtgattgagaaaaaagcagatgccaacaaaaaagaaggaattgcccaggcagaagtgatcaaggaaaaagcattggcagaggcagcaggaattacagagaaggcagaagcgatgaagaaactgaacgatgccggaaaagaccacgaagaattccgtcttcagcttgccaaagaaaaagacgtggagctggctcagattgctattcagaaagatattgcagaagcacagtcaatggtactggcagaagccttcaaatctgcaaaaattgatatcgtaggaggtgacaatacatttttcgacaatgttatcagacaggtttctgcaggaaaaggattggataagttcatcagccacagcgaaaatgcacagattgtaaaagaaaaccttctgggtgatggaaaaaatatcattggaaaagtaatgggaatggtggataaatataaaatctcttctgacgacatcaaaaatatgagcatagcgtccctgatctttaaactgaatggcgtagccaatcaacaggaaaaagttattctggaaagagctctggacatggctaaacacctgggagtagagcacaaaccggtgaataacaaccatgtttaatgcaagagtgctttaaaggcttctaaaattcaaaccttataggtttccaaaacctgtaaggtttagactaaaaaattttcaaagtaccacaagttatacaaaaacctgctgtcctgcagcagccatgacaacctaaataaaaacgatgtcagaacaacttaattccggaacttacgaaattattcagaaccgtttaaatgagcagaagaatgatctgattcagcgacttcagcagcttaatgaaaaccgtaaaaatatatttggcggagtagatttttcgcttgtagccaatgaaagaatttctacggatcacagctgtattgccaaagatatctattcactgggcgaccacctgattttcgggtctaatgcacatctgggacttcagacggaaatcaatatttcggacgttttttcaatatataccatcaataatgaccgatttgaacctcaggattataccctgatcaatgatgaggttttcattgacgagtttaaaaacctttacaaatattacagaaatactttctttgccagatttaccttcacggaaaactatctttatatggtttttcagctgtcagaaagtactacagatatcaaagcctttaaatggctgatcaaagataatcagctgatctatgttgattccagaagtgcttccgagacctcataccctcagcagcatggttttgcatggacaaaggcaacgagagatatgcagagatccgggaaacatcctcatatttctcttgcagataaagtttttgtagaaagcattggcggcgatatcaccatcaaagtagaagacaatacggatatcggaaaaggaatttattccgaagatgtcattcacaaagatcagaatctggatgatgcagagattcatttctgtgatctggataatcttgttttgtttaaaataaagccttatcaggaaacagaacgctattttatttataatcacaaagaaaaaaccgtttcaagagcagatgctcttaaatattcgggacttttgcttcccgaaaatcagggcgtattattttcaaacggatatgcgcttcagaccggaggattaaaagtgatttctcaggatcagaacaggctttactatctgaaaaccgttacggaaccgaacggagagaactttttatatgttttttatgatgataaaacgaataattatcagctgatctcctataacattatcacccagaccattgagacacccatccgatgcagtggcttcacatttcttaatgatggaaagctgatctatcttcgggaaagcgtagaaaccacgaagcatcatctgtcccagatctggcagactcctttttcaaaagaactgttgcccaatatagaaaaggcagacagtttactgtacaaaataggaaataaagatattgtacgcgtcatggcagaaagccaggagctgatcacccttctgaacaaaaaagactcttatagtggcttgtatgatgatatcgtaaagctctctacttttattctggatacttactattttcttggtgaagatgaggttcagaagcttgatgtaccattgaaggagatcagagcgattgcgcattcggccatcaatgaatacgaaaaagtagtagaacagagaaaaaatactgaagaagctttagaaaagataaaacagacctgtgataaaattcttgatgataccaaaaggcttcactattcccagcttacagaatatattgatgctctttctcaaatcagagccttaagaggagaagtgacaggagcaagagagcttaaatatgcagacacagctttgctggatagattggaaaaatcccttgcagaccgttatacagaactgtcaaatgcctgcgtggaatttctgcttcaggaaggtgcattattgccatacgaagaaagagcacagcaaatttctgaagatatcattggattacagaaagccattgatgccagaacaattgaagaaaatatcaataccctttccgggcagctggaattattggtggatattgttaataatcttaaaattgaagacacctcccagtctacccagattattgaaaacatctctctgatttttgccaggctgaatcaggaaagacttgagctcagcaaaagaaaaagggaaatttcgggaaaagagcttgcttcagattttcaggcccagattacgttgtttgaccagtctgtgatcaactttcttgaactttcacaaactccggaaaaatgtgacgaatatctgaccaaactttctatccagctggaagaaatggaaacgaaatttattgatttcgaagaatttatcctgcagataggaaccaaaagagaagaggtttacggacatttccagaataaaagagtacagcttaccgaagcaagaaataaaaggactcagaatctttttgatgctgcacaaagaatactgaaatcggtacagaccaaagcagaatcttttgactcagaaaatgagatcaatggctattttgcagcagatcttatggtggagaaagtgagggatctttccaggcagcttgcagaattggaggattcagcaaagtcggaggagattcagaccttgttaaaaacccagcagcaggaagcagtaagaaagctgaaagacaaaaaagaaatttatgcagacggacagaatattattgcgttaggagactataaatttgcggtaaatcagcagaaactggatctaactctggtgctgagaaatgcacaatactattatcatcttaccggaacaagcttttatgaaccactgaattttaccgcagatgaattcagagaggtatggaatcaggaatttgtatcagaaaacaacaaggtaaaaaggtttgaatatcttgcctggaacgtgttttccgctcatcaggagataacctccgaagcagagaatgaaaaggctgtacgggattttacctcagagcattttggggaaggactggtaaagggggttcatgataaagatgccgaaaaaattgttctcaaactgcagcagatacacaatgagctgggactgatgaggtttacagcacaggaaagaacactagcccagctgttctggtttttccttggaaccgaaagaaaggaatattataccaaacagtttgcggctgcatctattattgcccagtcattcattgtaaaacaggaatttgaatatctgagcagagagctttcggaagaaatgaaatcatttgcatcagccaatagtatttttaaagagacagattgtatcaatgctgccatctacctgaaaaaagaagacaaagagaatttcctgatctcggaaaaagccgccactctgtacgagcttttcatgaaagagctcaaagaaaagggtaaagatctggagtttatggctcagttacaggctatgtatcaatatccttcagcgtgttattatattgctgaaggtgcattacaggcatttgactctgatgctgatcaaaatacggtacaggaagcagcaggatttttgatcacccagaagtttgatccgaaaaatatcagacatattgcgtatgaagtcgccataaaagagctgaagtctcttgaaaaagacacggaatatcatcttaactactttgaatttgtatcccgactgaattactttaatacggttacagttccgaaatacaaacgcctccaggaattgaaacacagttgggtagatgaaaagaaaaaagcactgaaactggatacttttaaacctcagatattaagctcatttgtaagaaataaactgatcaatgatgtctattttcctctcatcggagcgaaccttgccaagcaattgggaacagcaggttcagacaaaagaacagacaggatgggaatgcttcttctggtatctccaccaggatatggaaagacaaccctgatggagtatatggcagaacgtatgggattggttttcatgaaaataaacggtccgtcactaggctacgatattgtatcaacggatccttctgaagccagaaatgcaggcgcaagacaggagcttgaaaaactgaaccttgcgctggaaatgggagataatgtcatgctttatctggatgatattcagcactgtaatcctgaatttttacagaaattcatctctcttgcagacggacagagaaagattgaaggaatctacaatggagaaagtaaaacttatgaccttcgatccaaaagattctgccttgtcatggctggaaatccatacacagagagtggagaaaagtttaaaattccggacatgctggctaaccgttcagatacctacaatctgggagaaatatccggatcgaaaacagatctttttgatctgagccttattgaaaatgctttaatgtcaaatgaatacctgaccagattaacaaatccgggaatggaaaacctgtatgaactctatgattgtgtacttacagataatcctgccgataacctgaaaggaaacttcagctctaatgaaatatcagatttcagagcagtcctgaaaaatacggtcagggtaagaaacatggtgttaaaagtgaacagggaatatatcgcatccgcagccatgtcagacgattaccgaaatgaaccgccattcaagctgcagggatcttaccgtaatatgaataagctgattgcacaaatacagcctattcttaaagataatgaagttactcagcttgtcttgaatcactatcaaaatgaatcccagacgctgaccacaggagcagaagccaatatgttgaaaattaaagaactgataggaattctttcagaagaagaaaccgaacgctggaatgagataaagaaaacatttgttaaaaataaaaccctgaaaggattgggtgagaatgatagaatgtcacagattgtagcactgcttgctcagtttggagacggactggaaggaatcaaagaagcccttaaaaaagcagaacaataaccacgaaactttaaatagtttacaggctgtttcagatagaaacagcctgtttttatatatatttacgttttagagctagcattgattagaaatgggcttcacttaatctacaaagcatccatataatgacacataaaaatctgtacccataatattctatagttctgtatctgtgtccaaaattaaatactccataattttgtttagctaaagaagaaaatatggaaacaatcactcaacatcagaaacagtttcgatatgctgaggcttatatatcagacatgctggtgctgaaaaatatttttctggaaacacagaatctcaaattagcagatcaaagtttcggacttccttttcttttggctaaaaacggaagggaagtagttgcttttgccagtcttattgtaaatgaaaaggatgaaatttgctttaaaatatatgataaaaacaaaatgactgaacccgaggagagaaacttcttttctcatgttgaaagatattttaaaaataataatagccccaattttaaaaatcctgctcaattaaaaagcagtataaatagtatggttaactggcttaatccttaaacataggaaaaattgtacatttacttaaaacccggattctatgtctaaagatgttctgtaccttaaaatagccaattctgtcacagagcagattaaaagtgaaaccctgcagtttggagacaggctgccttcattgcgaagtgcccagaaattatacaatgtaagcctgaataccataaaacaggcgtatatggaactcgaaagccgttcgctggtagagtcacgtccgaaatatggatattatgtaagccagacttcccagcgaaaactggcgctgccttctgtgacacagatgaaggtttcagagggaaaaaatacccctcaggatttgattgacaaggtattcgggagtatcggagggacagatgtcacacaattcgcgcttggaattcccgggaaaagtcttcttccggtagccaagatgaaaaaatgcatgattgatgtgatgaaaaggaaaagcgacagcggaaccaactacgaacccgtgcagggaagcgaagtactgcgccgggaaatcgccaaatggtcaatggttatggaagggaaaataacagaagatgatctggtgattacttccggagcgatgaatgccgtttataattgcttaatggccgtgacgcaaccgggagattcggtggcggtagaaagtcctgtatatttcggaattcttcaggccattcaattattgggattgaaagcagtagaaattcctacgcatccgattacaggagtagatctggatgctctaaagaaagtgcttcccaagctctctgcatgttgttttgtggtaaattataataatccattgggatttcagatgccggatgagaacaaaaaagaactggttaaaatgcttaccgagcataatgttcctttggtggaagatgatgtctacggaaacatctatttcggagcaggaagaccgaaaccgtgtaaattttatgatgaagcaggcattgtgatgtgggtaggctcggtgtccaagacattagctcccggatttagagtaggatgggtagcacctggaaaatttaaagaaaaaattatccgccaaaaactggttcagacggtgagcggaccttctttattctcggatgtgattgctgatttccttgctcatggaaggtatgatcatcacctgaggatgttcagaaagaaattgtacgccaactaccttcagatccagaaatcggtgattgaatattttccggataatacaaaaatctcagagcccaaaggaggttttatgctctggctggaactggataagagaatatgcacagaagatctttatgatttggcggtcagtcagaaagtaaactttgccccgggaagaatcttttcacaatataatcagtatcagaactgtatgcgtttaaactatgcattagaatggacagacagagtggaaagtgatctggaaaagctgggaaaaatgataaaaaacagaatttaataaaccttatagcgatgaatgatagtaaaaatgaagtaaacattatagcctatgaacctcagtataaagaagctttcaaagctttgaatgaggaatggatcaaaaaattttttgtaatggaagcgggagattataaactgctggatcatccggaagaagagattttaaataaaggaggacatattgcctttgccttattggatggagaagttgtgggaacttgcgcattggtaaaaacagaagatcatcctcttacttttgaactgtcaaaaatggcggtaagtcctaaagcgcaaggaaaaaaactaggctatctgctgggaaatgctttagtggaaaaagcaaaagaattaaaggctgaaaaagtctttctagtcaccaactctatccttgttccggctatcaaattgtacgaaaaactgggctttatccatacccctatcggtcatgctgagtacgaccgtgcagatgtcagaatggaattggtttttcatagataaacccattgtttctcgatagtttaaaaacaattaatcgtaaggagttctcattttatgagaaaaatttccgtttttacctttttgcctatccccaggaaaatttccctatttttgtaaaactccttatttcatttatgaaaaaaattattcttatcgaagacgagaccagtgtggtatcctttattaaaaagggacttcaggaaaacggatatgaaatttctgtagcatttgacggccgtacaggagtgcagctggtgcaggctaatgatttcgatctggtcattttagacattatgcttccggaaatgaatggtctggacgtgtgtaaagagataagaaaaacaaatcagagtgttcctattctgtttctgaccgccttgggaacttctgaaaatatagttctgggactggaaagtggcggagacgattatctggtaaagcctttcaaatttattgagctggtggctcgtgttaaatctttgctgagaagaagcaacaacaatgggccacaggaaatcgctgaaccggagccggataatgaacatgtatttcagttttcggatctgatcgtgaatgattataccaagaaagtaacacgcggaggagaagagatttcactcacttccacagaatataaattactgctgtattttttgaataaccctgaaaaagtaatttccagagctgaaattcttgatgcggtgtggggagtaaattatgaactgggaaccaatgtagtggatgtgtacgttaactatttaaggaaaaagctggataaccaggaagaaaataaactgattcataccgtgataggaatgggctatgtattgaaaaaaacataatgaatgtttaataaagtcattacaaatcaaaccaaaacgatggtgcttttaatgttggtttttacagccatcattttgctgttcagtggtttggtgtacttttctatcgttaatttttcgcatcagagattttatgagctgctgaaaatcagaacggcaacaattgttcagatcgaaaaaagcaaggataatctcgatcttccggaaaactatattctcagcaacctgaatgatgaggagcttccgatggaaaaagactatgtttttgccgttcccaccgattccaatttcaaaaaaatatcccaggaagttcatattccggactatttctttaaaaatatcattaaagaaggtgaatctaactataatgacaaagaattctattatatcggccaaagcttcaggtatgatgataaggattatatagcgatagcttctgcaaaaaaccattatgttgtctactatcttggatttttaaaaagaacgctgattacgtgtattgtactttccctgttcttcagtatgatcttttctttttatctgtctaaaaccttattcagacccatcttaaaaatcacaggaaaagtaaaggaaataagttctgaaaatcttcatttaaggctagaatcacagcctgataataaagagcttaatgagttggtggacacttttaacgatatgctcaaccgtattgaaacttcctttgaaacccagaatcatctgatcggaaatgtttcccacgaactgagaacacctcttacttctattatgggagaagcagatgttgcactatcgatcagcagaacagccgctgaatacaaagaaaccctcggaattattctggacgaagccgaaaagcttgataaaaagatcaaagctttgctaatgattgctcaaaccggattcgacggaaagatccagaaaatggataaggtgaggattgaccagctgctttgggatgtcattgaaaccctgcgaagaattgattcccgaaataatattttcctggatatcagcatgcttcctgataatccaaaaaaacttaaagtgcagggaaacgaacagctcctgcatctggcagtggccaatatcatcagtaatggctgtaaatactctgattttcagcaggtcaaagtttctttgggagctaccaatacagatgtctacatcattgtaaaagacaacggtatcggaattcctgaagaggaaatgaataaaatctatgatccgttcttcagggcgtccaatacaaacaactatgaaggatacggcattgggcttccgttggccagaaacattgtgagaatgcaccatggcgagctgatcgtcagttcacacgaaaatcagggaacaacggtacagatgcgttttccgaatttctatactatgcagaaagaagaagaagttaaagggtaagccggaaacaataggtaaaatcgcaaaacggcaaatttgcgaaaggctctttcaccttttattctttcactttttcgctatattaactcctcttaacaattttctaatctcattttaatctctttaatcacattttaattccgttccaaaggtcttctaataccgtcgttctaattttgtattatcaaaaaagataaaaacacaaatacaaaataataaagaacatggctaaaacaattttaattgcaacagattattctcttgagtcattaaatatattgaagaaggtacttaaagagaaggatgcggcagaagatcagaaccaatataatattcttctgacttcaggatatgattccggagattctataagagatcttttattcagcaccaaaacatcggtcttcaataaaatcaggccgaaagagttttgtgacgccttaggcattatcagtaataaatatcctcatctcattaataaaatcatctgcgacatttttactggtagcttccagagaacttttaatcaatatgtaaaggcagaaaatattgaagaagcttattattctccttctatcataagcaaaggaaaaggaaaattcgatctgattccttatatcagaaaatgcaaagaacttcagtcttatgaaattaccattgaagcaagagaaagacttccggaaaaaggcagactggcagagatctttgtagaagtttaaaagtatacacaatttaaaaagataaaaaatgttaagaaattatagtaacagcaggacactgggagacaatatcaggttggggacgctgactgccttcaccgcaggtactataaatattgcttccctgttgatatttctctcttttacatcgaacgtaacaggacactatgctattctggcagcagaaatcagtaaaggaaactggacgcaggtagctgtagtgggagcatggattttcctcttcttctttggaagttttgtatccaacttcattgtcatcaattttaataagaaaagtaaatattttgcccatgccatgccgattgtgctggaaatcatatgtcttctttttgtaggagtatacgggcagttttattatcagaaaacattagaagaaacagaataccttgtagccctgatgctatttgctacgggactgcaaaacggattgacagcaagtatctctaatttctctgtgaaaaccacccaccttaccggaacaaccaccgacttaggaattctggtatctatgtttacccagaaaaaatacagaaaaaacggagaactgatcggcagagctaaacttctgacgagtattatggtagcctatgtgatgggagctgtattttcaggacttacttattactatctggaattcagggtgttttatgtgatcagtatatgtctgctgattgtcatcggatatgatgcctataaaattcacgtccgtcactttaatacaaaatacagatacaacagaatctacagaaaacctaatatttttgcttacctgtatgagaaaattcatggagctcctaaaaaagagaagaaaagaaaacttgtctttgaggaataaaaataaaacacaagcgattaattttttgtataaactagctgtaagtgcccttattttatcataaaataggggccttttttttaaaaataacttcaatatttaaatgtgattgttttatatcctttttttcgtgagggttgaaataaaaatttacggatcaaatcaataaacttgctaacgcccttcattacaaacattaaaaaaatcagttggggataaatagggaaaaatgttgataattaaatattaaatcacggtttttgtattttaattcccgttttcattgactatttttgtaagttgatttacgtttttatgtcagatattattcagcttttaccggatcatgtagccaaccagattgcagcaggagaggtggtgcagaggcctgcatccatcgtgaaggaacttttggaaaatgctattgatgcagatgcaacgaaaattgaactgatcatcagagatgccgggaaaaaccttattcaggtagtggatgacggaaaaggaatgtccgagacagatgcccgtatggcttttgaaagacatgcaacctccaaaatcaaagggacggaagatatcttcagaattgccacaaaaggattccggggtgaagcgctggcctctattgcagcggtttcacaggtggagctgagaacgaagcagaaagatacttccattggaacaaacatttatattgaaggtggagtttttcagtttcaggatcctgttcagacagcagacggatcaaattttttagtaaaaaatcttttctataacgttcctgcaagaaggaagtttttaaaaaataataatattgaattcagacacgttattgatgaatttcagcgtgttgcattagctcatgagaacctggaattttccctgttccatgatgatgaagctgttttcaggctcagaaaaggcagtcagatgcagcgtattgtggatgttttcggaagaaagctgcagccgcttctgatccctattaaagaagatattatatggtgtaaactgcatggttttgttgccaagcctgaaggtgcgaagaaagcaaggggcgagcaattcctttttgtgaatggaaggtatttcagaagtccatacttcaataaagcagtgcaggaggcttttgaagggctgctgcaaccgggatatgtaccttcatttttccttttcctggagttggatccggaaaaaattgatgtcaatatccatccgcagaaaacagaagtgaagtttgaggatgagcatcttatctttgccttgcttcgttcaaccatcaaaagatctctggggatttacaacgtgtctccaagtcttgatttcgacagagatccggaactggatgaaatgatgaataaaccaattcccagcaaaagtaacagcggtggaagcggaagcgttattaaaatgcctgaaattattgtagacaaagattataatccgttcctggaagaaaaaaatgtagtgcatccggaagaaatccagaaccttacggaaatgtatcatcagaatattacagcagaaccttcaaaaatcaatttatttgaagatgaagattttgatgaagatcttatgaggcttccaaacggctattggctttttaacaaaggagatgtgacgcttatgttggatcttggaagaatgcacaggcttttgatatctgaaagcaacaaatctgtcagaaaatcaagtacaaacagccacgctcttctcttttctctggagtatcacatgaatgagattgagaagacaaaatacaatgcgattaaaaaatatcttccggaattagggtttgacatgaaaattgctcatgaaagtgtacttcgcatagattcacttccggaagggttaaaagaaacccaggcgatgaagttcctggaaaacctttttgagatcctggattacaagacggaagaagaattcatgcagtattaccataaccaatggaataaaatgcagtctaagtcaagatttgattttatttataaaaaagatgcggaacagcttatcaaagattttacagcattaggcttcccggaatttttaccggatggcaaaagatgcttttatgaagttccgtttaatgactttaaaaacaaattttaaaaattatgtttaacaatataccgcccattacaaggaatattattatcatcaatgttgtagtatttattttgacttacttcatgggaaaccagatgattggctatcttgcgggcttttatcctttctcaccatttttccattcatggcagattattactcatatgttcatgcatggaagtattatgcatattttattcaatatgatgacactctttagttttggaccaattctggaacaaaccttaggagacaaaaaatatttgcttttatattttgcaagtggcttaggtgcattttttctttttaatgcatggaattttgttgaggttcaacaactttcccgtgaactggagcagctagggttcaatgtaaatgcttatttgtccggagcaagtgttgaatttgcaggaaatacgagctctgttcttaaacagaaagaattactggaaagtttaaaagctattgttgctaccccaatggtaggtgcttccggcgctattttcggagtagtcgccgcatttgcaacattatatccggatgcaaaaattgggattatgtttatccctgttcctatgaaagtaaagtacctgttacctgttattgttgtgatttcaatatatcttggggtttcaggaaacggcggaggcattgcccatctggctcacgtaggtggtgctttggtaggatggctcctggcactaaactggaaaaaacacctgtacaggttcaattaaaataatgttgtgaagattttccgactcatagtattgattatccatctgggaattttatttctattgttgggtaccttgttaaatgcctatgtcccaccaaagatttttccgtggtttaatctgctttctttagggtttccggtacttattatcttgtatcttattctgaccatattctggatattcagctggaaaaaaagagcatttgtatttatgtttgccggattggcttttataaatcctgtaaaaagatgggttaattattctgatcagaaaggaaactctgacataaaggttgtttctttcaatacaagggcaggcggcagaggaaacaaagagattgcaccatacctgaaatctcagaatgcagatgttttttttctacaggaggatgcgggcaatgaatatcagtttgaaggctatcagaaagcaaatccgggaggaggcttaaccattctcaccaaacataaaatcattaaacaacagattttagatccacaggatgaagacgtaagaattcccggtgtgctggccgatattgaaattaaaggcaggacctacaggctcattgatgtctatctcaatccttttcggtttgaaaaagagatggtgaaacttaatggaaataccgataccaacgaacaaaaaataaaagatgttattaaaagactgattcccacctttaaaaaacatcaggatcaggtagcgcttattcgtgaagccattgaaaattcaccttaccctgttattcttgcaggtgatttcaattctgtaccgaattcttatgaatattaccatttatcagacggacttgaagatacatttttaacagccggaaagggaagtgcaacgagttttcatgattataaatttccaatcaggatcgactatgttttttcttcaaaatctttaaagacaatatcttacaaagttgaccgttctgtaagtatttcagatcattatcctgtcattgtaaaattttcttcagaaagtaaataatcataaaaatagttaaaatttttatgcttggtaggatttttgttgaaagaaaacagtaccaagaacgttttttcatgaagtcgaatcagatattactatttatacatatcgttgttgccgttttgctcttatgcacattggggaatgcatggattccacccaacattctgggcaacctgaatcttctgtctcttggatttccttatctgatccttgcccatatcatccttacactgatttggatctttaaaaaagaaaaaattgcaatagcttttgctttaggtacacttattttctataatcctatcagacgatggattaacttttccccgaaaacagagaatttaaaaacaatacgggatatcaaggtattgacttttaatgtgaaatacggcgaatacggctgggataaagtaaaagactatatcaaggcccaggatgccgatatcattcttgtgcaggaaaaagatacaaaccgtgttataaaacgtgatcttataaagtatccgtcagttattcttaaaacgaaacataaaattgtaagacaggcagaattaattgatgagaaagcacggggaaattcattctatgctgatatagacattaacgggaaagtggttaggattattaacgtttatcttgagcccttcagacttaataaatcgatgtttacaaaactggatgcattaggcctgggaaatgtttcaacattactttctcatatgactcctacgtttcaggctcatgaagatcaggtgaaaagaatcagaaaaatggttgacttgtcaccatatcctgttattctggcgggagattttaattctgttcccaattcatatgaatattataaccttggaaaagaccttcaggacgcattcttagtagccggaaagggtagtgccagcagtttccatgattataaggtgcctttaagaattgattatattttcagttcgaaatcaatcattccgctaagctataaagtagaccagtctgtgaaattatcggatcattatcctgtaattgcagaatttctgttaaattagttccatgaaaaatttactggctgcaatttttatttctactcttttttttaccgcttgttccaagaaagaatctccgggattcggggctgaacaggaagttaaaataagttatgataccactgctgttgactccttttctacaggggcggtttcagtggatattgcacgcaaaataagaatgtcttccccacagtatattgattcagtaaaacaggctaaaaagcttcaggatgaagaaaataaaattaaagccgagctggaaaaagaaaataaagcaaagctggaggaggaaaagaaaaaggcagaggcagaaaagaaacagaaagcaactgaaaaaccagctgcccaggagactaaatcagaataaattcaaaaaacattaaacaaataaataatatgaaaaaacaaattttcgctgcaatagtgatttcagtattcacagtagcatgtacaaaatcaacaaagaaaacagaacaggtagaaaaccctgacggttcagttacaaccacaaccactacggttaccgaaacccctaatggtgtggatacagcaaagatcaacaatgctaaagaagatgtaaagactaaagtagatgcagcagggaataagatcgacgaagctgctcaaaaggcaaaagataaaattgatgctactgcagataaaacaaaacaggatcttaacaaagcaggtcaggacattaaagcagaagctgataaagtaggaaaggatgctaaagaagcagcaaaaaaaggagcttcaaaagtagaggaagccgcgaagaaagtaaaagaagatttaagcaaataaaaaatgaaagccgtcagtttgtgacggcttttttatttttattatacgcgaatgaaataacattcctttatttattcatttccagcagcggatcaatgtattctctgtcattgctcagtcgcggcaccttattctgtccgccaagctttcctttagcctccagccactgatagaaaaggttttctttagcgatatgtacaataggcctttttaaagtcatgttattgtacctttttgcctcataatctgaattgatagctttcaggtgcttgtcaaaagcatctataaagttgtccaggttgtccggatgctggctgaattcaaaaatccactcatgggcgccgccttcatttcctttcataaatacaggtgctccagtgaaatcggtgatgtgtgcacccgttacttcgcaggcctttgaaagagcagattctacattggtaatcattagttcctctccaaaagcattgatgtagtgctttgttcttcctgttatttttattctgaaaggattggttgaggtaaagaccacagtatcaccaatcaggtatctccaaagccctccgttggtggtaatgaccatagcgtaattttttccgacttccacatcttccaggcttacgaccttcggatttgaaaaatggaactggtccatcggaataaattcataaaatataccataatccagcatcagaagcatctcatcactgtctgatctgtcctggatcccgaagaagccttcagaagcattatagatttcgtagtaattgatgttttttccgatgatctgtctgtattgctccctgtagggcttaaagctgattccaccgtgaaaaaacacctccagattgggccatagctcacaaatacttcctacattggtttccttcaatactctttgtagaagaaccatcatccagcttggtacaccaaggatacttcccacgtcttcatttttaacttcggaagtaatcgctttcagcttactttcccattctcccatcagagaaactttcttactgggcgttgtggtgatttctacccagaacggaaggttatcaattaaaatagcagataagtctccaaatttggtgttgaaatctgcatacagctcagagctgccgcctaaacgtaggtttttatagttaaaaagctggttttccggatggttgttggcataaatggaaaccatatcctttcctgctttcatgtggcagtactcaagactttcagcagagatagggatgaatttgcttctggcattggtagtaccggatgatttggcaaaatgcttgatgaggcccggccagcttacgtccttatgtccttgcctagctttttcaatatagggctccatttcctcataggtgacaataggaactttatttttaaaatcctgatagcttgatattgaattgaatccgtataattttccatattccgtgtcctctgcatgaaacagctgtgaaaagagtatccctttttgtgtttcaatgggatggtccatgaaattctgtatctgatcaatcctttgacggataaaccagttgactacggtattgaaaagtgctttggttgccattccaacaaatataatgatatttgaattttcagaaaattttttaggtgattaaataaaaaaaccgttacaaattttgtaacggtttgatatctagtttattgtctgttagcaatactcatcgtatgcagcctgaagatttgctgcaatagcacccgcagggtttccttcaatatggtgtctttccagcatgtgaaccaattcaccatctttgaaaagcgccacacatggagaacttggagggaatggagcaaggtgttttcttgcttctactaccgcctcagtatcatatcctgcgaatacggttgttaaatgatcaggctttttatcgcctgttaaagagtatactactcctggtcttgccgcacctgctgcacatccacatacggagttgattaccaataatgtggttccggactgcttcaaagcttcttctacctgagcaggagttgttaaatcctggaaacctttatctgtaagctctgccttcataggcattactaaatctgttggatacatatattttgttttttatctctacaaagttaagcaattctttgcgtttgttcaatatataaaaactatcaatggattagtcatacaaaattaatagaatattaataatgtaataatattcaaaaaaaagtgaattaagactaggaataatgaaatattattattaaatttgaaatgattctgaaaaacaaacgaccgtgaaaaaacatttaaaagctttccctcaagcaatcaaccacttaaacactgtctgaaatatggtagtattttaacacttttttcagtttagaatcaaactgactgacaaactttaatatccaaagaaatgaagccctgaaccgaacagttcagggcttctttaatcaaatcgatatgcaaaggttgtatatcctatagttatggtgtgaagtgtgctgtttgggcttcagaatggctctgaatcaaacgcacatcacattaagaaaggagttttttagccatctcggaaatactttttccgtcagattttccggctaatgcttttgatgccactcccattaccttccctaaatctttgacagattcagctccggtttcagaaataatgtttttaatttctgtttccagttcttcggcagaaagctgtttcggtaaaaactgctcaataactttcatttgagcatcttctacttcagcaaggtcatttcttccctgtgccgtaaactggtcgtaagaatccttacgctgctttaccattctctgaagaatggcaatttcctgttctgctgttacttcagcccctacagcctcagttttaagcagtaatatctgagattttacagcacgcagagaatctaaagccactttgtctttagctctcatggctgtttttatagcttcgtttattgtattttctaaactcatgtttatatgcttttggcttctggcagttggctaatagctttcatagggcccgagagccatttgctaatagccaattgccaatagcatttaatctacgtctttatttaaaaacctgttttctctgatctgcatggaaccgttgttatcagacaggtatgtattgatattctggtctgatgcattgtttccgtcgatcgaaatattttttcttttgaaggcaggaatagattcaaattcactggtgctgtcaaagctttgatagcgggagttgaattcttttaatttatttcttctttcaatcactctttcctgatcgatcgttttattcacgaaagtgaattctgattcttcagttttcggagtttcagttttgttttcaaaagccggttttatttcagctttaggttcttcctgtttctgatagaatgtttcaatcttttgagctggttcagctacagcagcatttgttggggtattaaattctgcttttggctgtccgaaatccgtattcggctcgtttctgacaggctcgtttacaaagaagctgaattcaacaggtttttcctctgaaaaagagcttgtaaacggagttccggattgtggctcatcttttttattttcaaaatcaaatgagaaagactggatctcaagatcgttaggatcatcatgctcttcatcaatggaaaataagctgtattcttcttctccgccttcttcatttctccagttctgttcaggagtatttaccgtatcttcttctttatcaaagaattttatttcagttcttggctgttcttcctcaatgatcatttttttttcagtagacttcacattgaaagagatgtcgtggtcttcgtcatccagcctgaaaagattctttcctccaaaatcatgtgtagtttctgttgcagattctctttcttctctagttttgaaaggagaatttttcggagcttcaaagctgtcattaagactgattctgattttctctgtaggaccagcaaatttcttgttatcgttagagaatcctgttgcgataacaaggacgcttacagcatctcccaattcttcatcagcacctaccccgaaaataatatcggctgtgtttccggcttctttctggatgtggtccatgatcacaccgatttcatccatggtaacttcttcagcaccacttctgatcaataaaagaacgtttttcgctcctgtgatcttgttgtcgttcagcaatggagagtctaatgcctttcttactgcttcttccgctttattttcacctgaagcaattcctgtagacatcaatgctgtaccggagttctgaagtacagatttagcatctctgaagtcaatgtttacatcaaagtaacccgtaataacttctgccatccctttcgcagcattggttaacacctcatcggcctttgagaatccctgtttaaatccaagatttccgaactgttgtctcagtttgtcattgttgatcacgatcagtgaatctacattgtttcttaatttatcaagcccgttttcagcctgctccagtcttctttttccttcaaagctgaaaggaacggtaacaatacctacggtcagaattcccatgtcttttgctactttagcaatgacaggtgcagctccggtacctgtaccaccacccattccggcagtgatgaacaccattttggtgttctgtcccatagcggctttgatgtcttcaatactttcgatagctgatttctcaccaacttcaggatcggcacctgctccaagaccttctgtgatagaagttcccaattgaactttattcgctaccgggttattatctaaagtctgggcatctgtattacagatcacgaaatcaacaccgtgaatacctttctcgtacatgtgtttcagagcgttgtttccaccgccccctacaccgattacttttataatggatgaatttccttttggtaaatcaaatgaaaatccttgtgaacctatattttccataactatactttttacaattataattggtcattgattaatgataatggataaggaaaagatcgtttatcgcttatcactcatcatttataatttactctacttcttcaaagaatttttttactttttccataagcgactgcccgaaggttaatttcgcttttctgttgtcctgtctttcattttcaacagaatgctgctccatgaccggggctgtctgctgaacaggttgaacagtttctgtctgtgctgcagcaacttccggttttggctgttcagtgacaacttctgttacttcatcaatattctgccttttgtctctgatctttaagctttccatcagcaatccgatagatgtagcaaattcagggcctttcagatactgatttttatcgttggcgatatattcattcgcaaaaccgattctgctgtcaaaacctgtggtataattggccagctgacgaaggtgctttaaatttgaacctcctccggtaagcacgattcccgcaataagctttttcttttgctcaaaagcgccatatgctttcagctcggtatttaccatttcaagaacttcttctactctcgcattgatgatctgagccagagtttttaaagaaatttctttgtccggtcttccgtgaagtcccggaattgttacaaaagtactgtctttttccaattcgggaacagccgaaccaaattttactttcagttgttctgcatgtttctctatgatggagcagccttctttgatatcttcggtaataattccgcctccgtatggaatcacacaggtatgacggatgatattatctttgaagatagcaatatcggttgtaccaccaccaatgtcaacaattgccacaccggcttctttttcttcttttgtaaggacagcttctgaagaggccaatggttctaaagtaagggcttccatttctaatccggcttcgcgaacgcatcttgcaatgtttctgatgcttcccatctggcccactacaacgtggaagttggcttctaaacgcttaccatgcattccgacaggttcctgaatttccccctcggaatccactttatattcttgaggaagtacgtggataatttcttctccaggaagcataaccagcttttttacctgatcttttaatgcttcgatgtcatcgtctgtaataaatttatcaggatgttcacgcataatataatcggaatgctgcagagaacggatgtgttttcctgcaatacctaccgtgactttgcggataggaactccggcactggattgtgcttcggatactgcagccttgattgaattaatggtctgtgaaatattattcacaatacctttatgaacaccaagacttttagcttttcctacaccgagaacttctattttcccgtgtgcattccttcttccgacaatcgcgactatcttcgttgtcccgatgtccagacctactgaatactcttgattttccattttatatcgatttgattttttctacttttccctttttttctataaggatattctcctatttgtgtataaatgtcctttcggatttattctatttttactttttgcttagatttaggctgtaccttgacgggtggctttttttctgctttttttgtttcttttgtatgtgttttcggttttgtactctcttgcggctttaccgtgtttgagctggtcttttttgcttccgctgttttgggcttcacctccgtctttttgactgcagctacggaaggagcttttgccagttccatttttcctgcttttaaaatactgtcattttctttaaaatacgggtttaaagtggtgacaatctgattctggtatttcacagaaaccatgctgtatttctgaggatcctgatataccaggtatttctccacaaaggttttgaatccctttactttaaaatcaatattatctagatctccgatttctactctatagttgccttcactggtaagcaggctgtagctgtctttattttttgagattccgataaaatattttttactgaaatcatctttgtcaatcttttctaccagttccgccagcttttcatattcatccggctgtacatttcctgtgaccagcatgcaagggtgcgaataggttcttgaaatcgggaattcaactcctttttcatctacataaaagtcttttccgtctttattcaatctgaaaaccgggactctctgtttgatgtcaagattcagtttcccattcaggttcagataaacattggcactgtctactgccggtaaggaattgatctttttttctaaagcaggaatattaagatctccaacttttcctgacggattttctttttttacaatctccctgatgtctttttcatccacaaaatataccggtgttctctcactcatttttacagaaatcttattgtccgtaatctgctcacggctgaatctcctcaatgagaagctcagtaaaaatcctaagataattacagtgacaacaatttttaatattctgtatttatttttcatacatcttttgtattcatgtatttatccattcacaaataggatcatacagggtgtctatatttcctgcccctacagtaagaaggatatcaaaatctttttcttttattttttcaaaagcatcggataaagaggatacttcttttttatctaattttactttttccaacagccagtttgaagtaattccttcaaaattttcctgaagttctcttgcaggataaatatcaagaagaatgagttcatctgctttacttaagctttccgcaaagccgtctgcgaaatctcttgttctgctgaaaaggtgtggctggaaggctaccagaagttttttatcagggtaaaatgttctgattgagctcattacagcattgatttctgtaggatggtgagcataatcgtcaatataaattttaccattttgataaatatgtttggtatatcttcttttaattcccttaaaattggcaattgcttttttcagcgtatcaaaatctgcgcctaaattatgcagaatagccagtgctgcagtagcattttccacattatggataccaggaatttcccagacaaaatcttttactgtttcagttggggtatggaaatcaaaataaatcttatcatgttccatacgcaggttgtctgaataataatccgcgggctcattgactgcataagtttgatgtcctctgccaatttccagaccttttcttacaaaaagttgtttgtcttgaggaactaaagctgcaaactgtctgaaaccttcttcgatatggctcttatctccgtaaatatcaagatggtccgcatctgtagaggtcaccactgcccagtccggagacaggttcaggaagcttctgtcatattcgtcagcttcaactactgagtacgtggaaccattgtacaggaagttggatttaaagttttcagaaattcctcccaaaaagcaagagaaaggaagatctgcttctttgcataaatgagcaacaagggtagacgttgttgtctttccgtgggttccggcaatagcaatacagtctgtattttctgtaattaatccaagaactctggctctttttaaaacttcaaactgattttggttgaagtaatccaatattccaagcgttttgatagccggagtatagatgaccaatgtatcttctttctgaagggaagttatcctttcatcaataagatcttcaaaaacgatatcaatcccctcattcatcaggttctgggtaagtttggtattggttttatcatatcccaatactttttttccggatgcgttgaaatagcgtgctaatgcactcattccgatacctccgattccgacgaagtaaaaagtctgatatgtttgtaaaatgttcatttatattttaatctttaaactcttgaaccaattcagagttttattactatattttatattataaggctttaatcagctaacatcaatgactcgttaattaattaagttttaacggtgtcaggctgtgcttgtcgaagcctcctaatctttcatcctattttttgataacaagggtaataaatcccagttattatttattattgcttccttctttttcctactccagcctttaacttgtttttcaaatcttatagcttgattaacattattaaactcatggtagaaaacaagttccacaggttttcttgtatacgtgtaactttcaggatttaatccgtcattatgttcgttaattcttctttccaaatcattggtaaagcctgtatagtaagaattatcggaacattttacaatgtatacataatatattttcattcattagtgtttgcttactggcccttcgacaagctcagggagacaactctaatactagctgttttattttactaatgtcaggctgagcttgtcgaagcctctctattttatcacattaaatatttcatctacaatctctttcgctgcattgggcttggcaaaatatttcagattgtcagacatttcttttcttatattttcattttcgcagatttctgataatgtattccagaacttttcctgcatctcagagtcttttaccattctggctgcgttcttttctaccagattcatggcatttttggtttgatggttttccgctgcaaaagggaaaggcaccaaaagcaccggtttctgtgctacagccagctctgaaatggcaatagctccggctctggaaacaatgatatcagcggcagaataggccagttccatgtctttaataaattctttcagatgaattgaagccggaagctgaaggctggatgataattcgttgtaatccagttttcctgtttgccagattaactgataccctttttctttcagattttcaaggttttctttccatgcattattcaatgttctggaacctaatgaacctcctacagaaaggattgtaagtttgtctttatccaatcccattttctcttttgcctgagcagtatcctgcattcctgaaataatattttcacgaatcggatttcccagaaattttattttctctgccggaaagccgtctactttcggataagccgtgaagactgctttagctttcttgctgaggattttattcgttacccctgcatgagcattctgttcctgaatgaaaatcggaattcccattttactggcttcataaagtgcgggtccgcttgcaaatcctcctgttcctacagcaaagtcaggcgcgaagtttttgataatctttttagattttgatagacttttcagaatcttgaaagggagacctaaattagataacaagttacctctgtcaattccggcaatatcaattccttcaattttatagcctgcctggggaactttttccatttccattttcccgttggcaccaatgaacaaaaattctgcatcaggaaatctttttcggatctcatctgcaatagcgatggcaggaaagatatgtcctcccgttcctccgcctgataatagtatttttaattttttgtccattttaagcgatatcgtttatttctgctatactttgttttttgcccattccttcttcatcataaatctgaatccttgagcttatatttaaaataatacctaactgtaaataggttaccagcattgaggttcctccgtaactgatcaaaggcagtggctgcccagttaccgggatcagattcactgctacagcaatgtttactgaaagctgaataaagatcattaccccgagactgagcacgagcaacgatccgaaaaatgccggcatcttgctggcgatcataacaatccttatgatcatgatgaggtataagctaatcagaaaagcagcgcctatcactccatattcctctacaataactgcgaaaataaagtcggaggcagattgcggaagcatttgtttcaatgcactttttcctggtcccattccggtaattccaccatgtacaatggctgctttggcctgcattacctggtaattttttgcttttacactttcatcatccacatcggctgttttggctttgctggatgtaaatgtttcaatacggctcatccatgtatgaacgcggtttcctccaataagattggtatttaaagcaatcaataagaagaatacgatggccacaaatgatgcggaaataaatcctgcaatgtatttccagtgaagctgtcctatcacaagaacaatcacagaaaccattaaaatcattaacgcagtggaaccgttatctttggctaccaacacaaaaacaagcaggataggtccgaagatatacatgatattctctatcggaagtctttctcttgtaatttttttggttagatatctgcacagatagatgattaacattaaaaaggcaaatgatgaaggctggaaggagatcggtgttccgggaattttcagccatcttgaagcactggctccgtcaatggtctgtcctgtaaacatcgtaaccaccaataggataatcataaggccaagcagaatactgctgagctttccgatgtattcatattttacggttccaaccagtctcataatacccaaacctaagactacaaagaacatatgtttgataacgtgacctgttgtggtcccgttattgacaatgtattcaagatttgaactcgcagagtagacagggaaaatagagaagatggagatcacaaggatgaccatccaaagtactttatcgccctttagaaattcaaatctgctttctgtgttctgttcgtccatatttaatgctattggcttctggctaatggccattggcttttaatacctgctctttaaactgtcgtcctctgtcttcgtagcttttgaataagtcaaagcttgcacagcaaggagacaataaaacggtatcaccgtttttagccagtgattttgaaattctcacggcttcttccatacttgaagtgtcataaataaattcttttttatctttaaagaaatctatgatcttcttattgtcaattccaagacaaacaattgcctttacttttcttttaactaaatcctcaatttcggtatagtcgtttcctttatctaatccaccaacaatccaaacggttggtgttttcatgctttccagggcatagtaagtagcatttacgttggttgctttgctgtcgttgatgtattttacgccatcaatttcagtaacaaactccagtctgtgttcaactgcctgaaaggtcatcaatgaatgtctgatactttcattgttgatttctaatattttaccggcaattgatgcggctaagctattcgctacattatgatttcccaacaaagacaattcatcaactttcattgagaattcgtctttcatttttaccacaatttcatcttcattcacaaaacctccttccggtaatttctcttttgttgagaaaggaatcattttagcttttatctcaagcttttcaaggagatttttgctcatttcatcatctttgttgtagatgaagaaattatcattctcctgattttcagcaattctgaattttgccaaagcatactcttcataattgtagttgtactgatccaggtgatcctgagacagattcagcaataaagagatataaggcctgaaattctgaatatcatctagctggaaagaacttacttccaatacataatattcatgattttcatctgcaacctgcttcgcaaagctgtagccgatatttcctcccaagcctacatttaatccgtcatttttcaggatataatagatcagggaagtagtagttgtttttccgttgcttccggtaatagcgataatttttgcatctgtaaattcagaagcaaattcaatttcagaggaaagtctgattcctttttcatgaattttactaataatatctgccttttttggaattcctggactttttacgatccagtcagcatttaaaattctttcttcgttgtgatttccttcttcaaattcaatttcattatcggtaaggaactgcttatagttatccttaatggctcctttatctgaaagaaatacttccagacctttctttttagccaaataagcagcgccacatccgctttctccacctcctaaaacaactattttcatatttattcttttgtaaaatgtaaaatgtaaaacgtacaatgtatctggtgtctttttacattaatactttttacttttcacaaaatttatctcatttttaatgtgatcagacatacaatagccaatattaccccgatgatgatcattcggttcacgattttactttcgtggaatccttctttctgataatgatggtgtaatggtgacatcttgaatagtctattgttttgggcatattccagcccgtattttctttttctgtatttgaaaacaactacctgaagcattacagacaggttttcaattaagaagattccgcataatacaggaatcagcaattcttttcttaaaataatggccaaaacggcaatgactcctcccaacatcaaacttccggtatctcccatgaaaacctgtgcaggataggtattgtaccagaagaagccaattacagcccctaccattgctacagcaaagatggtggtttctcccatgttcggaaggaacatgatgttgagataatctgcaaagatgatatttccggaaaggtaagcgaaaagggccagcgtaagcagtataatggtacttgttcctgcggccagaccgtcaatcccgtctgtgatattggctccgtttgaaacggctgttacaatgaaaattacgataggaataaagacaacccatgcccactcatgggcatctttgtcattcatccaaaataaaattccactgtaatcgaattcattattttttgcaaaaggaacggtggaaacggtaattttttctgtaggcataaagttttgctctacgttgtttctgttgaccaccttagcatccgcatattttcttttaacggtaatgtccgggtggaaatacattgtaattccgacaattagccctaatccgacctggcctacaattttaaatttaccacttaatccgtctttattttttttaatcttctttaaataatcatcaaggaaaccaattgctcccatccataacattgaaaccagcagcaggacaatataaacattggtaatccttgtaaacagcaataccggaataatggttgccagaataatgataagccctcccatggtaggggttccttctttctgtttctggccatccaatccaagatcacgtaccaattcacccatttgttttgttctcaggtaattaatgactctttttccgtagacaagagcaataatcagagagaataatacagccattccggcacggaaggaaatgtatttcagcattcctaatcccggaacgtgaattccatggttggttagatattcgtatagatagtatagcatagtttcaattgttaataaatgatcattgataattgatgaatgattgaacaattattctttcagttatcatttgtaatttatttgctcattaatttccagagctcattaattacttctttgtcatcaaaatgatgtttcacaccattaatctcctgataggtttcgtggccttttccggcaaccaaaacgatatctttaggctcagcaaattttatcgccatttttatggcttcttttctgtccggaattgaagtgtatttgctgaagttctgtggctcaacacccgcttcaatttctttaatgatctgcgcaggatcttctgttcttgggttgtctgaagtgatgattgccagagtagattttttagtggcaatatttcccatttcaggtcttttggagtggtctctgtctcctccgcagccgaacacggtgattaatctttcgtttttggttctgatatcgttgatgctgtccaggatgttttccaatgcatccggagtatgtgcataatctacgataaagaaaattcctccatcagatttgagggtttcaaatcttccggaaactctttttaacttactgatagcctgaagaatttcatcctgttcaaaacccagttcagcagcaattccaaagacaagaagcaagttgtatacattgaattttccggtcagtgtcgtccagaattcttttccattgaagttcagcagcattccgttgaaatccacttctaaaagttttccgtgataatctgccatggttttcagtgcgtaagacttctttttagcctttgtattctgaagcatgacattgccattcttatcatccacattggtgatggcaatagctgtatcttctaattcgtcaaagaatctttttttcgtttttaaatattcttcgaatgttttatgatagtctaaatgatcatgggtaagattggtgaaacccgctattttgaaatgtagcccttcaatcctgttctgggcaattccgtgtgagcttacttccatgaaagcaaattcgcatcctttttctatggcttcagctaaaatcctgttgatggtaatcacgtcaggcgtagtgtgggtagccggtataatttcttcaccaattctgatttcaacagtagaaagtaacgcagcaggataacccaggtttttgaaaacatcaaaaagaagggtggaaacagaagtttttccattggttcctgtaactcctatcagtttcagcttctgagaagggtttccatagtaattggaagcgagatgtcctaaggctttagacgaatcttttaccaggatgtatgttacattttctgccaatgtttgagggagttcttcgcaaacaactgctgcagctcctttttcaatagcagatgtgatgaatgagtgcccatccactactgttcctctcattgcaacatatagagagccttctgtaacttttctgctatcgatcaccaattcagtaatttcacggctgttatctccgtgaatttccagtactgggattctgtttactaattctgttataatcatctttatcaataaggctttgccttattttgttttaaattgcccttccggacttgtttcttaattctgcagagataaataaattctctggtttttactgatcgttgtgccttccagcgggaattgttctttaattcttcctactcctttatagtcgacacgatagcctaagttttccaattgcgggatcacgtttttcccgattaatcctacgacattaggcatctgtttatcatttactgctatttttacattaggctcaaccattttgctcaggtttacctttttgtctaccagcatttctttttcaatattctgtggagtcttcaggaatgtctttcctgcaatttccttaaacaccggtgctgaaacggaacctccataaaaaccttttgctgtattcggctcactgatcattacataacaggtgtattttggagcgtctgccggatagaagcctgcgaatgaggcacggtacttcatagggccgggcagccagtattcaaatcttgcagttcctgttttccctgccattttcaggttaggcgtaaaaatgcttcgtcctgttcctttttctacagctttggttaaagcactcgtcatcattttaatagctttttcagaggccattctgttgaccattacttccggttttgcctgatacatcacttttccgtctttcatgattttatcaatgaataaaggcttaagcattttccccccgttagctaccccattataaaatgttgttaattgaagcaggttgatattggaagaatacccgtatgatatagaggcaagtgttgctgcattccatcttttattttccggagtaacaatttttggttttgtaatacccggaagctcgatgtccattttgtcgaataatttccaacgtttcaggtgatcaaggaaaatctgtggtttttcagcataatactttgtgatcagtttggcagtacccacattactggacttcgccagtacatcactgatatcgtatgttccacctccgtggccatcggaaattctctgttttgcatatacccaaacgccgtttccaacatttaccgttgtgttttcatcaataaatccgtcatccattgctgctaaaagcgaaatggttttaaaagtagatccgggctcgatattgtcttttagtgcatagttgtaagaatcttcataatcgccggattctgtccttcttaaattaacaagagcacgtacttttccggtttcaacctccatgacgattacggtgccatgttttgcttcaaaattaattaactgcttctcaagagctgagtgcgcaatgtcctgaattctaaggtctaaagtggtataaacatcttcaccatctacaggttcctgaactttccagaaatcaatcggtttccactgggaagaattaattctttgttccagcctttttccgtcagtacctgtcagatattttgaaaaagcgccttccagtccggatttaagctcgccgttatccataccgatggtaccggctccgatttctgaggtagccaattctcttttatagtttcggtcaacgataaatcctcctttatttttacctcttttgaagatcgggaactttctgattctgtcatactggtcaaaatcaagcccttttaccaaagtgtagtactgatttttcttttttttctgctcatcaaacttctgtctgaattcacttctcggtttcccgaacattttacttagggaatcagtcaatgctccgatgttgttggagtacaccgtatctttcatcgttttgaagtcaagatagatgtcataacgcattacagttgtggcgagaatagaaccgtcggaagcaaaaagattaccgcgggcagcctttaaagtggcttcacggtagtttttattaatgtaatcatctttaatttcctggacattggtattctgaaggatcacaatccttgccagaaacataacaaacacgcacaaagctaccactgcaaagaggtagccccatcgtaacgtttttttacgtttattgtcgtattcattttgcttttgcatctgtactgtccagttttattagcaatttgtgagggtggttttccagggtcatcaatgaatcccgtgctacctctttccccagctctgattccatttttactttgatcagcttactttgagcgtaagcatttctcgatttatattcttctgtttcttcctttaaggcgtttacaattttaatttttttattgacgagatggttggtataaatcatggccatcatcagaacaaacagcaggagaaaatacttgtaatgtattttgatctcatcacggttcagaaagtttccttttataatgtctataaaagtgagtcttttctgggggcgatttgttgttctttttgccaatttattatgtcaatttgctttgcagtgaatttacttcgtgtcaatagtcaattttactttgcttaatgattcactattgacgattcactcattcacattttatactttaattcctgttctcatcttggcacttcttgctcgcgagttttcttcgatctctttgtcatcagggatgattgctttactcttgaccaattcgaatgcctttttataatttccgtagatatctctttccggttctccctcgaacattccgtttttcaggaatctctttactaaacggtcttccagagagtgataggaaataacgactaatcttccttcaggtttcaaaacattgtaagcctgaaccagcatttctttcaatacttcaagttcctgattcacttcaattcttatcgcctgaaaaagctgtgcatagaatttattgaccttgtgaggcggaatgtagctgaacaattttttcagatcttccgtagtttctatactttttgtttttctgtgatgtacaatttctctcgccagctttcttgcttctcttaattctccatagtgataaaaaagatcggcaagctcttcttcttcatattcgttgattactcttttggcatcaagattctgcatcacattcattctcatatccaaaggagcattgcttcttgttgaaaaacctctgtctgcctcatcaaactgatgagaagacacccctaagtctgccaaaacgccgtctacctgtgaaatgccgtacatcagcaatgagttttcaaggaatctgaaattctgattaaccaatgtaaaacgtggatcatcaattgtatttttaagtgcatccaggtcctgatcaaaactgaacaatcttcctttatcggaaagccggctcaggatttcttttgaatggcctcctcctccaaaggtgcagtccacgtatattccgtcaggattcgtcaccaaatcatcaacactctgcttcaacaaaacggggttatgatacatgcttaattgtgttttttatttaatactatcaattaataatctactgcagttattcttcgtcgaaagaacccatcacatcttcagcaaggcttgcaaaatcagcttcgttggttgcaatcaccttttcataggcgtctttatcccaaatctcaaagagttctcctgggctggtaatcacaatatctttctgaagatttgcaaaaaccgtaaggtcttttgagatctgtagtcttcctgcattatccagttctactgtttttactcctgccgtaaacattcgtatgaaatcagcattcttttttatgaacctgttcagtttattaattttacccatcagtttgtcccatgcattcataggataaacttccagacaaggttggaacacagatcttttgactacaaacgccttatcgtcgaagttttccatctgtttgattaaagatgaaggaacttttaagcggcctttgtcgtcaattttacactcatatgttccaatgaaatttttcatttgggacaaatttatataataatttccaaaatttcccactttttcccactttttgactcaatgttaataagttttattaaagattgaatttcaataatgtaaaatactgatatgaagagacttgttgaaagtgttatttaggccataataaagcggttctgaaaaaaaaagttaaaaaggagaatattatattatttttatcttaaattaggataatcaaaatttttttgaggtttaatttgtatttttgcagggctttattaaggcgttttatgatatttagtacaaaaaaagaaaagaaatattcctatatagaagcaggagaaggacatccattagtgctgttgcacggtttaatgggtggtttgagtaatttcgataaaatggtagattttttttcggaaaaagggtttaaggtctatgtgcctcagttgcccatctatgatctgccggtactcaatacgaatcttaccactatcgcaaaatatattatcaagtttatagaaagtcatatttcaggacctgtaaccattgtaggaaactcaatgggaggtcatgtagggcttattcttactctggcaagacctgatctggtaaaaaacctggttcttaccggaagttccggattgtatgaaagaactttcggggacagctttccaaggaaaaatgaccggtcttatatcagaaagaaaaccgaagaagttttctatgatccaaagattgcaacagaagaccttgtagatgaagtttttggagtggtgaatgacagaatgaagggaataaaaacagtaatgctggccagaagtgccatcaaacataacatgctgaatgatcttccgaaaattttgacaccaacctgtctgatatggggtaaacaggataatgtaactcctccggaagtagcagaagatatgcacaagtttattcctaattcagacttgttctggatagataaatgcggtcatgctgccatgatggaaaagccagatgaattcaatgagatcctgtacaactggataaaagataaagtttaaaaacatataaatgaccattaagagcttttcttaatggtttatttttctaaaatacattcaaaaatgattatcaagacagcagagtttgtaaagagtagcggaaaatggcaggaatgtcctgaacctaatattcccgagtatgcttttatcggaaggtctaatgtaggaaagtcatcactcatcaatgcgatgatgaatcataaagatcttgccaaaacatcacagacacccggaaaaacccagctgatcaatcattttttagtgaatgaaaactggtatcttaccgatttacccggatatggatatgcgaaggtttcaaaggtacagcgaaaggattttgaaaaactgatcaccaattatattctgaacagaaggaatctggtgaatctttttgttctggtagatgtaagacatactccacaaaaaattgatctggaatttatccagtggtgtggcgaaagcggaataccattctcaattgtctttacaaaagctgacaagctgaaaccgaatgccgtaattaaaaatgttgaggattataaggcagaacttcacaaaacgtgggaagatctccctgagttgtatattacctcagcagaaaagaaggaaggaggagataagattcttgattttattcaaaaaaccaatgagtttttaacccataataatataagctttgatgagtaatattgtctggaaaatcaaaacatttgatgagtttactgttccggagctgtatgccatactgaaagcacgtattgatgttttcgttattgaacagaactgtccttatcccgatctggataattatgatcagaaagcagtccatatctgggcagaagaagacgggcaggttttagcctactgccgtatttttgataaaggtataaagtatgatgaaacttctattggcagagttcttaccactgagctggcaaggggaaaaagccttggaaaacaactgatacaatatgctgtagaaactatagaaaaccgttttcatacttctgaaatcagaatttcagcacaggattatctgttaaaattttacagcggtttcgggtttgaagacaccggaaagaaatatctggaagatgatattccgcatacggaaatgataagaaaataaaaggtatcccaaacgagataccttttttcgaactgtgtataaaattatattggcgttattagttttttctcatcatttcttacatcaaaagtaagataactgagaaaattaaccttacgggaaaccgtaattggttaaattattcctaaatctttacaaaaagcaacaagctgttcgttacttgttatctgtaaatcttccttcatactgttcagttttttctctatactgcttaagctgttcggcttaataccgttgttttgaaggtatacaggtatattcttttgtaaaactccctgtgacaaaagagaaactaaagtgatgtcataattggaaaactcataattgttgagtttccttacttcctgtttaaggtcgagggaaagataattttcattcacataagttgaagcaattgctttttttaattctttggaatcatttctagccttacgaacaaaaccattgattttgtattcattaaaaagattatctataactccggatctgtgctctgcggaaaatacaatgattttcaaagaaggctgtaattctctaacggtttttatcagttcctttccgtctttaagattttgtatattgtggtcttcttcaaaagaaagatctgtaattaacaaatcataaagattattttcacgaatggatttttgaattttagctaatgcatcatcacaataatacacataatctgtgttggaaatactcaggtcttccagtgttttctgcacagagatactgctgctttcgtgatcttcagctattaaaatttttttgaacattcttttttcttttttaagaagcaggaaatgaaatatagattttcaatcccttttcggtttctgtgtcaaaaataatttctccacggatagcttcaatacgggaacccgtatttgtcaaaccatttttaaaagttattccttgcgagataccaattccattgtctgtatactgaatttgtatgatattattttttctttcaaatttaaaagcaaccagagtagcctggctatgttttttcatattaaccagaagctcccgtattacctgataaatttcttcccgggtaaattctttcatggctagccatatattttcatcatttccggcaagataagttctgacattttcattattaaaagaggcaataagagcagaaactcttttgctgaattcgggtttatcttccggggttgttttctcataagaaatatctctggacttttcatagacaaactccagttcatcaagtactttttctttgtcaaaatattcctgattttcgatctttgtcatgacctggtaaatgccgttggcaacgacgtcatgaattttcttggagactttcagctgttgttcctttaatttattatcagattctaaaagcatggtctgcttgcgttttttgtaccaaaacatagcagtaattataaggatgagggttcccaaacttatacttataattaaaatattttttttggtaatctgatattctttctgagcaatacccttctgcagcaaaagattttcagctttctttttttctacatcaaattctatcagggcaaatctgttttttgctttatcccttgataattgaatgctgtcatttagctgctgatattctgtaaaatagttctgtaagtgatttccggtatcgttttttaccagaaattcaagtgcttccagtcggtcattaggatttttaattgcttttgccagccggtatttttcattgttatgatacaacgctttagccttatccgagtataagtaatattcagcaagatgggaatggctggatataagaccagatttatcatttattttctgtcttaaagtgaaagctcttaataaaccatcttctgccttatagctattattttgaagccatctgatataattataattatctaaaattctggcataatcaatctcccgctgttgtaagttttcatctttaagcagtgtctgatagatgttgatggcttgcgaatagcttttctgttttccgtaagtatccgcaatattatttttgataacaattttttgtgtgttatctgaacttacctgtagagctttatgataccagctgagagcatccgtataatgtttgagatttttttcagatatcgcaaggttgttataaatggaaggcagataagcagagtcttcaggtaattttaagaatgaaagtgcttcaacagctctttcattgctgctgagataatctccgatatcatttagtataatagctttggttattaagcatgaggctatatttgctgaatcattctttagtttatagatactttcagcttttgaaagaagtgtaaatgccttttcattatcattattatagagagctgttgcttcattgtacattttatctgcttccgctgaagtagtttttaccggaggattattgttttcggaaaaattgcagcttatgaataaaagaaaaactcctaaaaatttaaaccgggcatgcatgataatagttgataacaactaaaggtattaaaaaaaggacaattttcattgccctttactgaattatttttttggtggtaaaatctgtcctgtttcgccgcttgtatcttccggtgctattcctcctgttccggaagaaaagcaagctgtaggagatacattattatcagttgctgaaatattggcattgttatctgaaaatgctaagcctaatagcattaaaataatctggatcatttcctttaaaattttcgaagttgaaactgtatttcttcctctcacgaaatggttatcgcaagctgtacactgttaaaatttcgaagcgcttcttatttttggggaagtgaacctttaaaaacggaggcgaaacatctgcttcccgatccggagtttaatctctgttttctctggttttgaaatcagttttttatgtttttcttgatttctgagacaaatttgcagcaaaacagtaaaggtatgttagacaaaatacagacaccaaaggacaataccaaagagtggagttatttacggaaatccgtaatgtgatatgactgaaaattatctactttgtaatgcccgaaaacactgtatatgtccaagaaaaaactactgattaatgaagtatttcagcaggcaagaagagagtcagagaaaaccacgaaaagtggattagcttgctatctgcatctttattttattgataatctgaaattttatgatatttccgaaaaaacatttatccgatattatgaagactttgttgaaggcaatagtaccagaaatattgagttggaaagattgaataaaatgagtcaatatatcggttataaagatttcacggatttttcacggacttttatcagaaatgatgaaaaaaaaaatatgacaacagtaaaaataagtgtggatcaggatgaggagattatatcagaaaggctgtctaatattaatattaatatcatcaatgagcagcatattaaaatgcctgaatttgtaaaacaaaatagttttggtctggtaggcatattgatgctcgggggatttttgattggaagtttttattgctcaaccggaaataaaagtgcttatgaatcatttaattttttgaatctgccggtaattgagaaaaactgtatgtattgggatcagtatgaatataaagcaacagcttgtaaagaagaaaatcttatattaaatattgttcctaaggatgatattcagattaaatattttaaacgtattacacggaaagatacgcttacagtagagaatgctctgggaaaaacatggtactccaaagtaaatgggaaagttgaattttttacaatggatggaattgatcctgaaaataaaaaagagctaaaaaagtcaactgaatatatcatcaggaaatattccggaaagaaagctgagatgattcccacagaatgaaacttccttcacaattatttaaaattcaattataaggaaatccttaccaatttatgataaacaaaaaagcgaaaagaaaatctcctcgcctctgagttttattgatctgtaagtatcctgtttacattttggtaaattaattaaatatcaataggaacggactttagtccgtttaatcgaaacttcagcctttcttcggctttagccaaaacctaaaactgtaaggtttactctgcattcagcattcccagttctccgaaatgttttttaaacttctgaattttaggccccactacagcgctgcaataaggctgtgtcgggttttcattgtaatatccctgatgatattgttctgccggccagaatttatcgaatttcgttaattcggttacataaataccagcccatcttcctgattcctgagatactttgatggcttcttctgcttttgccttctctgcatcatctttataatagataacagaacggtattgggttccgatatcatttccctgtctgttcagctgggtgggatcatgaaggaagaaaaatacatccattagctgttcgtaagaaataacagtcggatcataagtaatctgtaccacttccgcatgtcctgtttctcctgtacaaacttcctgataagtcggattgtctttatgcccgcctgaatatcctgaaatagcagattgtacccctttcagcatattgaaacagctttccacacaccagaaacatccgcccccgaaagtaatctgttctaaattattgttgtccattgttggtaattatattgttttatgatctcttcctttatccggaaaagctgatcaaaaataggaaaaactttttcatttgaacacggttttaagtcttaaacttaaattgtaatgatagatatgacaaatgatttctaaacacaaataacacaaatgttttttacgaatagccacaagaaaatatagcataatcatctgtgaaaacctgtgtaatctgcgagaaaaacaaaaagcaccctaaaaaggatgctcttaattatttaaaatagcgttcagttatttttcccaaaccaaagcacttgctccaagaatggcagcatctgcttcgtcaagctcactgaataccagttttactttatttctgaagataggaagaagatttctttccatatgaagcttagctggttttaaaataaaatctcctgctttaatcactcctccaaataaaagaatagcttcaggtgaagagaacatcacaaaattggctaatgcttctcccagcttctgacccgtatatcggaaaacctcaatagcgatagggtcttctttgatggcacattcgtataccgttttagaattgatggcatcttcaggatattgattcagcatagattccgggaactctgccctcattttctttgcggtgatggtgattcctgttgcagaagcataagcctccagacttccttcagaacctgtgctccagtgctttctaccgccgggtttcactattgtatgtcctaattctccggcaaacccgtcatgtccatagattaaacttccgttggcaatgattccgctgcctactcctgtacccagtgtaatcatgataaaatccttcattcctctggctgctccgaaaagcatttctccaagggctgctgcattggcatcattggtaaccgtacaaggaagaccgaattttgctttcatcagttccgcaaaaggaatcactcctttccagggaaggttaggagccagttcaatggttcctttatagtagttggcattgggtgctcctaccccgattccgtcaaaatgcttttcagcaccatgtttttccatcatgggatgaacatgttcatacaaagcatcgatgaaatcctcaactttgtcataagcatcggttctcagatttcctttatccagaacttctccacggtggtttacgattccgaatttagtattggttccgccgatgtcaactccaagggcaacttgttttgataaatctattaatgacatttctatgattaaattctaagggctaaaattataaaaaagattgtattaatggattattaactgagttttatttaatgccttaagctgtttttattgattttttcttttttcttccccgccagatcataaatcctgtaaccggaagagaagcgcatataaggcttacgataaaagcaataatcttggtaggaagtcctaaaattgcccctacgtgaatgtcgtaattggcatttaccactttctcaccaaagtttttgtccttcggatcatgagtatggagaagttctcctgaattttcatcaaagattaagctgctgcttttatgataagaataagacaaatgcttcacatacacttcaaagttaggatgctcgtgatcatccatgtgaggatggcccagatctatagcaaaaccataagcatcgggatattttgtctgtacagtattaataattttatcaagcgttccttctgttctcaactcaatgggagcttttgtcttgatatgggagaagtcaggatactttgtttctccaccggaaaagatcacataaatcatcgcttgaacgacaaagaatgcatagaaaagtcctgtgatggaaaagatcaaagcaaagatagatgcataaaatcctaatacgttatgaaggtcatagttctttcgtttccagcttttgatatttttccatttgaaagagaaacgctgttttcttgctgctttgttcttgggccaccaaagaatgattccggaaatcaacatgatgataaagataataactggaattcccaccacatacgttccccagtcctgtttcagaagatagctccagtggatcatttttacaatattgaagaatccgtttttctcatcataaactctcagtacctttccggtgtatgggtttacataagcctgtttgtaaataggaaattcatcaaaataattccaggcatctgtattatgttcgtaccaaaaaaacatgtaggacatttttttatcgataggaacactgacccagtggatcggatatttttcttttacctgttccgcgacagccttttccattacccggataggaagtacctgcttctgttcaatattctgctcatgatggtagatgacatcttttcgggtgatattttctacttcatccttaaaaacgtataatgctccggtaatagaaataataaaaatcaggaaacctatgcccaatccgaaccagagatgcagctttgcagaccattttttaatgaatcccggtttctttttatgatgatgctttttcttcatatcgcagtaaaagtaaagcaaatataagcttactctttattcagtttaattaaaatctatattcgaccatgaatgttcctctaaatcccagagcattggtaaaatcactgtctcttgcggtccaccatgaaatagcaggctggtagagtttattgaaaaggttttcaattcctaatgatactctccagttctcattaacctcataacttgatttgaaattgaaaacagtatactcaggtacatatccttcaccataagcatataatcccgtcttggcattaggttcaaatctattttgctggaaagagtggagcatatcaaatccaatggagagagcagggatcggtctggcctgcacatatgctaaaaccttaggcgcagaaattctgctgttgttgatttttgtggaatagtctccgtcatcttttacagaagtaattccttccatccagctgtagcttccgccaaactggatccatttcactggggtaaagtgtaaaaatccttcgactccatacacgatttcaggagatcgctgaatcattaatgctctgtccgggctctgtacgaatgatgctccaagtttggatgtacttacataagaagttaattcataattcaaccagctggaaagctgccctgttgcccccaattcgtaattattaacgatgatgggttttgtttccagatttttgatcgtttcagaagttgaggttcttaaaattcttcctaactcattaatggagtaggcctgagaaaagcttccgaaaagattgatataaggttcaatattgtaacggacaccgatatttcctaccagcgcattatagttcagctttccgccggctacaggaatgcttttggtgaaagtaccgtcacttttaagagtagaaagggtattgaaatcatcaacatttactctgatgttttcgtagcgaagccctcctttaatcgtaaactttttaaacagatcaatttttgccagcacaaaaggtgcaatattggtcatgttcatgttaggagtccagaaacgtccgtcttccagcttttgtacagtttcatcattcagaatatcagctccatagataatttctccctgagagttggccgaattccaaagctgggtatcaaaattaaatctggctcctgcttttttggagattacattagattgtccgccattgaagaacgtatcgctgtagccgtaaacggttttaaaatcctgataatagagactgatatttaacgaagttccggcaaaaagattcttattgtcatagctcactctgatgttgtggttcttcggagttccctgaggggttgtttccaatccctttccgattccttcaccaatggttggtgttatgccgtactttcccgtttttaatcctacattcagatctgatcttgaagaataaccaatgtaagaaacctcaattctctgattttcgttgatatcatagcctattttcagcaatccgttgtaattgtccatcttggcaatgctgtaagtcgggcttatcaaaacgccatctccgtctttcgtatatccggttctttcataagctaatgaaagggtatagtcaaatttgttgatctttcccgatacaagctggctggctcttactcccaaagtgccaccataaggctgtccggtaagaccaatctgtgaaattcctgagatttttttatctgttttgtttcttttcgtaatataattgatgatccctccgtcggctccgtttccatagatagaggaagctcctttgatcacctctattctttcaatcgctgaaggatctatcgtccttaaatctctggccccattacgaagtggtgtagactgaggaatgccatcaatcaaaaccagaacctggcgtcctcttaacgtctgtcctgtattggaagtctgtcctgaattggttcccaaactcggaacggtgtactgcaggatgcttgtaatatctgagttaacagtcagctgagactgaatctgcttttcaccgacaattgtgatagaacttggaacttctttgatgttttccttttttctggaagcagtcattaccacctcatctacatttttagtttgtaaactgtcttttacctgggcaaaaagggtagtagttcctaagcaggcagctgataaaagcacttttttcattatattttctttccttttttctttctttttccccaccaaaccaggaatccggttacagggagtgacgtacacgtaaggccggccataaaccagatgatttttccaataattccgaagtaggaaccggtatggatatcataattggcgttggaatatttctcggcagtattgagattgtgatgaggtttgttggcaagtagtttacctgaatatttgtcgaaggtcaggatgtttctttcactgtatcttccatccattccgtaaaccgttacaggaaggtttttcagctcttttccttttttattctttccgtttaaagtaattctgaagctggatgattttgaatacaggttttcagcctgtgctgcagccagatcaaaaacagcttcattctttgccatcagagagtccggagattttctttctttttcctttggaagttcccatgagccggataatgcaaaagtaaaagtgttttttacaaagggataggcaaaataaaggccggtaagactcataagcaaagcaataaatgaggcataaaatccaagtacattatgaagatcataatttttacgcttccagttttttacattttcccaattgaaccagaaacgtccttttcttgcatttttgtttttgggccaccataaaatgattcctgtaatcagcataatcacaaaaataacggttgggattcccaccgtgtacggcccccattctgagttaagcaataatccccaatggatatatttcagaatattgaatacatcgtatttttcatcataaaccgcaaggatttgaccggtatattgattgacatagacctgtttgctgatgagcacctgctgaaaataattccatccttttttacttttttcataatactggaactgataagatttgcttttatccaaaggaatttctacggcacttacaggatatttttcattgagttccagtgatactttttcacgaagcagattgataggtaaaggttttgtccctacatcttcttttttaagatatatggcttcttttcttaagctatcctgtatttcatccttaaaaacatataaagtccctgaaagagagactataaatacaatgaatccaacagacaaacccagccacaaatgcagctttgcggaccatttttttgttgaagaaatctcctttttatgatgatgcttttttctcatagcaaaaagttaaccccatgaggggctaacctttgaatttttaaaatttataagtaacagatccaagtacgttgattagtttttgtggattcgctgttgtatatccaatccagtaatgctgactggtaaagttgtcaacttttactccaactctgaattttcttgcgtcgtaaaatgcattggcattcattacaaagtactttggaagtgtaaaagtagatactctgctggttgcaggatctaattgattaaatatcttgttggcattggcaaaatttcctcctactccaaaaccaagtccctttaagtttccatccagaaactggtagcttgcattgaaattagccagccatggagaacccgccgtagctggtcttaagcctgtagccatatccgtagtatcattataggaaagaccacctattaaagaaaatcctttgattaagtatgcatttacttctaattcaacacccttactttggatttcacctgcctgagtctgtactgatttacctgcaccggtatattgtccggtagctaccagcatatttttaactctgatatcataataacttacagaagcattaatttttccattgatcagattggccttgaaacctccttcaaactgattcgctctttccggatctgaaagggctatacttcctgcaagatcggtagtaaaatacccgttgcttttaaaactgttctgataatttccaaaaatcgaaaatttatctttaataatctggtaaactacacccgccttgggagaccatgcagattgattataagggtctaccgtagacataaaatatttgccctcctttgcattattgttttcatatctaagccccaatacaatgtttaatccggaaattggagtgaaaacgttggaaatatatccgctgtaagtattaagatcaccatcactatcaaaatgcccaatctttgtgggatcattatataaatcacctaaagtagtcccgttgaagccagaataatcaccaccagtagccggtacgctatcaaaattaccgcttgctaaataaatatatcttgatctgtcctttgttttcagataatcaaaaccagctacggttctgtttctcattccatttccgaaagtgaagtcaaagttgaaattttgctgtatctggaaatatgactttctgctatctctggttgcctgatcatttctgtccacaagaagattgttgctggtatctactcttgcagcgaaataaggtccgaaaccatctgagtaactgcttgatgaattgatattggtagatgatttaatatgctcgttgatcttataatttatctgaccaaagatattatttactcttgccgtggtataaaggtcatttccaagataagattctctgtaattaagtcccttcttttcaaggtctttcatattatcaattcctccaaggttatctggtgtaagataaaagaagaatggttcaccaactgctcttgtattgaacatttcatattcaacattgaactgaagtttatcatttacattataagttaaagatggagcaaaggcaaaataggtatttttagcatccgttttctgaaatgttccttcattcgtataagctgtattgattctgaaaagcagtttgttgtcctttgtaagtggagtatttatgtcggcttgtgctctgtatgtattgtaacttcctccaaaaagacttacctgtccttcgaatttttcgtatggttttttagtaattctgttaattaaacctccataagaagcaacgttgcttccgtataatgttcctgaaggtccttttaagacctccagtctttcaatattaatggcgtcaatggtagttgtaaccggtgatactaagccgtttctcattgaattgttggaaggaaagccccttaaaacaataaacgaacctccatctccagctctgcttgttgccgtccacattttttgaattcccgtaacatttctgtaggcatcatccactgtaaaaattgtctggttttctagaactgatctgttaatggaggaaaaaacctgcggatcttcaatcgcctttaagggcattttgttagaatagtcactatcctttttgacataggtattaataattacttcatcaatattgttagtgttggcagaatcctttttctgagcaaaagttagcatagagcctaacattgaggcacagatcagtacatttttcatgaaagcaaaattttctgcaaatatattatttttaactgttctaaataaataataagattgatatttatcataaatttgttatatactgaataataaaaaaccgctatggtcaatgccatagcggtttttaagtgttattattaaatttttcctaagaaggaatttctcctttatataagaatgaaataatttctttgtttaatttatcgatcatttcactgaataagtggaaggattcctgcttatagattacaagtggatctttctgctcgtaaacagctccctgtgatgatcttcttaggtcatccatctcacgaaggtgaagcttccagttttcatcaataattgataaagtgatgttcttttcgaaatcgtttacaagactttcacaatgcgtttcgtaagcttctttaagatcagctacaatcgtcattgttttgtgtccgtctgtgaaaggaacctggatcattttgaacattgaaccctgattctggtatacattctcaataatcgggaatgatttttctttcaacaggttcagtttcattttataatcttcctgagctgctttgaataggatgtttgtaagatcctgaacattcttgttattaaaatcactttgagaaaccggagattccatcgtaaatgtcttaatgatttcgtattcaaaatctttataatttcctgaagcttttcctttcgcaacgatagaattagctacatcgaaaatcatattcgtgatatcatatttcaggtggtctccgaacaaagcattctttcttctcttgtagattacgtcacgttgcttgttcattacgtcatcatactcaagaagtctttttctggttccaaagttattttcttccaccttcttctgagctctttcaatagacttgctgatcatagagtgctgaattacttctccctctttatgacccattctgtccatcattttcgcaattctttcagaaccgaacaaacgcatcaagttatcttcaagagatacatagaactgagaacttcccggatctccctgacgtcccgctctacctcttaactgtctgtcaacacgtcttgaatcgtgtctttctgtaccgatgatggctaaacctcctgcatcttttacttctttggtaagcttaatatcggtaccacgtcctgccatgttcgttgcaatggttacaactcccggacgtcctgcttccgcaacgatctctgcttcttttttgtgaagcttcgcgttcaatacctgatgcggaatttttcttaactgaagcgctttcgaaagcaactgtgaaatttcaacagaagtggttcccaccaatacaggtcttcctgctgctgttaatttttctacctcttcaattacggcgttatatttttctctgttagttttataaactaaatcctgcttgtcatgtctcagaataggacggttggtaggaatgaccacaacgtctaatttgtagatctcccaaagctctccggcttctgtttcagcagtaccggtcatccccgcaagcttgttgtacatacggaaatagttctgaagtgtgatggttgcaaaagtttgggttgctgcctcaatttttacattctctttcgcttcaattgcctggtgaagaccatcagaataacgacgtccctccatgatacgacctgtctgctcatcaacgatttttacttcaccatcaattaccacatactcatcatccttctcaaataatgtgtaagctttcaatagctggctcatcgtgtgaacacgttcggatttttcagcaaattcagcgaaaagtttttcttttgcttcaaattcttcttctttagataagtttttagcttctacttcagcaatctcagttccgatatccggaagtacgaagaagttcggatcagagtttccttgagacatgtattcaacacctttgtctgtaaggtctacctgattgtttttctcctcgataacgaagtaaagatctttatctacgatcggcatatcacggttgttgtcctgcatatactgtgcttccactttctgaagcaatgctcggtttccgctttccgataagaatttgataagttgtctgttttttggaagacctctgtaagcctgaagcaatttgaatccaccttcctttgtatttccggcagcaattaattttttcgcttcgttgaaaatagcagaaactgttttcttttgtacttcaacaattctgtcgatagaaggtttaagaacgtcaaactcctgtctgtctccctgaggaaccggaccggaaatgatcaacggcgttctggcatcatctaccaatacagagtccacctcatccacgatagcaaagttaagttctctttgtaccagttctgaaggagaggtcaccatgttgtctctcaggtaatcgaaaccgaattcattgttggttccgtaagtaatatctgagttgtatgcttttcttcttccgtctgagttcggctggtggttatcgatacaatcgatagacattccatggaactgataaagagggcccatccatgcggagtctcttttcgcaagataatcgttcacggttacaacgtgtactcctcttcccggaagtgaatttaaataaataggtaatgttcctaccaaagtcttaccttcaccggtagccatctcggcaattttaccgctgtgaagaataacccctccgataaactgaacatcatagtggaccatatcccaaactacaggagttccggcagcgtcccatgagtttttccaaacagctgtgtctccctgaatgctgatgaaatcttttcctgcagcagctaactctctgtcccagtcagttgctgttacacggatttctccattctgagcccatcttcttgctgtttcttttaccaatgcaaaagcttcaggaaggatctgagtcagaactttctcttcaatttcatatgattctttctttagagactcaatttttgagaaaagagcttctttctcatcaacatttgttgaattttttatctgctcttttatctgttctatttgagctgtgatcttgctggttgcagattttatattctctttaaactcagccgtcttttgtctcaacccatcatccgtcagttgttggatgttaggttctacagccttgatttttgttacaactttttttacttcttttaggtcctgcgcttttttgtctcccaaaaaccctttaagaactttgtttaaaaaactcataaattttttgctttatgcttaatgcaaatgctttaagcgttttaaataacacttatcgtgtaaattatatataaaaagggcaaaaaagctctaagcacgcagcctaaagcttatcgctttattaatattcgtcttcgttccaaaggaaatcctcgtcagtaggataatcactccatacctcttcgatagattcataaatttctccttcgtcttcaattgcctgaaggttttctactacttccataggtgcaccagttctgattgcgtagtcgataagctctgcttttgtcattggccaaggtgcgtcacttaaatatgaagctaattctaatgtccagtacataattttctaattttttgcaaaagtataaaaataggttgtataataaacttttttatacttgattttcaattctttttataattttttcttataaatggctgtcacaaactggctgtcagctatgtcagcaatttacttaatgtcgttttctcaaaaaccattccacaaatttttttatgccattttggaagtctgtggcaggtttataccctattaattcctttgcttttgtgatatctgcattggtttttgtgacatctcccggctgcattggcagaaattttttagtggcagatttttcaagcgccatttctatagtagctaccatttccgataaagtcacaacctgattttctccgagattaagaatctcatatacctctgtattattttcaaggtaaaggattgatttggtaattccatcaatgatgtcatctatataggtatagtctcttgctgtatttccatctccatagaagggaatttcctgattttccgaaataagctttgtaaacttgtggattgcaagatcgggcctctgtcttggtccatataccgtgaagaacctgagctggatcatatctatatggtataggttatgataaacatggcctataacttcgccactttttttagtcgctgcataaggagagatagggttgtctacattatccgtttctgcaaaaggaattttttcattatttccgtaaacacttgaagaggacgcacaaatgaattttttaatctgatgttctttgcacaattcccaaaggttcatagtgcctcttacatttacttcttcatattccaaaggacgttcaatagaagggcgcaccccggcaagtgctgccagatgaatcaccatgtcaatatgatgatttttaaagatagcttcaatacccttataatcccgtatatcctgccaatagagggaatattgatcagaatgggagagggaaaccaaacgacggatgtcagtctctttatccgagaactcaaaatccgaaattttaccaattgactctaaagtgtttttaatttttacctgatagtcgtaaaaatcatcaaaattgtcaatgtttatgacagaatgtccatttcttaataatcgctcagttaaatgagagccaatgaacccgctgccgcctgttacaagataaaccatttgtattttttatggatacaaaaatataaattttactatttgaaaaatataatcattaaatttacttaaaaaagtaatataaatataatatgcagtttcaagggcaaattttaaagatgacaagctacgatgccaaacctatccagtactacctcaatctttcaggagatctgattcatatgaatgagctgtttggaaaggagttaagcataaaacatattggatttcaatgtgtaaattgtggtgagaataaaccgatttacagaatgggattctgcaaaaactgtttttttgaaagcccttatgcaagtgataccattatccgtccggaactttccacggcccatcttgatatcgcagaacgtgatctcgaaattgaaaaacaaattcagctgcagccccatacagtttatctggcctatacaggagatgtgaaagtaggagtgacaagaaatacacagattccaacaagatggatagatcagggtgcaacttttgctttacctattgcaagaacagaaaaccgctacgaagcaggaatgatagaagttgctttaaaagaacacttaccggacaaaacgaactggaggaaaatgctgcaggatgattttgaaggagaagtggatcttgcagatttcaggcagaagattaaagaatatttccctgaggatttccagaagttctatagtgatggagaagaattgtggatgctggattatccgtttgaaaaaccggaaaaagtgacttcattcacattagacaaaaaacctgaatttgcaggaaggcttaccggaatcaaagggcaatatcttgggtttgaaggaggaaatttcatcaatgtaagaggccatgaaggatatgtgatcgatctggaaatcaggaattgatcggaataaaaatataatcaaatcacaaaatatgaaaaaatgggttaaaagactattgataagtttcgggattctggcaggtatccttcttgccgcaaatttcggagttaacatatggcttaaaacccagcttccggattatataaaaaagaatacggattataaagtatcttataaaactcttgatgtggatttagcatcaggcaatatattcgcagcaggaatttccgtcaacagtaaagatccgcaaaatactgatgtcattggcctgcagggaacaattgataccttgaaaataagccgtttcgggatttatgatgctgttttcaataaaagaatcagctcttcggaccttttgctggctaagcccagcttaaatgttattcttgcaaaaccggttgatcgtaaaactggcaaaaagagaaatcctgtgctttttgaaaatatcaggatcagtgatggaaaaattgctgttttcagacataccaaacaaaagtttttatctgtagagaagttggatctgtttgttgaaaatttacagatgacggaagaatctgtagaggataaattaccggtcgtttttgacagatacagcattaaaggagaaaggttcttcttccgtccggataatatctatgccattaccatcagtaaaatcaatacggagaacggacaaatgtcggtggataacttcaggctgattccactgctttctttgggccgctttaaaaagttttatcccgagaaggtccagctctttgaattttccattcctaaaatggaatttaaagatgttgttttaaataagaacaaagtatcacttgctaatgcggattttaaaaaccctgttttggccgtgtacaatacaggggtaaaagggaaaaaaaatgaaaaaaaatcaaattttgaggttgatttaaaaaatataaaactcaataatgccattgtcaggatcagtaaaccggatggcaataaacttttatctgtcgggaatcttaatttgaatatcaatcagctgatgtttaataaagaaacttcagaacagatcattcctgtaggatataaagactttaccgttgccggaagagatattgaatattcaaaccatcagaatattacactaagaagccttgcgcttaagcctaccagcggtgagatccgggatgtggtattatcgggaggaaattcggaaacaggaaaactaatagaaggattaagaaccgaccatattgcttttaacatcaataaactggaatttgcagataaaaaactggatcttgaccttaaagatcttcttatagaaaatgtgaacgggacttttacggcaggtgaaaaaaagcagaacaacgctggcggacctgatattgtaaaatccattatcataagaaaagcttccttaaaaaattcaaatattatttatgacaagggaaaacagcctttagctttccgtgatctgaatgctacctttaatggcattgagctgtctcctaaacctgatcacaaaggtctttcttttaaagtgaaagattactatctgaccaccagaaattttgcctacaaaacgcagttttataatatgagcctcgggcttcttaagcttaataagaacagaatccaggtcaataactttgccatgaagcctctcgtttcaagagctcagtttatcaaaatgatacctgttgagagagatctgtatgacctgaaagcaggacagataactgcagaaggggcctgggagctattttctcaaaataaaatggtaaatgcttcccatgtcgttattcagtcagctgatgccaatattttcagaagtaaaattccaaaagacgatccgaaaataaaagctttatactccaaaatgctgagatccattaaaattccggtgacggttaataaccttgatgtgaaaaattctgtattagtgtatgaagaagatacaccagaaagtatgggaccgggaaaactgactttcagcaattttaatatgaatataaagaatctgaattcagctaaaataaaaggaaaaccaacaagggtagatattaaaatcaattgctcctttatgaatctgtcgccactctccgtaaactggaacttcgatgtagccgatcagagtgataagtttgcaatttccgggaaaacatccaatcttccggctagtggaatcaatccgtttatcagaccttatcttcatgtaacggctaccgcagggactattcaggaaatgctctttaattttaaaggaaatcccgccggattacacggaacctttaatcttaaacataaagatctgaaaattgctgtcttaaataaaaacaaccatgagaaaaaaggttttctgactgctgttgccaatgtttttctgaaatcagactcaggaagctttcctgaggcagttactgtggaagatgtggagcgtgatcctacgaagtctttctttaaccttttctggagaggaattgaacaaggattaaagaaaaccctgattggtaaaaacgttgaaaaaacagagaagaaagtaaaagatgcggtttcttcggtgaaagacatgaagcagtctgtaaaagaaataaaacaggaaataaaaaataaaaaagaaacttctgcaccaaaagaagaagagaaaaaagaaaagaaaggttttcttaaaggaatcttcaggaaaaaagagaaccctcaggaataattcttaaaccattaagatagaactatcactatttaataaaaaccttaatggtttaagaattaatataagaaagattcagttaaaaattgaattcatcactttcctgaatgggaatatctcttaaaaacttatcaaactcttcacccggataattactgtctgctccgtaagaatctatgatcattccgcggtttccgctattgtcttttaccacataaagaactgcattatcatcgggattgctgtctccttcaaagcggtatgttttcaaaatgaccagatccgaaggctgataaattttgtcggaattttcaaacttcatttcacatttttcattcattctgaactctctgtgtattcctctttcagaaagcgttttcatgacttggctcaaggtcgtcattctgtcgatgttttccggattttccataataatatttttgttgataagtacaataattaaaccattgcaatttctaaatataagaaaaataacagattataattttcttaaaaataaagttgaatgttaacaaaatttataatccggaaaaataaaatgggtatactttttgcaatggtatcaataataaatcagagaaaatatgaaaaaagaagttggagttttactggcagggggagttggtcttttggcagtattaagtttaataagcataaaaaaaatattgactaaaaaagataaaaaatatagtgatacttactcagattatcacagacactttgatgaaaagaaccatgaagatgaatatcatggtgtcgaattttacgcagtgaagtagtaaaaaaatatatttaattatgtttaaatccaacgcttttgaaagtgttggattttttttgtggaaaactttaatgttaaaactcattattttataaaaattccattctaattttacactggcatgcaaaacgaaaatttcataaaaggtcagggagctcagcgaaacgttatcaatcgtttcgacaggtatacctatgaacctgaagatgaagatttcgaacccttaaaaacctcttttaccgaagtctttcccaaaacaattgtcaatcaggtgaaaagcgaggatcttcccatggagtattcaatgaatccttatcagggatgtgaacacggctgctcctactgctttgcgagacccactcatgaatattggggttatagcgccggaattgattttgaaagaaaaatcatggtgaagaaaaacgctccggaactattggaaaagttttttcagaaaagaggttacaaagcagcacctattctgttgtccggaaatacagactgctatcagccggcagaaagacaatttgaaatcacaagaaaattactgcagatttgtctagactacagacatcctgtcaatattctgacaaaaaatgcattggttttaagggatctggatattttaaagccaatggcagaacagcatcttgtttccgtttccctaagtattccgacaatcaacgaagaactcagaagaaagatggaaccgagaaccagttccgcaagaaataagttaaaagcagtagaaatcctttccggaaacaacattcccgtacatgtaatggtcgctcctatcattcccggactcaatagtgatgagccgctgaatatattgaaggccatttcggatgccggcgcttccggcttcggatacacgcttgtaaggttaaatgataccgttgaacctgtttttgtaaattggatagaagcacattttcccgatagggcccagaaagtcttaaaccttatccggtctatgagaggaggaaagcttggagataaaagatattttgaacgacaaaggggagaaggcaacattgcagaaatgattcacactacctttaaagtcggaagaaagaagttttttgaaggtaaagaattcccgaaactttcaaccgcaaacttcaccggaacccgcgatcagcaattgagactatttgattagccaaaacttcgaagaaatcatatcatatatatagtataggataattttacaataggtttcgcaatattgtacatcattataatatagtaatagattttcaggagctatttcctgctattcattcatactcctcgcgcctgcaccctcccacgcccaaaccctctcgccctccaactcttgctgcggggtaaccatttctatcagggctagggaaggagggatgtaataagtaataagtaataagtaataagtaataagtaataagtaataagttggcacaataaaaatagtttatatgctataaaatagacattatgctccgtgtaaatccgcaccatttgtggttaaaaagaaaaaaaacattcaatagaaacgggttttaacccgtttacgaaaatacattctccgctggctttagcataaacttatctttttattatatatagtatattaccatcatcctaaaccccacaccccgcacccccgcatcccgtatcaccattctctcaccctcaaaccctcccacgctcaaactctcaaactctcatacactcccacccaataccccaaacaaatgtttgaaatttttctctctgcaatccagcgctttaagagtaaatattacgaaacggtaaaatttatgttaaataaacttgttttgcgttgttagaagttgctatctttgccccactgaaaacgagagtagatcagtaagcgcagaagagcttttaggtaagcaggaacattatttacttcacaagagacagacgaaaaaaactttaaaactttttgcaaaaagagttgtgagataaaaaagagtttgtatctttgcagtccgaataaatcggagcgcaggagtagagagattgagggtttgagaaggattaaggttacttaaaaaactttaaaattttcttcaaaaacatttggtcattaaaaaataaagttttacttttgcactcgcaaatacggagcactactgacagagagcgtgcttcgggaaaagcggaagatataaagatcattgacatacaatataacaaccaagtaaggaaaaactaaagcgttaaaaactttgagtgagtcagacaaacatacaatggagagtttgatcctggctcaggatgaa

SEQ ID NO: 11 - DNA, 245810 bp, Chryseobacterium sp.
cgtataagcaataagcaataagcaatgagtaataagtaataagtaataattgatgaatggtaaacgatacatcaatcaattatcatttatcaaccatcacttatcacttgacattcatcacataccccattgtcactccgcaggagtctaaacaaagtattagaaaataacacaagtattacttttacccttttaaattgtttaaaactctaataatggaggttggattcctgcggaatgacacagtagaaagaagcagcacaaatgaaaagaaagatgctattgacaagaaaagttttatctgtttagtctgttattcgtaggatagaaatcattttcctctttttaagctcataaattgcttattgcaaacaaaacctgggcttatcattataaataggtctgagtggctgaaatctactttattttaatccaaaagaaataaaaaaccacctctgtgaaagaagtggctccatttatggcattttgattttcaatcttacatgtcactgtttgtatccgggcatttgaaatcatcactgcaggttgcacaaacaatggttccattacaatagtacatacaaaaatctgtttcaggaagattagttcctccggaaatgtgttttaattggcctttttttagtttttttagatttttcatattgttttaattaaaaatttgtagttaaagtaaaaataagcaaaatatttttaactaaacaaggcttgttgtgtaaaaacaaaaatttaatggtaaaatgattctaacatttataaatctttatttaattattatgaaataaatactgattttaagcttgcgtaatccgaaaagcttacaaagtaggaaacaattaaacgataactataaaaaatttaaagaaattgaaagaaaagaattgaaaactatttgataaatgctatgatcttagagaatctccagatgatccttgtcaggaacttaataatcaaaataatgtttgttacagaatgaatagctgtacaatgttatgtacgcttgttccatgtttctaacggaattattatagtaaaatggctgcctatagggcagccattattttttattttttaatcaatcctaattcgatcaatctttcatgcaggaattctccggcagtagtatcttcgtataattttggattgttttcatctacacagttctcaagtgcatttaaagacattgcactgataggatgcataaagaaagggattgaatatcttgaagtactccacaattctcttggtggatttaccactctgtggatggtagatttcaatttgttgttggtatgtcttgacagcatatctccgacattgatcatcagttcgtccggctctgcaatagcatcgatccattctccattatggttctgaacctgaagacctttaccttgtgctcccattaaaagggtaataaggttaatatcaccatgtgcagctgctcttactgcatcatccggttcttcagtgattggcggatagtgaatgggtcttaaaatagaatttccttctgcgattttgtcatcaaaataaaattcatctaaaccaagatgtaatgctaaagctctcagcacgtactgtcctgttttctcaagcatttggaatgcctctttacctacttcattgaattttggaagttcatcaacgattacattgtcaggatactcagttctgtacttggaatcatcagacaggtactgtccgaagtgccagaattcttttaagtcgccttttttgaaaccttttgcagtttctttaccgaatcctacataacctctctggcctccaattcctggaatctcatacttttgtttcgtttccacaggcaggtcaaaaaagttttttacctctccatacaaatcatctaccaggttgtcatcaagaaagtggccttttagggctacaaaaccaatttcttcataagcttttccgatttcatttacaaatttctgtttgcgttccgggttgtccgaaaggaaatcacgcaggtctacactaggtattttatccatttttagaaatttacgaacagcaaaattacattttttttaatttaaatgattttaaaatcattatttataagttaaatttgctgtatgaaaaaatattcttctaaaagaagtatccaaatacttgcacatcttcttcagcagtatggaattgcagatatcgtcatctctccggggtcaagaaatgctcctttggctattcatttttcagaggtagatagttttaactgctacagcattgtagacgaaagaagtgctgctttcgtggcaatgggaatggcgaaaagtgagaaaaagccggtagcaattacgtgtaccagcggatcagcagtagtcaattattatccagccattacagaagcattttatcagaatgttcctcttttggtgttaacagctgacaggccgacggattttgttgatatttttgatgggcagacgatcaggcagaaggatgtttttcatcagcactcttacggtgattttcaattgctggaagacagtaaggagaatgcggaagatattaatttcgacacgataaaaaaggcgatcgagctttgttttgaaaaacaagggccggtacatattaatattcctttggaagaaccattgtacgaattggtttctgaacttccaactttcccgacagttgaaaaaacaatcaagcatagagattatgaaatcccatccaatctgattgcagaatggcatacttcacagagaattatgctgttggtgggaacaagagattacagcccggaacttgaaaatcaattgacgcaactggtaaaaaaccattctgttgtggtattgagtgaagcaaactccaacttatatcatgaaaagtttttcagacatatagaccgttatatttttaattttacggaagaagattataaaacatatgctcctgatctgttgattacagtaggacagaatgtggtttccaaaaaagtaaagcaattcctgagaagtgcccgtccgaaacagcactggcacctggatgaagtatggcagcctgatacttatttttcactgaccgaaaaaatagaagtaaagcctgaagttttcttctcaaaactgctgaaatttatcaatctggagccaagaccttactttaatctctgggatgttttaagggacaaaaaagatgctaagcatgagcagttcttaaatacaattgaattctctgatttttattttttcaataaggcttcacaaacggttcctgaaaattataatattcatttcagtaactcatcagggatcagatatgcacagctgtttgatttcgggaagagaaagatatactgcaacaggggaacgagcggtattgatggatctacttcaacagcaatgggatttgccatcaaaaatgaaaatccaaccttgctgatcactggagatctgagtttcttttatgatatcaacgggctttggaatcagtatattccaccatttgtaagaattatgatcttcaataatggcgaagggaatatttttaaaatcattccgggaccaggaaacgccaatccaaatacgctggatgagtttattgctacaaaacaccgtaaaaatgcagaatctttggccaagcatttcggtttttcctacatcagagtggaagatgaacttactctggacagagttctggagaacttcttcaagccagatgcacagccgaaaatccttgaagtgaacactcacgggaagaacagtgcagacgtactgaagtcgtattttgaatttatgaaatagatttaaagatcaagatattcttcattgcccggcagattgataattctgtcgatggagtagatgaacatgtcatcaaaatcattcaacgcattaatgatctggaaatgggagaattgctttatattctgtaaagtgatttccgtttctttgatctttttatgctttaaaagatgctgtctctgtactccgttcagcagataggtagaaggagtaaaccagtcttttccctttaaaaataaaaggttggaaaaagaagtatccgtgatatgattatttttgacgatgataatttcttctgtcttggctttcatcttcattttatccagctccttacgatcttcaaacttgaaagaataatcgaaactgttgttttctaccagctgaaaatcctgaatttcaggaatggcatagggaatcatctgtgtcctgatctttttatcaaggtcataggcaattcttagtttaaaaagaccatcttcatcgtgctgcagattcttatagattttggccagatcgatagagtcttcctttccgaaatgggaaaacgtctgattgacacgtttctgatgcagatccaataaaaaaacctcctgatcttctactttaatactttcaatgaattgggacatagattttatttttcatttcctgatactcgtcttctaatttactcatatgcgttataccgcctccgcttttgaaataaagttgatctccttctttttcaataaagcgtatcatgacacagctgtcaacattctgaccgtcaaaccatccgcagactcctgtataatatcctctgtcatatccttctgcgtccagaataatttccagtgttttaggtttcggagctcccaaaatagagcccgcaggaagcagttttttcataatacttccaattctgccgctaaactcaggttttactgtacctgaaatttcggagctcattgcgtacagatctttctgctgtgttttgataaagtcaatatgctgaaactgatctacctttacctcatcagccaccatgctcagatcattccgaagcaggtctacaacagtgtaatgttctgctttttcctttttatcattcttcaggatttctgctgcattttcaatggaagcatcaatagttcctttcatcggatacgtcaaaattttaccatcaatgatctttacaaaagtttcaggagaaaaaaatacaaaaaaatctttataaaatactttatacttagcatttgagtgataaaaaatttcttctaaggttaaattggtctctatctttgtttttctggtataatttaccagataagagtttcccagacgaatatttttctgaactttatcaaatccgattttaaagctttcctttgtttccggaaatgatttccataccacttttttgttaagattgcgtactgttttaacgttggaaaactcttgaaaatcaattattaaacctgatttttcaatctctttttcctggtatatttcaacattctccgaaagaaagtcgatcacgaaaaaatagggaaccttctgaagagaaagttcgtccatttccataaatttttgatgattcactgaaaacattccgcaaaaataattattgatgtttacttttgcataaattttttatgatgcagaacaaatatcctcagaaaccgggaatagattttatattgaagcaggcatttttctactggaataaaacactcgtttttcagttgatgttttcaatcatcttttttggaatatttcttaccgcaattatgcttttcggacagaagtatgacgttttttcatataataaagaattacaggaagcctttatggaaggaacccaggcttatctgaaaaaaatggaagaaataacggctactgaaaattatcagatgttcacactggcaatctggggaaccacagcatttttatatccattgaatcttgggatgtttcagatcttccgtaagcttgatctcagggaaaatattgtaataggtgatttgtttgtaggatataacggacttaacttttttaaatatgtaggatatttccttttctggttcttcatttacagatttacgattcctacaattatactggcagtaatttgggttgcggtgactctgtttgtcgctccactgatgttttttaccaataaaaggattttcgaagctatctctctgaattttaaagcatttaaaatgtattttgttgaaataatggtctgtgtgattgtggcttttctgtttaaatatttaggtttcgccttatttctgataggtggacttttcactttccccttttggaatgccatgatttactcactttataaaaccatcttttcagagaaaatttaaatttcgtacctgtttaatatgattttttactaaaaaaaactaaatttggtaaaatcattaaatatttaaactatgtctgaatttaacgaatttgaccagcaaggctctgtgcctaacagagatacggggtctattatttctcatgcttttgaaatgtataaaggagtcttcggttatggaatcgtagcgatggttatttacctgatcggaggatctgttattcaaatgcttacggggtttgactctgcttccatggttgaagaaatgaaatcaggaggagaatttaattactggagtgctccgggacttcctttatatatgggagtttccagtcttttcggtcttttattatcccctctgtatgtagggttgatctatatggtgaataaatataacaccaaaaatccgattgaattttctgatcttttcattggataccgtcagaattttgttaatatcctaatctacagtcttctttccggaatcatttcatctgtggcactggcattgtgtgtgctgccgatcatttttgtatatcccttccttttaatagggtatcctattcttttatttgaaaatgcttcagcaacagaggctttggggaaatcgttcaatattgctaaagaaaattatggaacatttctgttaacaggtttcctcggtttcctgatttctattgcaggagttgttctttgcggaataggagttattttgacggcaccatttattatgattgtcatgtactctacttattgcgctttcttaggaaaaccaagacaaattatgtacagcaagtaaaatagaaaagcatgatgaataaggacaagcaaataagcagtgttgcaataaagcaggtgtcattgctggcaatcattcttgtattgacggggttgatctgttttaatctggcattgtttattccctcggttctgggagcaattaccatatatgtagtctgcagaaaatacaatttttatctgcaggaagaaaagaaatggaaaccttccctggccgcctttgcattaatgtttgcaagccttattgttcttattcttcccatctattttattgctgatctgattattgataaactgggaaatgcacaggcatatatggccaaattcaatatttttctggacaagatacatacttatatttttgataaagtaggatttgatattctcagcaaggaaaatatgacaaagctgaaggattctgtaggaaagatttctacttctgcactcagtgggacattcaatacccttacggtggttatgtccatgtattttattctttattttatgctggaaaaacccaggttatttgaaaggattttaagtaatgctgcacctcttaagagagccaacatttccctgattggcgataaaatgaggaaactgattatggccaatgctatcgggattcctgttgtagcagtaggacagggaatagtttctctgataggatatataatctttggtgctccggggccggtattattatttgcccttacagctgcatcttcggtaattcctgtagtaggaactgccattgtttatgttccggtatgtatctttatgattgctgaaggaaatacaggtccgggactaggattagccgcatactgtgtagtagtggttggccttacggacaatcttctccgttttacccttttaaagaagctggaaaatattcaccctttaaatacggtattcggaattatcatgggaatgaatctgtttggctttatggggcttattttcgggcctattctgatctctctgacccttttgctgattcaggtgtacagaaatgaattttcggatgaagaaacgcctccggatctcgaattaccgaatcagaatgatcttcaggaaaaattaatttaagtataaaaagtggaaggtataaattctgaaatattaaaagaaatctgcgttgctaaaatgccttttggtaagtacgaaggaacagtccttgcagatcttccgatcagttatctggaatggttcaacagaagcggaatgcccaaaggaaaactgggaatgcagcttgcaaccgtctatgaaatcaaactgaatgggctgatggaccttttaattcctattagggcagcagtaaaaaatggattctaaaaattaaaatatatcaaccggttaaaaagtttcggcggcatcgaagatgccgccgaaacttttttataatcaattatttaagccttcaaagcttcaatttcatctctcagttttgctgccttaataaagtcaagattttttgctgcagcttccatttctttctgcttctgggcaatcattttatcaatatcttcgcttgcatagctggcttttgtttccgccaccttctgaagaatttctttctgagtatatttttcatccgggaagtctttgcttcttccgacaagattttcagaaatctttttattcaaagcttttggttgaagtccatgttcttcattatatttcatttgcttggcacgacgatattctgtttcatccagggtcgcctgcatagatttggtgattttatcggcatacatgatcgcttttccgttcacattccttgcagcacggcctaccgtctggatcatagatcttctgcttctcagcatcccttctttatctgcatctaaaatagccactaaagaaacttcaggtaagtctaaaccttctcttaagaggtttactccaataagtacgtcgaaaagtcccaatcgcaagtcctgcatgatctgaatacgttccagggtctcaacatcagagtggatatatcttgttctgattccgaatttggtgaagtatttggtaagctcctctgccattttcttcgttaaggtagtcaccaggaccctttcatcggcatcagctctcttctggatttcttccatcaggtcatcaatctgatttaaagtaggccttacctcaataataggatcaagaagtcccgtaggacggataatttgttctatataagctcctccggttttctccagttcgtaatcggcaggtgttgcagaaacataaattacctggttctgcatggcttcgaattcctcaaactttaaaggcctgttgtccatcgcagcaggaagtctgaatccgtattctaccaatgcttccttacggctacggtcaccaccgtacatggcatgaacctgtggaaccgttacgtggctttcatcaatcaccatcagaaaatctttagggaaataatcaatcagacagaaaggtctgcttcccggaagacgcccatccagatacctggaatagttttcaattccggaacagtagccaagctctttaatcatctcaagatccagttcggttctttcctgaagtcttttggcttccaaaggtttttcgatagagttaaagaaatcaacctgcttcaccatatcatcctgaatctctctgatagcgccgtttaaggtttcttttgaagtgacaaaaagattggctggataaatctgaatctggtcaaaattagattccacatttcccgttaaaggatcaaaactttgaatcttttcaatttcatctccaaaaaactggattctgatcgcattgtctgcatacgccggaaaaacatcaatgacatccccttttacacggaatgtccctctttggaattcatttaatgttctggcatataaagcattaacgagtgaatgaagcagagcggttcttgttactttctcgccgatggcaatagaaatcagggatttgtgaaactctgttggatttccgataccatatatacatgaaactgaagcaacaatcaaaacatccctccttcctgaaagaaggctggccgtagcggaaagacgtaatttctcaacctcttcattgatgctcaggtctttttcaatatacgttccggtagtggcaatatatgcttcaggctggtaataatcatagtagctcacaaagtattccaccgcattttccggaaagaattctttaaactccatgaagagctgtgctgccagtgttttattgtgtgccagaactagtgtaggacgctgaacgttttgtataacattcgcaacagtaaaggtttttccggaacctgttactcccagtagcgtctggtatttctcaccgatctctattccttcggtaagcttttcaatagcttggggctggtccccggtaggtttatattctgattgaagtttaaaatccatataacaaaaatacaaaagaaatgataagactgtataatgttttgaaggtgaatattttgattataaaattttaacagattatccttgtagttttgattttttgaagctaaacaaaacaattgaaaaaataaaaagtgctaattattagcactttgttgttatggacgtgtaaaggtcattgttgcagggatctttaatactgaagcaatggctttgccatccttcattgcaggcttccagttggtttcattacttatttcagtgaccgtttttagaagctccctgtttaggatttcgttttcccccgaagtcgttacctctgtcgtttttcccatcccattgatatgaatataagcggtagatgttatagttccgctatagcctcccaaattacttacatccacatttttgcttattttgatttttaagtctctatccccaccaggatattgcgccggaatttcattagaactctgttgagtattgataactgtatttgtttttttaccttcatctattcttggaactattgtatccgaaactttttttaattcctcttttttgaaacctgttatagcggatgtctgcgcttcttttgtttttttatggtatgaaggagtaactaaattggtttgatatggtctttgatctccaatttgggttggcatttctgttattttttcagaaaaaagaaaatgatttggattctcagcatatgttctttcggagaataagactactgcagaaattaaaacagtgatgctgactgttttttttaacagactaaattttgttttttttgttttcatcataataaatctttttttggtgttattaaaattaaatgaatgagtcaaaggtgggttttgatgattaagaatttcttcaagaataagattctgatattctttgatgtcgcaattgtttttcataacagcttcatccgccaggaattcatgattggtgataatagctttgttatagagtaaaagaatggggttgaaccaactaaaaattcttaaaacattcaaaatcaatatgtctatactgtgcttttgttcaatatgggtcttctcgtgaatgaaaattcttggatctatcacgttattattcatatagctttcccccatataaattgttttccaaaaactgaagggagaaagattttcttttgtcaataatatagtatgtttgtggtaaaagtgtttccttccggatattcttgtgattttaagtaaggaaataaggtttctcaacaacagaaatgaagtgatcaatatataaattccccacatcatatttgtcaagttcaagcttccctgatcctgcgggatgacaacgagttgttgtgccgtttcttcaataactaattgaggtgtttttccgctgttatgagttggcaaagtaatggtaacaaacggaattgcatatgaaagcaataatgagcttagcaaatacacacggttaaatctaaggattctttctttttccaaaaacagaaaatagacagtaatgaaaatagaagagcagaggattatttttaaaacaatagcaatcatctttattcttttatctgtttgtcaataatatcacgaagctctttcagttccttctggctaagttttgaattggaagtaaaaaaagaggcaaactgtgttacagagctgttgaaaaaacggtcaatcatggaagtcatttcttccttgaaatattcccctttctctacttttggataatattcgcgggaatttccatacaatttatagccaaccagttctttattctgcattcttttaagtaatgtagcaatagttgatggtgcaggtttgggttctggtgaggcttccagaatatccttcatgaaaacggttttcttttcccaaagaatttccataaggactttttcagaatctgtcagtttaatctctttcattctacaattttataatttgttctacaaatgtagaataaaaattaatatatacaaactttatggcattatttttccattcatttttttacacctaatcataatgctatgaaaatcaatcaattttatgtcccggcaataagcctttttcttattttatcttcatgtaaggaaaatcatgcaaatgcccagaaaaccggaaatgatgggagtgtagaaacggaaaatcctaattccgactacaggccggcatttcaaggacagacaagaattaaggctgtgaagacaacaacagaatataatgtagaagtattgaataaagatttgggaagaccctggggaattatcaatttgcctgacggaaggtttcttattactgacaagaacggacatatgaatgttgtttcaacagacggaaaacaaatttcaaaaatagaaggctttccaaaagttgattctaaaggacagggaggaatgctggatgtggctcttgatcctgattttaaaaccaataatataatttacttcagcttttctgaaccgttcggaaaaggaaacttaacttctgtagccaaaggaaagctgtctgcagatcttaaaaatatttctgacgtaaaagttattttccgtgcagaaccttcctacgatggagataaacattatggaagccgtctggcttttgataaagacggaaatttatttgtcagtacaggagaaagatcggataaagtaaccagggcatatgctcagaaaacggataattatcttggaaaaattttgaagattacaaaagacggtaagcctgctcccggaaatccttttatcggaaaacaaggctataagcccgaaatatatgcttatggagtccgtaatccgcaagggttggcaattgatcctgctggaaatttatgggatgtagaaatgggaccaagaggaggagatgagatcaatctcattaagccgggcaaaaactacggttggggagatgtgacgtatggaattgaatattcaggtgataaggtaggccagggcattacacagaaagcaggaacagaacagccggtttattattgggatccggtgatctctccgagcggggtcactttttataccggaaatattgatgaatggaaaggaaacctctttatcggatgtttaagtggagaacatatcgacagaattgtcatgaaaaataataaagtagtaggagaagaacgtcttctggcagatcagaaagagcgtttccgggatgtattgaatggaatggatggaaatctgtatgccgtaacagacagtggtaagctctataaaatttcaaaaaaatagaaaaaaagcctacagatattttctgtaggcttttgtaaggaagttggaggctggaagttatagtagcttaatatgaatttttccctgatgtactttccattttcaatcatttgccatctcttatttttcttaaaacttaaagttaagtctggcaaaaacctgccttccggcaaatcccatctgtacaggatcaaaaatacctccggattctgtatttccggtagttacctgagttgtctgtaaagtagggtaacggttgaataggtttttacttcccaacgtcagattcagatttttagaaaactcacaaccaaaagacagatccgttgttacctttggattatataactgttttgcgccgtcatatccaattaaggttactttatcaaatcttaccatctgcagatttacattgaatttgttgattttatagttaagatttaagttaacttttgttttcggtgcggaagccaggataaatgccttttctctttcgctcagataaatatcttctttccctgccagctgttcggatgtatttaccttggtaatttccatatcgttgtagtttccggctaaagtggcagtcagttttccggatcctatattttcgctatagcttaaaataaggtcaacccctttcgtacgggtatcaattgcattggaaaagaactgcacctggtcaataaatggattctccgcctgaacttctgccggcaagtcttcttgtgcaaaatatccggtaaggacgatcctgtctttcacttgaatataataaccatctattgttgctgtaaattttcctgtattgaaagtaaatccggcacttccatttacagaagtttcctgtttcaattggggaattccgacgctgcttgccagtttgctgtcattggaagccagttgaatagtaactaacttgccaccttgaaaattggtgaattgctggctgtaatacttctgcgccagagaaggtgctctaaatcccgttgaagctgatcctcggaaggcgaattgtggagtaaaagcatatcttattgcaaattttccgttcagggtgcttccaaaatcattataattttcaaatcttccggcaaggcttatcatcaggtttttggtaatgtccaactcagtatccacataggctgcaaaattgttcctgcttttgccgatatctgtagaatatcccgggaatccctgtgaaccgcctggtcttacgctattgtcatttaaaggattggtaaccagtaaactttcaggggtgtcaggtgtcacaggatttccattcttatcgtacatggtgtaagaagcctcctcacccttgatgatgttaaatttttcatacctgaattctgatccgaaagcaatattcagtccttccaataccttaaattgtttcacagcattaaagccagtcgtattctggagcaatgaatgccctccggcattaaagcttgttggtgatttaactcccaaagtagcattgatggtattgtcaatctgataggtaaacctgttattgccaaaagcattgtaaaaatccacatcccagtctaagaccttaaattttaaaccattgtcaaaagtaaaatctgaaatgctggtattttcaatcgggttaaatcctgaaggatatatttcagggatatttccatctgcatccgctgttctggtccacgcataggctttggtgtttctatgcgaaaagccctgacgggaataaaattttaatccgtctgatagaggaagttcaacattgccgaaaaaataaatattttgagccttggcgtctccgaaacgctgtctgggtgccggatccggatcattgtagatgttgggattggcatttcgtattgcataatctttgttgataaactctgctgtaaaatttccaaaaccgccttttgatcctattttagttccgaaattcccgctgaaatcaaaagtagttccatccactttgtgatcggatacaacgtcattatttccgggacttttgaaaagattcattccatagaatgcatttccttcaaaacctttgtcacgatcattaaggatcacgttaattacccctgcaatagcatccgatccgtattgggcagaggctccgtcacgaagaacttccactcttttgatggcgccaatgggaatggtattcatgtcatatccggtatttcctcttcctttggttccgaaaagattgatcagtgaagattgatggtatcttttcccattcaaaagaagcaacgtctgatcagggccaagacctcttaaagtggcgggatctaccgcatcagcaccgtcggatcctgattgtttgttggaattgaaagagggggcggaaaactgtaagagctggttgacttccacctggccggttgactggcttacctgtttaatatcgatgatatcaatagggacaggagtattaacaactgttctttttttattccggcttccggtaatggctacttcgtctatctttgattcttttaaagtatcctttatttgctgggcataggaaagggtagaagctccaaggaaaataatgctgatgtattttattttcatattgataatttttagtgatgattcaatcaaaattatcaatatttatttttaaatcaatatcaaaatttaatatttagtatgaaagtcttaatttgatgttgatttgtggtaaattcggtaaaataataacttaatattcggttttaatgaaaaatttcaacattaaaagcttgtaatcattctgttaattccttcttctaaaatttctcttgaagtggagaagcaaatcctgacatgtccttccgctccttttccaaaccatctttccgaaccgggtactattgcaacttttccctgctgcagaacatgttgtgcaaatgcatcgctggtcattccgtttttgatctttggaaacaggacaaaggtagcctcaggcaaattaggcgttacaatttcggattggcttaataagctaaatgcaagatctctgttgctttgtaaatgtgctaaaaattctctgtaccagggttttgctttctccagggctacacttgctgcaatttgtgataaagtggaaaccccttctattgtagaattgaaattggatttttcggtaaaatcttcaagaatgtcctggtcattacataatacagctccaattctcaagccggcaatcccaaacgattttgaaaatccatataccgtaaaactttttttcttcgctttttctgaaacagaggagtatgtataaaaatctttattgtcataaatgatatcactccagatttcatcactcatcacccaaagatcatgagcggaagcaacctcagctatttttatcaggatttctttagaataaacctttccgagtggattgtgcggattgcatatactgatcagtctggttttaggactgataagagaagccagtttttcaaaatcaatttcaccagatgttgtatccacagggcaaagcgtgacctttccgccagcaatttccactgattttttgaaaagaaaatctaccggatcgagaataatggcttcatccccgggtttaagaacatacgatgcaataagaaacattccctgagcagcactgttaactgccagaatattttcaggagtaaaacttccgtgtttttcctgattgaaatgatcggctacgctttttctgaattccggcagtccggaaaatggtccgtagcttaaatagccatctttaagatattcaataattccctgttctatttcaggcgctgttctgaagtccggatcagcagctgtaagagggataataccatcttccacggtagcccatcttccgttgtaggcttttcttttcagggcttcaaaattgatatcgttattggtaaacatatttatttataagatatgggtaaaatattttctgattgttggtgaagaggaagcaggaactgttctaacaaggttcttccgttactgatgtgagtttcaatttcgggttttctttctgcttcatactttttgaaagcttcttcggtatttttttcttcgactaaatatttagtgagagtgaaagagtcttttaatgcggaagtaacaccctgactggtaaaaggaattaatggatgtgctgcatccccgatgaatacaatattgtctttataaaacggatgtaatttttccaattcataaacacaccataaatgcacgtttttatagtctgatttctgtataatggaaggaattaaagggtgccagtcttcaaacacttcaagcatatatttcttcaggttctctggcgaacattcgttgatcatgtattttttattatcaaactgtgaataccacagaatagtgtcgcccgaaagcttgaggattccaaaagtcagtccgccttcctcgtgatgaaattttatgaaatcgttctcaatggaatctgcgatctctttgtcttgtatgatgttgaccacttcactttctcttaccacgctcattttttcatctttaaaaagatcccttctgatacggcttttagaaccatcagaaacgaccgtaatatcagcatcaataccggttccgtcagaaagctttagttttccggtctgttgattatcagggattacactctcttcataggtaatcttttcgggagaaatattttgtgccaggagatttattaaagagtgtcttgaaatggcaaaaacatggtccagtttcttttctgtcagaatcttccctgtatgggaatactggatgtattttttcagaaaatttccgtgtttgaggagagtttcaggatcaattatctcataaagatagtccatcccttcctttggaatgagaaagccatggcctgacagatcttccttttttcttctttcataaatatgatagtcaatcttgtgtttttctaaataatttgccatggttaagccggagatgccagcgcccacgacagcaattttcttcattcggaataacggattttttcaggtttgttttttaagtattgttagtctgtgttaatagacaatacaaaattaacttaaaaacagtcactatttcaaaaaatgaatcaatttactttcgttttctttaaaaataaattgaaaaagaggttatgatgatgaattataaaaatatatgattgatttatctctattttttaactgtatttatttctgatatttgaatggttttgaggctgttaaaaggtgaattaattccataaaaacaaaaaaaccggaaaaattccggttttatgattaggctttttcaagctgaacagtaaaatgtcttaaaatttcaggttcccaggtgatcttatacccttttgcaatctcttcacgtctttcataaacgttctttatagcagcagcaatataatccatatgattattggtgtaagttcttcttggaattgcgagacgtaccagttctaatttcgggtaacggttttcccttgttgcaggatctctgtctgctaataaagtcccgatttctacagttctgattcctgcttctttataaatttcaagaccaagtgtctgcgctggatattcttcacgggaaacattcggaagaaaatttaaagaatcaataaatacggcgtgtcccccgattggtttctgaacaggaattccatattctatcagtttattcccaagatactcaacctgggagattctgctttcaagataagcaaattcagtagcttcgtccagacctacagccaatgctgccatatctcttcctgccattccaccataagtaataaagccttcgtagataatggtaaagttagatgcctttctgaacacttcttcattattcaaagcgatgaatccaccaatgtttaccagcccgtcttttttggaactcattgtcattccgtctccgtaagagaaaatttccttacagatgtctttaatgcttctgtttttctgtcctgcctctctttttttgatgaaataggcgttctctgcaaatctcgctgaatcaaagaatacaggaattccatattgatcagaaagggctttcacagctttcatattttccaaagaaacaggctgtcctcctgatgagttacaggtaatagtaatcaggcagaaaggaatactttctttaggatgacttttataaacttcttcaagtttttcaaggttgatattccctttgaaaggatgaaggtcattgatatcaaaagcttcatcaatcgtacagtctattgcgtgtgcctttctgaactcgatatgaccttttgttgtgtcaaagtgtgagtttcccggaactacatcaccttcttttaccaatacggaaaaaagcacgttttcagcggctcttccctggtgggttggtaataaatatttgaatcctgtaattctttcaacggttttctgtaattgttcgaatgaacgtgagcctgcgtagctttcatctcctgtcattaaagctgcccattgtttatcggacattgctccggttccggaatcagtaagcaggtcaatataaacctgagaagatcttaaattgaaaaggttataattagcttctttaagccactgctctctttcttctctggtagactggtagatttcttccaccattttgatgcggaaaggttccgcgtacggtaaattcatgagttaatatgttttaaattgtttgtaaagaaaatgtgtttgaaaataattttcaaatttcatcaaagtatatataagtcgggaaagtgattattccggagccttaaatatattttcatcagaatggaatccggctacaccgccgcttactgcaaacttcatggcagaagctgctgtcattcccactacaggtttgatgtttttttcttcagtaacaattacccagcccgagatggcatacgagtggggaagatataccgcaacgtaattatgcttgtcaacgtccgacatttctttttgggtcaaaaaaccgattctccagatttcgggattttcattggtttttacccatacaggatcgttgaattttttcttgtcccctacaaatgaagacatgacgtcttttgtaggagtataaatgtgttttactccgggagttttctccagcaggctgtccattgtgtcgaaaaaaaatctcccgaccacaaatttatttcctaaatatcccagaatagcagtaaacagtataatagatacgaaaacaagccctggcacctgcttggcaagtgaaggaataagattgtcaatggcacttacaatataccagatgacaaaaatggtaagcccgataggaccaataattactaatccctgaaaaaaattcttcaggaaaagattggcaatattttcaaagcttggcttcttcaatggatactctttactgtttgtatttaaccgtgaatggtttctttgtttccgtaggacttaataatgctggcttcatactccagccattcttcccagcgatggtttactttttcaggattaccaagctgccttgcaaatcctataaaagtagtgtaatgattggcctcagaaatcatcagttctctgtaaaaaactttaagctcttcgtctttgatattttctgtaagaactttgaatctttcacagcttctggcttcaatcatagcggcaaacagcattttatctacgatgaggtcttctctgcttccctgaacgataaatttcgccagttcattcacataatcatcttttctggctcttccaaaagtatagcctctctttttgatgatctcgtgtacctgattgaaatgatccagctcttcctgtgcaatggcaagaagttctgttacaatgtcaggatattcaggaagcatcgtgatcagtccgatagcattggtggctgctttttgctcgcaccaggcatgatctgttaaaatttctccaatgtttccttctgcaatatttgcccaccttgggtcggtaggtagtttcaacttaaacatgttgtaaattttttgtaaatttaaacaaattgaggtaagaaatgtgactttatttcaatttgatcactaaagtcttaagaggctgtcttccttcttaggaattccaaaatattccagcctaaggtatcaacctttttcagccctgcagaaattacaaaagctaaaatgatattaatgatataaataatgatcatcaaaatccaccagggtatattttcttttaatggaaccaccaggaaatagaccagcgaagagctgattccctgtgcaaaatagaagaatatagcattcctgccgatataagtgatgaaattttcttttgtgatctttagcctgttatagagaacaaataatgtcaccagagagaataatgcccagatgatatacgggattttcggcgggaatttgtttttattgattttatagaaaatatctcctccataataccaaaacatccatagaagagcagctcctacaagtgcatatgatagaggaattgctttaacaggaattttttttccacgcattttgttcccgattaaaaatacagcaagataaaaagcaacataacccacctgtccggttggataatattccgggaaaatattaaataataaagttaaagcaatgcaaagtccgataaaccagttgatatgtttcgggaaaaatcttaagatcaggactccgaaaacggttaaaataaaataaaccttaaggtaccagaagcttcccatgacaaccggaaaagtatcggcattggtgtattgatgaagataccagtttcccagattttcccattgaggaactgctgaaatgctggtagtggaatatttggagccaaatgttgaataaaaactctggagccattccatagaaaagaaacttaatccgaaaactttaaaaaagtaatctaaaaagaacaggaaagtcacaaatatcatataggtgatctgcagtttcaacaaccggtaaaatgttttttcaatattagctccggaagtaatgccactcagtgcataaaaaagagcgacgtcaaaaacaagggagaatactcttacttctgcaggaatataaaactgtccggaccagaaagcggtatggataaatatgatggaaagtgttgccattcctttggcgaaatcaatatagagatctctgttcattttagatgggttggaagttttttgttgtggttcaaaaatacaaacaaattgactgtcgaaaacataaaagattttttaaaacaaaaaaggggcggaacatactgcccgcctcctttcttaaatatgctaaaaatgaatgttctcgtttattgaagatgtttaaattcttctgcagaaatttctcctgactgaatttttctcagctcatctatatattgactcatataagcgtcaatttcaggatttactgtgtttttagccatcttatacgtaccgttcaaaactccctgatagtaataaaagaagttgtaatcgaaattggaagcgttaagatcgtattggcctagaaggaatcctaaacgaactgctgatcttctttgcgccggtgttccgtgatggttgacattggtcgtctgatagtctccaatgctctgagcaaactcataagctgcggcgatttcagggaagctggttttattgtaaccattaggtcttctcagataatatcctgcgaaaccatctgcttcaagctcgttcggtctgtatgttgattctgatacagaaggaagattgaagatgtactgaagctgatgtccgtattcgtgggcaaggatcattgcgtttacaatatcgccgccttttgattttgcatcataatagatagcatatccgtaatagatctttccggtagaataagaaatagcattgtacgtagagttgaaattggaagggtcattcacaaatcgcagtgtaggagcggttcttccccacatgcctgcaattttagtcatctgaccgttcatgaaattggtgtctgtggagttttgaaggcctgtcagcaaaacagaactggagctccagttgttgtctacgtaagagcatcctttttcagtatttcccggctgatcaatttttgcactaagtgcttcttgctgaggttgagcattgctgtccatttggtcatcactacatgctgtcaatgaagtgacagcaatggcgcctgctaataagcagagattaaagtttcttttcatatataaatttcaatttggtaaaacgaaggtaataaattatctcttaattgtgagtactttatttcaaaaaattattcaaaacatagtgaataggattttatttaaaaaaacattgctttgattgtaagctatttagaaatttatatgtatatttgcacctcgaaataactaaaaatttataaacaatgtttgcaattgtagaaatagcagggcttcaatacaaagttgagcaagaccagaagttgtttgtaaaccgtttaaaaggagataaaggaggaaaagtttctttcgataaagttcttcttactgtaaacggtgcaatcactgtaggcgccccagctgtaaacggaatcactgttgaagcagagatccttgaccacgtaaaagctgataaagtaatcgttttcaaaaagaaaagaagaaaaggttacaaagtgaaaaacggtcacagacaatctttaactcaaatcgtaatcactggtattacaggatttgaaggtggagctaaaaaagctgctgctaaaaaagaaactgtgaaaggtgaagttctttctgacaacgcaactgttaactttggtgaagatcacgagctgaactatcacttaaagaaaaacaacttgtctcagtctaaagagaacagagaaactttaattactttaggtaaagcagttaaagttgaattagaaaagaatgttcttactcatgaagaagtagatgctgctatcattaagaacattgatcaatttaaagcacttaataaataatccagtaataaaatggcacacaagaaaggagtcggtagttccaagaacggtagagagtctcactctaaaagattaggtgtgaagattttcggaggacaagaagctattgccggaaatattattgttagacaaagaggtactcagcaccacccaggtgataacgtgggaatcggtaaagatcacactttgtttgcattagtagatggtaaagtagttttcagaaagaaagcaaacaacagatctttcgtatctgtagagccaaacgcataattttgtaagcgttttataaaaattaaaacctcagtttttactgaggttttttttacggattgttatagtattcatttgttcgtgaaatattttatatttgttcactgccacatttgtggaacagttgcgatagccgaaaagcatcaagagtaggcagcattaaaacaaatatctatgaaaaatgtaagaaaactagccagaaaagatttaaaagaaattaccggtggggctgcagcttattgtccttccatgtttcagtcatgcgaagaatggtgcagctggactccatggcagaaatcacactgtattttgtctgaaccatgtacagaatgcttttaatgatagaagaaaaatgccctttgagattttatagagctgaatcgtgaaggttcagcttttatttagttaaaaatatttaaataatatcttcaataagtgaaatattaatatatttaaccgactttaaaataaaagaattacgcggaagccgaaaagcaaaaagagtaggcgataaataaaactaaacaatcatgaaaaatttaagaaaattgaccaagaagagtcttaaggaaatcaatgggggaggaacactggcactatgtccgccaaaaccaatcagatcatgcgatatctggtgtgggatgactccagagcagaaaatgcgctgtttgcttgatgtagaggagccgtgtgagtgtttttaataacctctcattatatagaataaggaaaggtaaataaagtttcggcggcttcaaagaagccgccgaaactttattatattattagaatcctacctggaatcctgctttaacaccgaattttgagatatccggtttgtcaagataatttcctctccagttgaaatccactctgaaaattctgagatttccgattcctatattttcaatcccgaagccgtattcataataaatatgttcgcttggtgcagaatatttaaacccttccacgttgatggctttggatgcatcacttaatgttccgtatgcacctctgataaatgcaacttctctaagtttcagttttttaatcaaaggaatataagaaaggatcttaccgttaaaatggtgttctaattgaagggtagtataagcatcagttacaaattcataataattaagctgcgagaatgtattgggtaccaaaccatatgaaaggttggcagggattatattctgtaatgccaaaggaacagtgctgaaattctttcctgcttcgaaattaacaaccagttttcccatgcttccaatcaaaaacggcttatagagcatgaactgcagcttgtcataattaaagtcagcattgaataaaccttcaatacctctggtatatcttaaaacaatcgttggagccaggtttctggcctgataacggtcaattccggtctgagaaaacttagcgccgggctttgcgattaagctgatggtaacatgtgagtcattaacggtctttctcagctggccgtctttataatacatgagattgaatttctcaggaattgcagatttaatgctctgcatcactccatctattcttatctgaaagtttttccacggttcaatagctgcaaaaacacttgttttattgacagaacttaaagaaatgttttcccctcttgcaaaaaaagtgctggtagatgaggattgaggtgtaacgccatcaccggatgtaagctgtcctccaagctgaacaatatccctgctggttcctgccccaatcataaaacggttcagcttattgaacatataccttgcctcaactccatatttgatctgttggtctttgaacccgtaggctgtataaaactgggctctccaggtatcattcaatccgaaataggttcttgctcccaatcgtattctgtctccttctacttcatttcttccataaattgaaaatatgggaccaatatctattcctttgaaggcattataataacgtgaaccaagggtttcaaacagttttaccattcgattgaatttcggggtctgctgaagctggtcaagcatgttgtaaacgccctgctctgctttggataaagtgtcgggtctgacctttgtccagtaagcttcatctttattggtaaactggtcttcgtattcttcttcagtacgtttgaaaacctttgggtctagaggcttattaaactgataatcggaataatctacagatcttttggcgataatacttttggctcctttcttttttgaaaaaggactcatttcaaattcggtaaccagttttttaggaagaaacgtggcatcatcaggattgtcgtattccacctgagtatagacactattgacaaaattgacattgatcttctgggttgacttcaatgttgctcctaatacagcataagtatctgtatcaatataaagatttccctggaatgcaaggatatcttttctttttggctggtatcttatctggaatgctttttccccacggatcgtaatggtgtccataaggctgtaatcgtaggtgctgaaaccatctgttcctacggggctctggaatccaatatcgaaataattcagggtattatcgtaaatattaatatcacggtaaaggtttttagctgaaacggtaatcacctgattgtcctggaaacctgaagttttctgagcaaccagagttcttttactgtccttatccggcttgtttttaccataattttcataaaccgcttcattcaggaagataggaagtccaagccttccacttgctgtagaatctgcatagctgaaaatgaaatcaagtttattgaagatctttttcttcataaacgcactgtccagattgttcagatcaaactgcgttttttcatattctttgtaggaatacgtatcgaacttttctagtccgttatttcttttttgtgcccagaccttctgcataatagcataagcagggttttcttttttatttttgtatttagtcttaccgctttgaagaacaatctcctggatgtcacttactttagcttgagaaagctgtacgaaaatattttctgcattttctggagtaatatcaagggtttccgttacatagttttttctggaaaatcttaactgatggataatgctgtctgactgtacggtgaagctacctgaagttgtcgtcagggaaggggttgtattattgttgatgaaaatatcaactttattcagttctttattgttcttttcgtcaaccaccttaccactggccttgttttgagcgcatacggaaccggagagaatcagtaaaaaaaataaaagatagtgtttttgggagttattgtttaacatcattcgtttcttcaggcaattagcataaacaaaaagcatgcagtttatttaaaaaaaggtaaaaaaataaaatatttttattctaccttataaaacgacaaaagtaacgaaaataatataagtgttgttgaaaaaataattgaaaattttaacgcttaagagataataatcagaggattaatggaatggataaagtggtcaactttataagttgactctgatacttttaagaatataaaataaaaaagacctacatttctgtaagtctttttgctcctcctgctgggctcgaaccagcgaccctctgattaacagtcagatgctctaaccaactgagctaaggaggaatgtcctttgttttaagtggtgcaaatataatatgaatattggtaccaagcaagttttatcccttattcttgaagatttttaactaaatgtattgaatttcaataagaaatattttatctttttttagttaatccccgaaatattctgtcagctaaaggaattaactatgtcacttgagatgtttatgatattgttaatttaatccggtcctgaaaaaccgttatttcaggaccggatataattaaaaagactacatttatttctttaaatctttaagaatttcctgaacagctctttccaattgagggtcattgttctgaaggcggtccatgaaagtattttttacataaatatcaggtttcacaccggttttttcaaggttttgtccgtccagagtataagttccccacgcaggcagcctgtaagaagagccatcaaccaagccttttgctgaagtaaaaataatccagcgataagtatcctgaccgataattttacccagtttaagcgctttgaatccggctgctgtcatttcagcatcgcttaaggaagcttcattgatcaaaagaacgatcggttttcctgaaggggcaaaattaggttgagttgttattttcccttcgcggtatttccattggagataaggtctttgagaaaggaaattcaatactttatcatgaacatttccgcctgtattataacgtaaatcaagaataacggcgtctttcctgttttcctgctctaccatatccagaaggaaacggtccagctcatcagtagacatatttttcatgcatgaataagcaatacggttattgctaagcttgtctacacgctgatggttattgtagatccaatcgtcgtaaagcaatgattttaattccccatttgaaataggatgtactttggatgttatatttttaccaccgcggctgaatgtaagaacgagttcctcctgctttttaggggtggtaaaataagtttcgcggttttcatcaggatcaaccttttttccgttgactgcaatcagttggtctcctggtttaatatcaacaccagtgcggaaggcaggagattttcttaggatactttctaccatataaggctggtcttttttgaagataatccccgtttcgttggtaaaatagttcaggaacattgcctcttcttttccggatgaagaaaatcctgtatgcgaagaattaagttcacctaaaagatcattgagtaaaattcgcagatcatttctgttgtgtacatacggaagatatttcgcgtactgttctttttttgctttccagtcaattccatgaaatttttcatcgtagaagttttcctcaacacccgtccatgcttcagcatacatctgggtaaattcggaagctaaatctttatcaaaactatattggatgtttattttttcaggttttagagctgatacggttgttttataaatatttccttcaatcagggcaaatagatttttatcatttttggtcaggtagtaagctgctttatcaaagactttttcagatttggcaggttcaaaatcagtaaacacttttttgaaaagctgcctttttccgttatcctggttggagttaaatagcagaatctcttttttgtcatctgcaaaaacagcagggtcgtcctgatatccataacggtcggtaaccagttcaattctgtccagtgtatcttcaggattaactttcaattcttttattaccggctctttttctttctcttccttcttttctttgtccttgtcttcctcttttttattttttttgtctttggtgtctttggctgtgtcggaaggttttgtttcctttttttcttcaatgaaaaggttgtcaaatttttctgacttaaaaggctcgtcaaaccaatccaaagccattctgtaaatattagacttttgcattcctaaagggtaggacggattggttctgtcactggcgaaataaatgtatttgccattaggcgaccacacaggatcttcttctgagacaccggtattggtaaggttgagagtctgtccttttttgatgttatagatgaagatatcaagctcaaaatttcgttttgctgaaaacaaaacatattcattattgggcgaaaaagaaggtcttgagttttggaatgcccagatttcgtcctttacaatagtcgttgagttaaaatctttcaaatccagcaatcttacttcatcacgaccgcttaagtaaaccgcttttgaaagatcattgttaagtgtaatacttcgattgtttcttaaatcctgagtgagttgcttaggctgacctttcccatctgcagaaacagtaaaccagttctgatatccgttataggtctgattataaagtaaagtacggttgtctttcagccattttacttccatagcacgttctttcccatcagtaacctgttgtgcgaattttccttcaatatcagaaacaaataaaataccgcggcttataaaagccattttcttaccatccggggatacatcataataggaaatattattttccacattgaagttctgttctttctccagtgttttattggtattcagattaacgttaagaagtctcgttttttttgaggctacatcgtaagtgtaaagttgataatctttttcaaaaataactttagtgccgtctgctgatacaaaaggttttttaatagaagtatcaaattgggttaaagctgttttttttccaccttcaattttataaagattatattctccgttattctcatccgaaataaaataaataataccgtttttatctacacttggattaaaatcctttccttcatagttggtgtactgcttaaacgtattattttttgggttgtatcctaagatgtcgggattgttttctcctttataacgcttacgctgtacctgatgggcgctttcagatgaacttgtgaaaagatattcacctgcaggagtttctgcgagactattcgtattgttaaaataattgttgaaaagcttctgtggggttttcccttcaatcgtggttttaaaacttccgaaattattatttctgttggaagtaaagtaaattgttttgctgtcccaggaccagttttccatttcatcttttccggtatggaacgtcagctgtttgattgttccgccttctgaaggcattacataaagatcataatttccgtattgattggaactgaatgcaagccattttccatcaggagaaacgcggggattgatttcttcgccgtccagagcggtaatccttgaggcgtttcctccgttggaatctaccctccagatgtcgccgtcataagaaaaataagcagtcttgccatcagggctcaacgaaggacttgataagaaataagatttttcctgtgctgaaatcccgatcatagaaaatgctgtgaataacgaaataatagttttcttcatggtataactaaatatgatgcagtattataatattgattttatgtttttggttttaaagtattattggatataagtctctcagatccgtctacttcttaaaagaatagtcggattattgaaggaatcgttacatacaaaatgtctcagtaggaaaataatattcaataaaacagataaatacttcataagggttgagataaattacaggtatctgtcttttttaaattaaagtaaagatataaaaacaaaaaaaagacctacatttctgtaagtctttttgctcctcctgctgggctcgaaccagcgaccctctgattaacagtcagatgctctaaccaactgagctaaggaggaatgtcctttgttttaagtggtgcaaatataggacgaatatttataccctacaaatattttttagaaaaatttttaaaaaaaattataaagttcctgaaagccatttgaaaatatcgctaccgaaaatcagtaacatcaatcctaacaggaagataaccccgatcatctgtgcgttttccaaaactttctgaggaaccggtttgcctacaataatttcatataatgtaaataaaacgtgtccgccatcaagccccgggataggaatcaggtttaggaatgccagccatacggagaacatggcagtaaagctccagaaagctacccagttgattttaaagcttccgtcagcatctttatctacaggcatattctttacaatcgcaataggacctcctacatttttatacccctgaactttagagttgaacatgattttgaactgcttaacctgagtagttaaagcctcaatagttctcgtgaatcctcttggaatagcttctccaaaagaatattttttattggttacgatagattttgcaatactttttgtatcaattgcgatacccagttttccatttttgtcaacagaaactgacggtaatgtctgtaaagctccgtttctttcaacatcaacagaaactgtttttcctttattttcactgagaagagtgcttacttcatcaaaaaatacggcttttttaccgttgattcctacaattttatctccttttgccaatcctgaagcttgagaagaaggagttgccaatgaatcaactaccatagaaactcttggggtgatgtatagttttgcctctctttgtttaagaacatcagctacaccatcagcatttaccgggaatgtaacttcctgaccgtttctcagtaccgtaacatgatctcccaaaagaatattgattgacgtgttttcaagcctttctgccggttttccatctacgctgatgattttgtcaccattctggaagcccattttctttcctgctgcagtagcctcaattccgttgctgaattttgtgatatctgtatacatttcaccattgaagaatgaaagacagctgtagattaaccatgcaaggaaaaagttaacagtaactccacctaacataataataagcctctgccatgccggttttgatctgaattcccaaggttctgccggttttttcatttgggcagtatccatactttcatccaccattcccgcaatttttacgtatcctccgaaaggaagccatccgataccgtacttggtttgctcagggtattttctccagtcactgtccggaagtttagatatatcgataggaacttcttccttctttccgttaacctctattacttcagaatccggcagattctttgataagaatttatactgccattttccgttgattttcttcatggagaatatggagaagtaaggatcaaaaaacaggaaaaacttctctgctctggtcttgaaccatattgccggtaaaaaatgcccaagctcatgaagaagcacaagtatagagatgctcagaatgaactgaaaaagtttgattgctatttccattaataaattttagattttaatttgcaaaggtaacaattatcaaaactatgccaaataaaaaagctccccgaaacgagaagctttgtcatatttaaagacgatttgttataaattgaaagaaaccccaaggctgccgttattacctacttcggcaaacactcctattttatccgtgaagaagtatctggctccgatgtgggcgcctactccgaaatcttttccaacaactccaaggtccacacccgggtaaatatcccattttgatggtagattcaacgcttcctgcaaatgaaagttcaatcttccgaaaacaaaaacgcggttatccttatcgttgtttttataattgtcaaagtagccattgatcccggctcccactgaaataagttgattgagaccatagtcataagttcccgttattccggttccgtatccccaggcgctcagccccagttgtatcttctgatcccctttacctgtccatgcctgggcattagccattgcaccaaaaaagaagatcattaccataaaaaacaatttcttcataaattttaaatttttaaggattttaataaaaatatctctatcaaaaatgaaaccgaaagaatgggagtattctaaaaaaggctgactttaataaattattaagaaatatagttctgttttcacgggagaacctcttttttcagcagtttaattcttcttttgtaatgataaaagctgtatttttatacatcagattcggaataacttaaaaagaataaaagatgaaagttgcagggcttaatttagatatcatctggaaaaataaaactgaaaattttaaactcatagaaaacgagattcagcaggttgaagctgatctgtttcttctgcctgaaatgttttcgacgggtttctgcatggatgctgctgaagtatcagacagaaatgaagagtcatttcaattcctgaaaaagatctcaaaagaaaaaaatgctgcattctgtggaagcgctcctgtagagcaggatgggaaattttataacaggatgtattttgtaaagcctgacggtgaaatgtcttattacgataaaagacatttgttttccttctcgggagaagataaagtgtataccccgggaaaagaaagggtaattgttgaatatcaggggattcggtttttgcttcaggtttgctatgatctgcgctttcctgtttttgcaagaaataatgatgattatgatgctgttttgtatgttgccaactggcccgaaaaaagggtaggagcatgggaacatctgttgaaagcgagagcaattgaaaatttgtcctttgtatttggcttaaacaggatcggaacagatggaaataatctgttttatcaggaaagctcgcattacttctttgctgacggaaaagaaatttcccggaagcaaggcaaccttgtgtctgcagaattaaatatggatgaattgaaagatttcagaacgcatttccagtttctgaatgaccgggattctttttctattaaattttaggttttcccacagatttcgcagatgttaaaagcataagctcaactatggaaatttgggtgatctgtgggtattataaaaacaaaaaactgtgaaaaatcacagttttaagcatattcttgtaaaagtttggtgagtgtattcacgtcatgtacaccactttccttccataataattctccttttttgaaaatcgccagtgtaggtactccacgtactccatattgagcggctaaggcaggatactgatctacatctacttttatgattctggcaccttcgccgatattttcttttacagtatttaataccgaagactgcactttacaaggctggcaccatgtggcgaaaaaatcgataagtacgggtctttcggaatcaatgatttcctgaaatttttgtgacataggtttagttttttttgatcttaaaaagttttggactggcatacaaaatccgaagtagggaatttttccgtttttttgatcccgttgaaacctccttctatttcagtaaaatttctgataccatgtgagttaaggatgcttgctgcaatcatgcttctgtatccgcctgcacagtgaaggaagaaatgttcagaatcatcaatagtgcgtgcccagtcactgatggcatccaatggcttattgtatgcgttgtcaatgtgttctgctgagtattcagtcagttttcttacatcaattacggtagcatcttcagtaaactgttctgcaaattcggcaggggaaattcttctgatctcatcggtttccttccctgcatttttccagctttcaaatcctcctttcaggtaacctactacattatcaaatcctaccctgcttagtctggtaataacttcttcttcagttccttcatctgttaccagtaacagagggtgtttcacgtcaacaataagagttcctacccatggagcgaagtctcctttcagccctatattgatggaattgggaacaaagcctttatgaaagtctgcaggtcctctcgtatctaaaattaatgctcctgtctcttctgctacggcttcaaaatcttccggttcaacaggatgcagtcctttgttcattacaacatcaaggctttcataacctcccttgtttaatgcgacattcattccgaaatatttcggtggtgctgttaaaccatcaagaacctctctgatgaaagacgctttgtccggttgattaagggcgtaattggttttcttttggtttcctaaaatatctactgtttccttctgcatattctttccacaggcagaaccagctccatgagccggataaactgtgatgctgtcatccaatggcatgattttgctttgaagactgtcataaagaatacctgcaagatcttcctgcgtaaggttggttgccttctgcgcaagatccggtcttccgacatcacctaaaaacaaggtgtcacctgtaaagattgccgtttcaacaccattttcatctattaaaaggtaagtactgctttccatggtgtgacccggagtgtgcaaaacctttatttttactttcccaatttcaaaaatctgattatcatctgcaataatagcttcaaattcaggagccgctgtaggtccataaacaatcggagcaccagttttcttgcttaaatccagatgtcctgatacaaagtctgcatggaagtgggtttcaaaaatatattttaaagtgacattgtctttttccagacgatccaggtaaggtttaacctctcttaaaggatcaataatggcagcttcattctctgatacaatataataggcaccctgagccagacagcccgtatatatttgttcaattttcattgggtctttttttaatgagttaaagatacgaagtattagataaattctaaatgaaatgttaaattccattgatagtttctttcaatacttgttaaaatttacattacttttttagcaaaaagaatgccttatataaagtgaatttacgaatgctgttttatatcatattctttaccccaaaactgtctttatgttcgtggtttaaaatttgcttgtgcagggataaattattttcagaaggacttaaaagaagttcatccgaaaatacctttacattttccaaaaaattttatatttataagttaaaaacaatcagatggcagacaaagcaaaatttattgaagagttaaatgctagatatactccgaaaggagaacacattatattaggaaaaggaatgcttgacggacaagtggttcctgaggtgaatgtaacaatccctttgaaaacaattaaccgccatggtcttattgccggagcaacaggaactggtaagacaaagacgctacaggtatttgcagaacagctttcccatgcaggaattccttcattggtccttgatatcaaaggtgacttctccggaattgcagaagcaggacaaatgaatcctgttattgaagaaagatacgctaaaacacagcttccatacaatccgcagggatttccggtagagctgatgagtatttccggagggaaaggcgtaaaattaagagctactgttacagaatttggtcctgttttattaagtaaaatccttgagcttaatgatactcagcaaagcattatgtctattgtctttaaatactgtgatgataaaggccttcctttgattgatcttaatgatttgaagaaagtattgcagtatgtaacggataatgcacagggaaaagctgagcttgcagccaattatggatctatcgcaccggcttctctcggagcgatcttaaggtcaattgtagccctggaacaacagggtgcagccggattctttggcgaattaagttttgatgttcaggatttactggaaacaagagacggaaaaggagttgtcaatattttaagagtatcagatattcagaataagcctcagcttttttcaacatttatgctttcgctttttgccgaaatttatatgactttcccggaagaaggagacagcggaaaaccgaaacttgtattattcattgatgaagcgcaccttatttttgatgaagcttcaaaagcccttctttcacaaattgaaacgatggtaaagctgatccgttccaaaggagtggggatctacttcattactcagattccaggagatgtgcctgaaaatgtgctttctcagttaggactgaaaatacagcatgcactgagaggctttacagcaaaagataaaaaagaaatcaccaaagctgttgaaaattatcctacaacagaatattatgacgcttccagtcttatccagaatttagggattggagaggcatttgtaacggctttggatgaaaaaggaatacctacaccattggttcatacctatctgatctctcccgagtcaagaatggatgttttgagcgaggcagaaatctctgaacttacatctcagtcagcacttgttgccaaatacgagcaggctattgacagagaatctgcttatgaaatgcttacgaacagaatggagcaggctgcacaaaacccatcaccaacacaaaaaacaagaccggtaaaagaagaaccgggaatgtttgaacaggtattgcagagtaaagcaggccgtacctttaccaatacattaatgcgagaaggagcaaaagcgatcctcggaatgtttggtctgggaggcagaagaagataattttgaaggataacctgctctgttttgatatattttttgttattttagcaggttatctttataatattaatagtaaagccaggtttattggggaataatacatcgggtttaaatacgaacgacaaacagcagttaacacacattcaatgtattcaattatagatatagaaagtaatggtgcaggttatagaaatgaatgcattatagatatcgccatttacagatatgacggtcagaaaattaccgaccagttcatctctctggtaaatcctgaaggcgatattactccttttgtacagaaactgaccagcattaccccaaaaatggtcaaaacggctccgaaatttcatgaaattgccaaaagagtcatcgaaataactcaaaatacaaccttggtagggcataatattgattttgattacagaatgcttcgccaatcattcaaaaggcttggttatgattttaaaatcaatactttagataccattccgttagcaaaaaaactgatacctgatgaggtaagctattcgctgggaaaactggtgaagtcgctgggaattcctttgaccaatcatcacagggcagaaggtgatgcaagagccaccttggaactctttaaattgctgatttccaaggatactgaaaatgaaattattcagaagcagcatgaagagtctaatgccaagacctatatcaataaaattaaggaacttacccaagatcttcctaatgataaaggatttgtatactttcaggatgaggcaggacgtatcatgttctcggattatgttcaggatatcaacaaattttcaaaaaaggttttcaattccaaatcaaaaaaatgggagcagattcagaaagatgttgagcagattaattttgagcttaccggaacagatattattgcaaaactgattctgaattcaaagaatatcaaaaagaaagaaattttaccattcggactttatttcagaaacaataaatatgttgttgaaaaaaacaagctcaataaaacggaaaaaccggtattaaaattcagatcgtttacccagggaacaaaagcggttcagtttattggttctcaggaagagtttaatgatttctccgcattgaaacagaaaattgaattcagaaaaaggaatgagctctggctggggccgggaagaaagcttggtgaaaaattatttctaatcatagaaaacggaaaagtagtttcttttggtttctatgagctgtttacgcagattcagactttgagtaagctggcgaagctgaaaattgatcttcagctgtcctccacagatctgaataatgaattacagctggctttgcttcgtggtgattttgaaaccttaccgctgccaaaataatatagaaattagcactttaccgttttattcagaagaagagctgttcaaatcattttcttagaataaaaaaataaatagtatttttgcaaaaaaataaatagaagcaatgcaaaatcttaaacaaaataaaactggaaaaaagggagctgtaaggttctctaaggtttggaatatttaaaagagttgtcttgcataaaaaataattaatgtggcaggctcttttacgaagaatctgcctttttttatgttaaaatgaaattatgaattcaaaagaattattaaagattgccaatgagtttggcaccccggtgtatgtttacgatgctgagtccatcaaaattcaatacgaaaaacttacctcttcatttttaaaacatactaagttcttctacgcagcgaaggctttgacaaatatcaatatccttaagtacgtcaagaacctgggagcatctttggattgtgtatctattaacgaagttaaacttgggttaaaagcaggatttccgaaagaaaagatattgtttactcccaattgtgttgacctggctgaaatagaagaagcaatgacttttggagttcatatcaacattgataacatttctattcttgagcagttcgggaataaatacggaaattcataccctattttggtaagaataaacccgcatatttttgccggaggtaactataaaatttcaacagggcatattgacagtaaatttggtatttccattcaccaggttcgtcatatcgaaagagtgatgaaaagtacgaatctgaatgtggaaggacttcatatgcacacaggaagtgaaattaaagatccggatgtattcctgcaggctctggatattatgctggaactttctgagcatttccctaacctgaaatacctggatatgggaagtggtttcaaaattccttaccaggacagtgaggaagaaacggatgtaaaaacattaggtaaaaaagtagaaaaagtaatttctgagttttcaaaatctaccggtaaaaaatttgaattatggtttgagccaggaaaattcctggtaggaaaaagtggttatttattagtgaaagctaatgtaatcaagcagacgacagcaactgttttcgttggcgtgaattccggatttaatcacctgatccgcccaatgttctatgattcttaccatatgattgaaaacctgtccaatccaaaaggagcagaaagaatctatacggtagtaggaaatatctgcgaaacagatacattcgcgtgggacagaaaactgaatgaggtaagagaaggtgatattcttgccttccataatgcaggagcttacggttttgaaatgagttcaaacttcaattcgagattaaaaccagctgaagtattattcttagatggaaaagctcatttgatccgtaaaagagatgagtttgaagacctgctgagaaatcagattgaaatagtgatgtaaaatctgaaacatacgatataaacagccgccttttgggtggcttttttgttttacaggggaattaaacctcacgggttttcaaaacccgtgaggtttcaatagaaaaggaattcaaaattaaattacaattttttaacatcgagttagggatagagtctcaactttattagctaaatttgatagaaataggaagattttcttcttctcaagtgctattttcaccaaaaacaaccaccaaaacagaataattatggccaaaaacatagcagagcagattgttgaaatgctcgaaaatgccaatgtgaaaagaatttatgcagtaaccggcgacagtcttaaccatctgaatattgccgttaaaaaaagcagcatccaatggattcatgtgcgtcacgaagaggtaggtgcttatgcggcagcggcagaagctgagctggatggccttgctgtatgtgcaggaagctgcggaccaggacacgttcatctgatcaatggggtttatgaggcacatcgttctcatgttccgatgctggttattgcttctacaattcccagtgatgaaatgggaatggattattttcaggagaccaatacgataaaattgtttgatgactgtagttattataatcaaatgattacaaggccggaacaggtacagagaaccgttcagacagctattcagcatgctatttccaaaaaaggagttgctgtgataggtcttccgggagatgtgtcggaactggaagcagaagaagccactacttcagcccagatctttaaaaccaatccggtcataagaccttcggacagcgaattaaaaagcttgtcatcccttatcaacagcagtaaaaaagtaacattatattgcggaatcggtgctgctgaagcaagtgaggaagtcattaccttatcaaagcttttaaaagcacctgtaggatattcattccgtgggaaaatggctattcagccaaataatccgaatgaagttgggcttacgggattgctgggctttccttctgcctatcatgccatgcatgaagctgacctggtgattcttctgggtacagatttcccatatcagaaattcatgcctgtaaaaaataaaataatacagattgatgaaagccctgaaagattaggaagaagggcaaaactggaattgggacttaccggcgatgtcaaagaaaccattaaagcattacttcctctgcttgaagaaaaaacagatgaccattttctgaatgagcagcttgcattttatgataaagtaaaagaaagccagctggagtatgtaaaagattcaggaaaagaaaatgcaatccagccggagtatgttgcccatactttagataagctggctaagcatgatgctatttttacggtagatacaggaatgtgctgtgtttggggagcgagatttattacaggaaccggtgaaaggaaaatgctggggtcatttaatcatggctcaatggcgaatgcaatgccaatggctatcggggcggctttggctcatcctgagaaacaggttatcgcgatgtgtggtgatggcggactatctatgttattaggagatatggcgacaatttttcaatataaattacccgtaaaactgattgttttcaacaacagaaccctgggaatggtaaagctggaaatggaagttggcggaatgcccgataatgaaacagatatgattaatcctgactttgcgatggtagcacatgcgatgggctatcctggtaaaaacgttcatttgccggaagatgtagaaagtgctatcaaagaatgcctggattataacggaccttatcttctgaatatttttacgaatcctaatgctctggcccttcctccgaagattgaatttgaccagatcatgggaatgaccaaatctatggcacagctgatgctgggaggcaaaatggatgaggtttttgaaacggtaaaaacgaattataaacatattaaaggtctgctgtaagattaagaatattcatattatagaacttcatgcattgtgtgaagtttttcttttttataactgggctaaatatttacctttgtttattattagtaaattatgagaacaatacttttatttttgaccttatgtgtaatgaatttttcttttgcacaggatcaggaagaacgggatgactcttttatccgggaaagcaataaaaatcttttaaaaatagatattcgggaaccttttatgcaggttgccgtgaaatgtaatgattttaaacctgcagccttcgaagggggtgttgcggcctataaagatatcctgaacaaatatatgtacgcatatctgaattctgacttctatgcccttacaggtgattttacatttacgctggtgcttgatgataaaggaaaagtagtggatgtgaagggaatgcctaaagtggccaacagcgaagttttctttgatgacatgcagtatgttgtaagaaggatcaaaaaaaactggactccggcttcttgtaacggacagcctgtggcttcacagattaaagttaaaatgaatttttcttcaatttcaacggacattgactaataccaataaatgaaaaaatatctctttattctatctttatattttaagggttaaaggtttatcacaaaagctgtagagcagattacagaaaaatgggacccggaatcttctcgggaatgccatcagtctctattttccggatatctgtaactttatgattttgttaaaataataccgctgacattctgtcacaatattttgtatctttgcaaacttatctgttcgtaatttactattacgggccttaaattgattatcgtgcaggaaaaatatatagacgaaacaaagcagggcgaagcttttgctattgccgaaagaccggaaaattctaaaaagctgtttttagaaagctatggttgtcagatgaacttctctgactctgagattgttgcatccattctcaacgaacagggatacaacacaacgatgaaagtggaagaagctgatctgatcctattaaacacatgctctatccgtgaaaaagcagaacaaacggtaagaatgcgcctctcccagttcaaaaatctcaaaaaagaaagaccgaatatgacggtaggagttttgggatgtatggcggaaagattgaaaactaaattcctggaagaagaacaattggttgaccttgtagttgggccagatgcttacagagacttacccaatcttttaaaagaaacagatgacgggagagatgccatcaatgtaattctttccaaagaagagacctatgcagacatcaatcctgttcgtttaggaggaaacggagtgactgcttttgttactattacaagaggttgtgacaatatgtgtacattctgtgtggttccttttaccagaggaagagaaagaagccgtgatccgcactctattattgaagaatgtaaagatcttgccaataacggttataaagaaattacccttttaggacaaaacgtagactcttacctttggtatggtggcggtcctaaaaaagattttgccaaagcatctgaaatgcagaaagcaacggccgtaaattttgctcagcttcttgatttagtggctaaagctgttcccgaattaagaatcagattctctacttcaaatcctcaggatatgagtcttgatgtgttcagaatgatggcaaaacacgataacatctgcaaatatgtccaccttcctgtacaaagcggaagcaataatatgctggcagcgatgaacagacaacatacccgtgaagaataccttgatctgatcagaaaagcaaaggaaattgttccggaagtagcattttcacaggatatgatcgtaggattctgtaatgaaacagaagaagatcaccaggataccttaagcctgatgagagaagtggaatatgactacggttatatgtttgcttactcagaaagaccgggaacccctgcccataaaaaaatggaagacaatattcctgctgatgtaaaacagagacgtctcgcagaagtaattgcacttcagggtgagctctccaaaaagagaatgaaatcctatgtgggaagagagcaccagattctgatagaaggaatttctaagaagaataaaaaccaatggaagggaagaaactctcagaatgccgtatgtgtctttgataagcttgaaggacagaaaataggtgacattgtgaacgtttttgtgtatgataatacgcagggcacgcttttagggagaacagcggaataaatataagttttgatcaaggcggtttattttagaaagaatcccgatcactgaaaaacttaaaaaagaaacaagatcaacggtatattaccgtaagatttttagtaaattgtgaaggaaagacaggcctgttcagattacagcatatgagtccggatctgaaagattctgtactggatgaagaattggaaaaaaaattgctgcagtttacaaaatcactcgacggctggatgccgaaagagatacaaggtttaaaagtagattattatcagtatttaacctataaaattgaaaatggaaaagtttcagaggtattaccttagctttttgctacttatagtttacaccaatactattgcacaggttaactgtaatgcagtagagggtgagaactgcaaaaaagcgtgcgggttatacaactgggcttcagatttacaaggtttcgcagaatcccaggaaggctttgataaagctattgaactttgtcctgatttctcccatgcttatatggaaaaagcagttccatatcttaaaaacggagatttcgtaacctggaagattctgattgataaagccgttaccttagatccaaaaacgtaccttggttacagaggctggacgaagtttcagtttttaagagactataaaggagcaatccaggatttagaaagcttaaaaaaatatgagcccggagacttaggaagatctcaaaacggagattataatctggatgtggtaagagccatgtcttacagtgcgttagggcagaaagaaaaagtcgcaggcattatagaaaggcttctggctgccagaggttatgtgaaaggaatgtttgatcattatcagctgggagttacctgtttcgagctgggaagatatgacagagttcttgaaaattttgaaaaacaaagcaaagagtacgactttgctgagaatatatactttaagagtaaagtttctaagatcagaaacaaagattatttggatttaaaaaagttagcattacgaacgtatgatgaaggaaagaccatgaaagaggtctacactcatcactttaacaaaatctacagacagcagattgaagcggtgtagaagattaacattaaatcaataatcaaaaatttacttatgagcaacgagctacaaaacataaaaaaccgtttcggaattatcggaaactttcctgcactcaaccgtgccctggaaaaatctatccaggttgcccctacagacatttctgtactggtgattggagaaagtggagtgggaaaagagtttattccgaaaatcattcattcagaatccagaagaaaacatcagccctatatcgtggtaaactgcggggcaattccggaaggaaccatagattccgagcttttcggacatgaaaaaggagcctttacgggggctacagctacaagaaaagggtattttgaagtggcagatggcggaaccatttttctggatgaggtgggagagcttcctctgcagacccaggttcgtcttttaagagtactggaaagcggtgaatttatgaaggtgggttcttcacaggttcagaaaaccaatgtaagaattgtggcagctaccaacgttaatatgatgaaggccatccatgacggaagattccgtgaggatttgtattaccgtctgaatactgttcagattgatatgccgcctttaagagaaaggaaaggggatattcatttgttattcagaaagtttgcaatagactttgcggaaaaatacaggatgcctgagcttgagttggagcaaagtgcagttcattatatagaaagctattcttttcccggaaatgtccgtcagctaagaaatttagtggaacagatgaccgttgtggaaagaaacaggaatatcactgcagaaaaacttgctgaatatattccaatggaaacccaccttcccatggtggtaaataatcagagtgctccaaagcagaatgatttcggaagcgaaagagaaatcatgtataaaattctgtttgatatgaggaatgatattaatgatttaaaatccttaacttcggaactgatcaagaacagaggaactgcagatctgagtaaccatgagaaaaacctgatcaacagaatttatacttctgatagtcagccacaagtgaattccggatcgatgttatattttgaaaataataatgatacaccggccgttcagactcctacgattatttcaaaccctgatgacagctatgaagatattgaagatatcgaaattgaagaaaacagaccggaatctctttcgcttcagaataatgaaaaagatttgattatcaaggctttggagaagcataagggacgtagaaacagagcggcagatgagctgggaatctcacaaagaactttatacagaaaaataaaacaatataatctggaagattaaaatcaaaaataaagatttaagattttaaataacagaaaataccacaaaaatgaatatcaggattaaaaatatcagcctgaaacagtcgctgctaacagtaatgctttttgcgttactgggagttttaaattcatgctacagttttacgggatcatcccttacggacgagaaaacagttcagatcaatgaatttcccaataatgcacctctcgtaaaccctgcattatcacagcagttttctacggcaatacaaaacagattccttcagagaacaactttaaaaggaacaaaagaaaatcctgatatcctgattgaaggagaaattacggactattccattacccctaccacaatcagttccaatacccagacaaacccttcgggtggagtggttcagcaggcacagaataaacttacgattacagtaaaggtacattatgaaaataaaattcatccggatgcaagttttgacagaacgtattctgatgaagctgcattcaacagtgatgtatctctaagccagatcgaagaccagcaggtaaagctggtgacagatagaattattaataagatatttaacgacattgtagcgaattggtaagatgaatccgagagttttagaattaataaaaaatccgaaaaatattcagttggaagaccttggtcttttgaaagaagagattcacacttttccttatatccagaatatcagggcgcttcacctgtacggagtacacctgtacgaaaaagagaactatcagaaagaactctctacaacagcggcctacactacagataaaaaaattctatatcagctgatcaatggaaagatcagacaagaaccaaaagctgaaattgctgaagaaaagaagccatctaaaaccgttgaaaggcctgcacaattagccctgaaaactaaatctttccctattaaaagagaagaagaagctgcggtggagaaattggcagaggagaaggaaaaaacatctgttttaccaattgcacatgaggttaaacctatttatgtaaatggtgagcgaaacagaattttgtttgaaggagaagaaaatttcctgaatgaaaagaattctgaaacaatagatattgaatctactctggaatcaggaactcttgtaacgcaaaaggcagagcctgcagcagaacaacctgttcaggaatcaaaagaagaagcacaggctgaaacagaggaaaaagcaggagaaaactttacgccggaaatcattattgatgaagatcagatttctgatgaaaaagaagtaaatggtaatgaagaaacgcactccgcagatgtatctgatgctgaagtaagcttccatggtaccgattcatttatgccggacgttaagatccaggcaaacaatgaagaaactgttgagaccgttgaaatttcccagcctaatgtcaataaacatgaagaggaaatgagacgtctgatcgaagaggttgagaaaaagatgaaggaaactaagtctgtttcgcaagaagaaaaaacagagcctgaatccattgaagatcatgaaattagctttgcagagacccagagttttcatttttggtcaacaagtgacgagaaaccagcgcaaatcgaagaagagccggtacaggaagaaattattgaaaacccattacctgtagaagaaaatactgacgataaagctgcagtagaaaaagaagaaaaaatgcctgaagttcattcagcatggaaaccaatgagtgtagaatctaatgtaccggattccttaatcaataaatctgaaaaagtatcagctcctgaaataaaagctccggcagaagaagtaactcctgttgcagaacctgaagcagttatagaagaggcacagcattctgaggcagctgaagatgttaagacagctgctcaggacgaagttctgcaggcagaagaaactcaggaagaatctgtatcaactgaagtcattgaagaagaaaaagctgaatcagaaactttaaaagaagatgttcctgtaatgaatgtttcgttcttcggaaccgatatttctacacttaaagttgaagaaaagcaggaggaaaagaaagaagagcctgtagaaaaagtacaggaggtaactatgaagaatacaactcagtcaccagtagacagcaatgttcccggttttatcaatacatggcaaagctggctgaagatagacagaaaacaggaaatcgaaaaggaaaagtcggtcattaaagaaaaggctattgaaacctttattgagaacaatcctaggatcagtcagttaaaagaagaaagtacttatgttgtaaaagaaaagaacgacgatatctcgcatctgatgacggagaccctggctaacctttattttgaacagaaattatatacaaaagcaataaaagcgtttgaaatattaatcaaaaagactcctgagaaaaaagaatattttgaatccagaattcaggatattaaggatttcagaagcaagaattaaaaataaaaaaggtactgattagaacagtaccttttttattttatcaactctgggaatcgtttttacttcctctcagctttctccaggccttccgtccaaatacaataacaagaattaatgtaattacggcgaagattgcggcaataacaggagcggccattgcaagaacagacataagcccggcgcctgcagtttccgttgttcctaccacagaattccccaatcctccggttgtggctgtggaggcggcccgtattcccgcaaacccggaactgatggtggctgctgtacctccaccggctattaaagccaatgcccattgtggaaaagttccaagttcagtaaactggctggcaaataatatagagccggcaaccgttgccataggaatagatacggtgtccagcaaatgatcaataaaagggatataataagcaaggatctcgacaatggtggctattccggttgtaataagcgtaggcagccccgcaagccattcaaagtgctcattcatagggatccagtggaagtaagaggcaatacttacaataaacatagggagaaacacccggaagcccgtagctgcagccagtccaatgccgataaatgcactgatgatatatgaaaaatagggaacattgtctaacatattaattttcagatttattgttttccctaaattacaaaaactatatgatattaagtgttgctaattttaagtacaggttctgtgatgctggatctgaactttactgctcttgaataaaaagcaaagaatctacgcaaccatctgtgttgatctttgccatccatggaaaaataaacttcagcaacactttattaatatcagatcattgaaagcagattactttttctgcgcttcacaaagtttgataaactgagcctccacatcctggaattttgccggcatctcagaagaaacccaaaacagcatagccattgttttctctccgaaagattgtttaaacagctctttattcagcctgtagcattctctcagcaatctcttgatacggttcctgtgaacagcccgcttaaaatatcttttagacacagaaacaccaaactttcctgtgtctataggaatactgggtttgtctttcagaatgataattctcagatttccgctggttctccatttgcctttctcaaaaagcaaactgatctccgtattttttttgagcttctccgctctgggatatttggaattctgcattaatcttttttcttcactaaatgattaatcacttcagctgcagcatacaacccaaaaatagcaggaataaaactgatagtgccgtagaatgactttttgaagttacttccatcagtcattttaagactttcctccttctggatttcattggagaatacgcatctgatccctttattgattttttctttttttagcctttttctgacctgtttggcaaggaagcaattgtgggtcttgctgatgtcccttaccattaccatacttggatctgttttcccaccggcacccattgagcttacaatcttgatttttcttcttctggcagcttttattaaacagattttcggcgttacactatcgatacagtcaagaacataatcgaactttccggaatcaagcacttcatccattctttccggattcagaaactcattgattttggttaaatgaagctgtgggttgatgtccagcaatctttcagctaccacttctactttatgctttccaaccgttgagtgtagtgcaggaagctgtctgttgatgttggtaatatctaccgtgtcaccatctacaatggtcatattgcctacaccggctcttgccaggaattctgcggcaaaagaacctactccccctaagcctacaacgagtacgttggctttggtcagcttatccaatccatcttcctttatcaaaagttcagttctttccagccagtatttatccattttttatcgtgtgtaaattttctaaaatttgttcattgagttgttccaaagaaattccttttatttccgaaaccttacgatacaattcttcgatgttaaaatcttcgttgtcagtttctaaaaagattttgtctgatggagtgtttttcaaaatatcctgcaaagataaattatacaaaacagcttttccaaaactcaggtaaaaattattggcaagaagatcctccgcaatttggtgttttttattaaaaccatggataatcataggttgttcagccctcttcttaaatgaaatgacctcataaaattttcttacacaatgaataatcagaggtttttttacttcgttggcgatctttatctgtcttaaaaaaactttctcctgaattttctgatcaacagaaaccaaagaatccaaaccgcattcaccaatggcaaaacagttttggaatatcatgtttttcatcctggaaaactgctcttccatattgttgatgtcaatatcctgggggtgaattcctatagaataagggaaatcaggaggtatctggccaatatccagattataaattccatttctgatatatttcttatgatggtgaaaatcaaaaaaatccatattcaaaaataagtaatttcagatttaatctaaaattattaaacgatcgtttataaatgtgttaaaaatttcttaactttactcaaagtacacttcatgaaaaaaaaatttacagaaaaacagattcacatactggatattgcagaagagctgattgcaaaaaagggatacgagggaacttctgtaagggatatttgttctaaagcaaatataaacgtcgccatgatctcttattatttcggttctaaggagaaaatgatgtcttatctctatcagtacagggtactgaagaccagagagaatttttcagaatttgcagataccatcaaagatggtaaaccggaaatgcagttgcgtgagatgattaagtatattgttgctcagcttttcaagtataattatttccatgggtttgtgacccaggagctccgccatacagaaaatctgaaagatgagctgcttgatttctatcagctgtttgtgaaaaaactggatgatgtcattaagaaaggagttgcgtcaggcgtttttacatttactcccaagcctgaggatattcttaccatgatcatcgggtcaaccttatttgtaatcagaaataaaaacttttacgagctgtatgttcccagtaaaaatgaagaaacttacgcaaaagaagctgagaaaaaggtgagaatgaatcttttattaagtgtttttgcaattttgggatacgctgcagactaaaattacgttaaatattcataaaaaaaaatctattgacaaaaaagttatatttttgcaaattagtaaatcggctgtataatccgaaaactgttgaattttttatatgaaaaaatatattttaggtctttttgctgtagcggtggttacttcttgtgtaagccagcaggaaagagcaatgaggagtgctgataaagattttatcttgaaagctgctaatgaaaacttcgccaagaaaaagtggaagaacgcattggctctttatgacagacttgctaatcttgtggcgggaacagatgatttccctaacgtaggtttcaatacagcgtacgccaactattatgacaaaagttataagctggcagggcatcagtttaaaaatttcgcagtaagttttccaaaagatccgagagcagaagaggcagcatatatgtctgcgttgtgctattatgaaggatctatggattacaatctggatcagtcaagtacagaattggcgatcaatgagcttcaggactttctgaacaattatcctaactctgaaagatctaagaatatcagtcagttaattgatgaattgtcttataagctggaatttaaggcttatgaaaatgcaagacaatactacaaaatgggcgaatataaagccgcaaatgtagcatttgataatgttctggaagattttccaagtacaaaacttcgttcaaaaatttatgattatatcatgaagtcccgttacgagctggcaatgaaatccgtgtataatcttaaagaagaacgtattgagagtgctttaacctatacaaaactggtagaaaaagaacttccggatacggaatattctaaaactgctgtagatctgagaggaaaactggaaaaggaaaaacagaattttgccgttgttaaaaaacagactgaagcaagaatggctgctttaacagcaagacagaaaaaagaagctgaaaaacttgcagataaagataaaaccgagcagcagattaaagatcagatcagcaatgaaaagaaagcaatgcagttacagagggacagtgcggcacttaagacccctcctccggcagcgactttcaaaattcaaagataattcgtaaatttgccatcttaaaataaaaataattttctcaaaatgagtgtaaaagatacaaaagcagaagtaaatacaattacttacgataaagataagattgaagataaagtaggttcaatctatgaagctattgttatcatgggaaagagagcagagcagattaatgcggagatccgtacggaacttcacaataaactggatgaatttgctgttcacaattctacattagaagaggttttcgaaaacagagaacaaattgagatctctaaacattacgaaaagcttccaaagcctacttcaattgctattgaagaatggttaaacggagatgtctatttcagaaaaacagaagaaagaaaataatcaatcatctgtgttttaataaatcagggtcataaaggaattcacttcttttatgacctttgttgttttgaagcctgattgtgtgggaaaaaataagtactttagtatttcaaaaaattagaactaaatgagtgtttccggtaaaaaaatacttatcgctgtctccggaggaattgcggcttataaaattcatttcctgatcagggattttgtgaaaaaaggcgcagaagtacaggttattatgactcctgacgcagaaaactttgtgacaaaattaagcctgtctacattatccagaaaaccggtgtattcagatttttatggagataacggaacatggaacagccatgtggaaatggctttgtgggcagatgtcatgattgttgctccctgtacagccaatacattagctaaaatagtccacggaatgtgtgataatctggttatagcgacttatatgtctgcaaaatgcccggtgtttattgctcctgctatggatcttgatatgtatgcgcatccttccactaaaaagaatctggagctggcagaaagcttcggacatatgattataccagcagagagcggagagctggcgagcggattaatcggacagggaagaatggctgaaccggctacgatctttaatacggttgaacattattttacttctcatagccactccggcagtcttgaggggaaaactgttttaattacggctggacctacctatgaagctattgatccggtaagattcatcggaaaccattcatcgggaaagatggggttttctcttgcagaggaagcttcgaaaagaggagcaaaagtgattctgatttccgggccaagttcccaaaccataaacgaaccaaatgttgagcttcataaagtgacttcagcaaaagaaatgctggcaaaagtttttgagttttacgacagaatagacattggaattgcaagtgccgccgtagcagactatgcacccaaagaggtggctaaggaaaaaatcaaaaagaatgatgaaaatcttacaatagaactggttaaaaatccggatatccttaaaacgatgggagaaaagaaaacccatcagtttctggtagggtttgcgcttgaaacccaaaatgaagaggaaaatgcaaaaggaaagcttgaaaagaaaaatctggatatgattgttctgaattctcttcgtgatgaaggagccggttttaaaaatgataccaataaaatcaagatatttaccaaaacagaaaagaaggagttcaacctgaaatccaaagatgatgttgcaaaagatattctcaattttgttgagtctcaacttttaaaataattttaataaatttccgttctcaatttttaatagacaatgaaaaaaattataagtttattttttctgttttttctatacacccaaagtttttcccaggagctgctggcaacggtgcaggtaaactccaagcagttgggaggaagtaaccagcaggcgtataaggcattggagaagagtctcagggactttatcaataataccagctggacaggcaaaaaacttcagaattttgaaaaaataaaatgtgctttttccattgttatttcggaaagagatgttaataaattcaaaggaactattgttattcaggcggtaagacctgtttataatactacgtatgaatctcctttgctgaaccttcaggatcagagatttgcttttgaatatattgaaaatgagagtcttatttttaatgaaagacaattttctggaaaaaaccttacagatgtaatcagtttctatatttatgtgattctggggatggatgcagacagctttcagtctatgggaggatcacaatggtatgcaaaagcacagcagattgcccagaattcccaaaacagaaactatgagggctggaataccattaacgagcccagaagccgttctattttgattaacgaaatcatgaaccctaactggagtcagctacgttctaccatttatacctatcacagagcaggactggataaccttttcaatcaggaccagacgcctggtaaaaaagtgatttttgatgccctgatgcaattgaaaatgtatgagaacagttttcagcaggcatttttctttaacctgtttatggataccaaaagtgatgaaattttcaatattttcaattctggaaataacggaggtctgattctcaatgatcttaaacaaacaatgatcatcctttcgccaaagaatatagacaataaatggaataagtggaaagtctagagatttccggataagttaaatactcagtattatggatgagagtagtgaaaaaacattttctcaattcattaaaaaaaaacttatttttacatttcaaactgaaattggattataacccggattatcaatgctttcgagaatttacattaaaaactttgccctgattgatacccttgaagtatcattgaaaaatggtttacaggttattaccggagaaacaggagctggaaaatctattattttaggtgctctccggcttattctaggagagagggcagatgtaaaatctatcgctaaaactgaagaaaaaagtgtggtggaaactgagttttcactcaacaatcagtttaaaaaattctttatagaaaacgatctggactacgagcttcagaccataatccgaagagagattcttccttcagggaaatcacgtgcattcattaatgatgtgccggtaacattggatatccttaaagagctttcctctcaattgatcgatatccattcccagtttgaaacttccaatctttttaccgctgaatatcagtttaaaattattgacggattatctgagaataaaaaggttattgaagaatatcagcaggaattttccgattttcaaaatcttaaattgcagctgaaaaagctgaaaacccagtttgcagaagccaataaggaaagtgattacaaagaatttttactgaacgaattggaagagctgaagctggatgatgtggattatgaagatatccaaaatcaactttctgttcaggaaaatgccggtatgatctccgaaaatctcgggcagatcctgtccaggtttcatcaggaagaaataggaattctgtccttctttaatgaggcaaccaataagctttcaaaaatttcaggtatttctgccagtttcgcagaattggatgaaaggctggaaacttcatttgttgagcttaaagacatcatttctgaattggaacatgcagcagaaagagtagaaattaatcccgaaaatctcgtataccttaccgatctgaacaataaaatcaatgctttgtttcttaaacataatgtttcagaactgaatgagctgatagaaatccgaaaccagctggcaggagaccagaaaggagcttcagatcttgagttacaaattgaagaaacagaagaaaatatttttcagaaagaaaaaacacttctgagccttgcttcaaaactttcaaagaacagacataagaacatttctgttttcatcaaaaaagcagaaaatcttctcaagaaattagggcttgaaaaagcgaaggtcgatattgaactgcaggatgctgatgaattcaatcagtttggaaaggaaaatatccagctgttgtttcaggccaattccggtttccctttaaagccaatccaaacagcgatttcaggaggagaaagatcaagagtgatgcttgctgtaaagaagattattgcagaaagcgacgaacttccaactttgattctggacgaaattgacaccggagtgtcaggaaaagtggcagaagaaattggaaatcttatgcgtgaaatgtctgaagatatgcagctgattgttatttcccaccttgcacaggttgcggccaaaggaaacgacaactataaagtcataaaacaggatatttccggcagaacacagtctacaattattcctttgagcagtgaagaaaaactgaacgagattgcccagcttctttccggaagtaaaattacggaagctgctttagctcaggcgaaagagcttatcggataataataaaatcacacttttcctgaaaaaattgtaacatattttacattatatttactaatgtaaaaaactaacatatgtttctaaagttccttaggcttgaaatcaaaagcttctttcgtggtacttctttagggatcaatctgactatgaaaatactccggtttatcggaatactttatttcatgggctgtctggtaggaggagcttttattgcttttttctacgtgcaggaggaaatgcaccagaatcctttaaaagtggtttcaaaatttctgattgttggctggatcattgatcttgccctcaaatacctctggcaggaaattcctacacagaatattaagccgttcctcaccctgaatattcggaagaatacactggtcaattatatgctggctaaaacttttctttcggcattcagctggttgagttccttgttcttcattacattttcactgattgctatattcaacggatataatgttcccgggatattactctggcttataggggtgatttcattactctatctgaataatttcattaatattttcttcaacggtaaggagacccttgcagtgatcattggtgtatgcttcctgattgtgggagcgttggcatattacaatattattccggttttgtcttattctgagtctgtattcttcagcttttatgaaaagccttactttgctttgatccctgttgtattgtttataatattgtggtggatatgtttccgttaccttcgtaacgaattttatcttgaccaggggcttgaagcgaagaaaaccgttggaaaaacagaaaatatagctttcttaaataaatatggagttaccggtacatttatcaataatgatataaaaatgctgagacgtaataaagtgaccaaaggcattttgctgggcagctttatgtttctgttctacggattactgatgtttacctcttcactttacaaaacacctgcaatgatgatgtttatggggctttttgtaacaggaggcttccagtttctgttcgggcagagagtaccggcttttgacagttcatattatccgttgatgatgaccctgaatgttccttacaaagaatatctgaaagcaaaatggtggctgatgaatattgtaacagcagcttctgtgattatagccctgtgttatgcgtattttggctgggaagtttatattaccttttttgcagccggattatacaatattggagtgaactcccagtttaccttatggtcaggtgcctttaataaaacccagattgatctgaattcaaaagaaaaaagaatggggcaaaaaggaagtttcaatctcgtggcaatgcttctgctgattccaaaaatgcttcttccaatgagtgtatttgcggtggcaaaatatttctcgggaattacaggaggcgtaataagtattgccgtcataggaattatcgggtttttcctgagagaaaaaatcttcgatatcattgtaaaacattataagaaagaaaaatacagcacccttgatgcatttaaaaataaaagttaagccatgatcaatatccataatttatccaaaacatacgggacagcaaccgttcttaatatcgaacatcttgaaattccaaacggagaaacatttggtcttgtaggaaataacggggcgggaaaaacaacacttttcagcctgatgctggatttgattcaggcttctacaggatatgtaagtatcgatggtattaaagttaatgaatccgaagcgtggaagaataaagtttcagcctttgtggatgatacattcctcatcggttaccttactcctgaagaatatttttacttcatcggagagctgagagaccagaacaaggcatctgtagatgaattcctgaaaccttttcatgattttttcaatggggagattcttaaatccggcaaatatatccgtgacctttcaaaagggaatcagaaaaaagtaggaattgtgggggcaatcattggaaatcctgagattattattcttgatgaaccgtttgccaacctggatccatctacgcagatcaagctcaaaaaccttatcaaggaattgtctaagcaggatggagttactttcctgatatcgagtcacgatctttctcacaccacagaagtctgcaacagaattgttgttgtgaataaaggtcttttggtcaaagatattcagaccaatccggaaaccttgaaagatcttgagcaatattttgcagatcaggtttcagtttcggatatttaataccacaaaaaagaggtatgaatacgatagaatcacagaacgtaacagattatccgaatagcaatactattttcatggtctggaaacttaatgacagtccacagctgaaggatgtttttcaaaggctgtgcgctttggttttaaatcttaataattcggttttcaaccgttttccggacagcagggcaagctgtgtgatgggaattggggccgaagcatggagaaaactggaacttccaacacctcctcccaaggaattagtgagttttgaagaaataaagggaataaaacataccgctgtttccactcccggagatcttcatttccacctgagagcagataacaaaagtctgatctttgatatggctgtggaaatatccaaactgctgagctcggtaggtgaaagtattctggagattcatggattcaaatactgggatgcacgctccattcttggttttgtagacggaacggaaaatccgcatggggacgaccgggattactttgccaaaatcggagatgaagaccttcagtataaaggcgggagctatcttttcgtacaaaaataccttcataatatggatgcatggaaaggattatccacagaagagcaggaaaaagtaatcggaaggtcaaaagagaatgatattgagatgtctgataatgtaaaaccttcaaactctcatattgccttagccaacattgaagatgaaaatggagaagaactgaaaatcgtcagggacaatatgcctttcggaagtccttctaccaatgactttgggacctattttatttcttatgcaagcacgtttacgactagcagaaagatgctgaccaatatgtttataggtaacccaccgggaaattatgacagaattttagacttcagcacagcagttaccggaacgcttttctttgttcctaccagaaatatgcttgatgaattctcaggataaaatgcaaggctgtctctttcaggacagtctttcttatttaattaagtacagcaaataaaatttttttaaaaacgtgtaacctttttttgttttcattgtctttagtatagaaacagcataagcatgaaactcttgttcggaaataaaaagaatgatttgttgagcctcctgaaaaaacaggacccggctgcacagaagattttctatgaacagaatgtaaagaaatttctgagtgtaagcaaaagctatgtaagcgatttgtaccaggcggaagattgcctcattaaagcattctgtaaaatttttaagcatatagaaagcttcagaggagagtcgaacctggaaagctgggcaagaagaattgtggtcaatgaatgccttaattttatcaaaagtcataaaacagttttctatctggatgagatcaaccaatcttttcatgaagatatccacgaaacggagattgactgtgactttaatgcacaagagcttctggatcagctgcctgatgcttacagaatggtttttaacctgtacgtactggaaggatattcccatcaggaaattgctgatactttgcagatttcaattgctgtgagtaaaacacaactgttcagggcaaaagaaaaattaagaaagatctactttcaacaacaaaaaaaagtgaaaaatgaaaacgtttaaagataatattgaatttcagatcaaaaagcagattgaggaaagagagatcgctccgtcccgtgatctttggtctgaaatagagtttcataataacagtaatcgttcaccaaggttacaagtgaagtggggtttaatagctgcatgtttactattaacctttggtttgggtgctgttctgttttttcttaatcagcctgcggaaattcatcctgaaattgtaaaggaaacagaaaaaactcctgttgacaatattataaaagatccggttcagaacagcattccgctggcagctgagaataatgataaaaaagatataaaaaaaatacctgctcaggataaagagcaaatagtttctgctgtggcaataggatcggagaaactgattcctaaagaaacagtccctgcaaagaaactggaaattctccagatttccactcctaagctcatggcaaaagccgattctttaaaaactccggttaaaaagaagaaatatgtagacccatccacgctactattttcagtagagcataaagacgttatcgaaaaaacgaaggatggaagcaatgttgctactactattgacctgaatgcccggtaatttatacgaaaattaaaaattaataatatgatcaagaaattaatcgtaatgggattgctatgctttgtttcagcatctttccatgcacaaaagacctttaatattaacctgtcttccaaaaaagatactgaggtaagcccgattgtcaaagaaaaagtggaagaatatgccgctaagatcaatgccattatccaggaagaaaaaaagctgatggaagaagaacttaaggttttgcaggcaagaaacctggataaggctgaattcgacagagaaaaagcccaaattgcagatcgctattctgagaaaatggataaaagaattgaagagctgggatttgatctggatgatgtgattcagaagcaggtaagatattcccttctgaatactgatgtgacttccaatgaagagcttaaagaaaagctgttgaaaaaattccgtcctaccagaagctttacaggatatttctcttacggaatcatgacactgacaaacagttctcaggataacgagcttgataagaacatcggatatacaaataatctggaatttggactgaaactgaattatcagcttagcagaacaagcccgtgggcgattacttcaggattagggttttcctggagaaccgtcagaacagataataatatgtactttgcaaaaagtgcagaccagggagtagcttttgttcaggctaatcaaaatctggacaaaagtaagctgagaacgggatatattatcgttccccttggagtacagtataatttctccaaacttaaaaatgctggtatggatatccagtaccgtagttactatactggatttaaaataggagcgaatgtatatggaggggtgaaaatgtctacgaataacattgtgaaagacggtgacggagaaagaagagaccgtggaaattatcaggtgaatccttttgtgtatggggcacagcttactctttcttataatagtttcagcatatttgtaaaaaaagatttcagcaatttctttaaggacggctattttaaaaatgataaagcgctgatattcggcttagccattggcttggattaaatatattttgattgcaaaacaaaaactccggaagacttgctcccggagttttacatagtatcagttatataatcattattttaagcttcctaccatgtcttcaggttttacccattcatcaaactgttcagcagttaacagaccaagattgatggcttcctcttttaatgtcgtaccatttttatgggctgttttagcaatcttagcggcgttttcatatccgatgtgggtatttaaagccgtaacaagcatcaaagatttgtctacaagctctttaatcctctcatgatttggctcaatacctacggcacaatggtcgttgaaagaaatacatgcatcagcaatcaattgggcagactgtaagaaattaaaagccattaccggtttgaaaacattcagctcataattcccctgagttccggcaaacgagatggtagtatcatttcctaaaacctgtgcgcaaaccatggtcattgcttcattctgggtgggatttacttttcctggcataatagaagatcccggctcattttcaggtatatgaatttccccgattcctgagcgcggtcccgaagccatgagtctgatatcctgagcaattttaaacagagatacagccaactgttttaatgcgccgtggctttcaacaatggcatcgtgagcagcaagagcttcaaatttattttcagctgtaacaaaaggatgttttgtaaactgagcaatatattcagctacttttacatcatagccgttaggggtattcagacccgttcctacagcagttcctcctaatgccagctcagaaagatgaggtaatgtattttttaaagctctcaatccgaattcaagctgagccacatatccggaaaattcctgtccgagagtaagtggagtagcatccatcaggtgggttcttccgattttgacaatatctttgaaagctttcgatttttcagccagcgtattctttaatttttccactgcaggaatcgttacttccatcacttttgtataagcagcgatgtgcatggctgtaggataagtatcattcgaagactgggatttgtttacatcatcattcgggtgaatttcagacttttcgcccaaagttcctccattattaacatgggctctgttggagattacctcattcacattcatatttgattgtgttcccgagcctgtctgccagatcactaaaggaaactggtcattcaattttccttccagtatttcatcacatactttcgctatcatatcccttttttcggcaggaagtacccccagatcagtattggcataggctgctgcttttttaagataagcaaaagcttcaatgatttcgtgtggcattgaaccttcaggtcctattttaaaattgtttctggaacgttctgtctgtgcaccccagaatttatcggcaggtacctgcacttctcccatggtgtctttttctattctgtaattcatagtggttgaaatttgtatgatctttatttttgagccaaaaaattgttgacattactcatgtttaatgaaataaataatgttttggctttgtttatttatcttttataaaggtacttataaactcagaaacctacaatttataatcattataaatatcaatttaagtgactgattttactcatattttttttaaggaggcgtatttttgtacaaacaaaaattgaatggattttagatatcaggatccgtatcctattcagaaagatgatacggtgtacaagaagcttacatcagattatgtaagggttgaaaaactgggtgacagagaaattttaacagtagatccgaaaggactggaattattggcagaagaggccatggcagatgtgtctttcatgcttcgttcctcacacctggaaagccttagaagaattattgatgatcctgaagctacagataatgatagattcgttgcttacaatcttttacagaacgctgcagtagcggttgagggagctcttccttcatgccaggatacaggtacagcgattgtaatgggaaagaaaggtgaaaatgtatatacaggagtagatgatggcgaatacctgagcaaaggaatcttcaatacttaccagaaaagaaacttaagatattctcaggtcgttcctttaacgatgtttgatgaaaagaattccggatccaaccttccggctcagattgatatctatgctaaaaaaggagattactacgaatttttatttttgacaaaaggtggaggttcagccaataaaacattcttataccagaaaacaaaatctttactgaacgagaaatctcttgaagaattcatcaaagaaaagatttcagaccttggaacggctgcctgcccgccataccacttagcattggtaatcggaggtacctcagcagaagccaaccttgcggctgttaaaaaagcgtcagcaaaatattacgataatcttccgacagaaggaaacgaggccggacaggcgttcagagaccttgaatgggaagccagagttcagaaaatctgccaggaaagtgccatcggagcacagtttggaggaaaataccttactcacgacgtaagagtgatcagacttccgagacacgctgcatcttgtcctgtaggaatgggagtttcctgttctgcagacagaaatatcaaaggaaaaataacaaaagaaggaatcttccttgagcaattggagcaggatccgaaaagattcttgcctgatacacctccgcatctggaagaagctgttgagatcaatctgaataagccaatgccggaaattcttgcagagctttccaaatacccgatcaaaacgagactgaaactgaacggaacattgatcgtggccagagatatcgctcacgcaaaaatcaaagaaattattgacagtggtaagccaatgcctgattatttcaaaaatcacccgatctattatgcaggacctgcaaaaactccggaaggaatggcttcaggaagcttcggacctacaactgcaggaagaatggatgtttatgtagatgagttccagagccatggcggaagtatgattatgctggcaaaaggaaacagaagtaaagatgttaccaatgcatgtaacaaatacggaggtttctatcttggatctatcggaggaccggctgccatccttgccaaagacaatattgtatctgtagatgttgtagacttccctgaattaggaatggaagccgtaagaaaaatcgaagtaaaagacttccctgcattcatcattaccgatgataaaggcaacgatttcttcgcagatcttgctcactaattagtttaaaattaaaataaataacaaaatagaacgctgatcttttgtgtaaaaaggaaaaaagttctatttttgcctaaaatctttaagagaatgataacgattttatcagcattttggccgttctaccagttcctatggactgttttcttcattactatgttcttagtaggattctggtgtatttttatgttcttcggattagtaatcccaatgtggctaactgaaggtttgaaagagtatttcggaaaagtaaaacctttcgatcctgaagacatcagaagaaagcttattactgagcaggaaggtgtagaggttatctataacgagcctaaaggaaacggacctttcattcacgatcacggacatcatcattaattgattgtcattgctttttcacctgaattctgaaaaagtaatatcaaagcaaaacaacatatatgaaccgcttaatttttttaagcggtttttctatttgatatttctcaggcttctcatgaatttttctggattatttttccccgaaaactgaaatatttaccagtgactgaataaaatagacaatatgaataaaaattaatcctatattcgataaaaaataggacatgagaaaattttattccgttgcttttctgctgattgccatgtgtgtttttggacagatcagttatacaatttcgcccaatccgtttaatgaaacagatgctattacgcttacagttcccggagatcagattgacgaatctgcctggggcgtttccaataatgccatttacatatggacctggtcttttgataccaattatcagaacagccaggattgtcctaccaatggaagctggaacaactccaatgacttaaataagctgaattataatgcaacaaccgacagctattcgcttacctttactccaactgccttctttggtagaacaggaatcggaaggctcgggtttctattaaaagataaaacaggatcacatcagacctcgccggatatttttgtaaatgtggggactttaagcctaaatcttacaaaccccttggtgaatagcctgacttctgttcctgcaggtaattccatcaatattactgctacaaccaatgtcaacgcaacatttcagttaaaagccaacggaacggtcgtaaactctaccacaacaccatctcaatcctattcttacagttataccgttactcaggatgcaagcatggagcttatagcaacacagggatccagttcaaaaagtgtcgcatttattctgcaggttccgagaaatgtggtttcggaagcaataccgaactggataaaacaaggaatcaattatcacccgacagatcagaccaaagtaggacttgccttatatgctccaggaaaaagttttgtccatgttatcggaagtttcaataactgggtagtgaatgatacgtatttaatgaaaagagataccaccaatcctgatctgtactggattgaattgattggtttgacgcctcagcagctctatacctttcaatacagaacaaatgacctgagaaaagtagcagacccttattcaccacaaatcttgtcttcttatgatgatcagtggatttcaactgccacttacccgaacttacctgcatttccggccggacagggttttgaagtttcaacatttaaaaccgggcagacagcttataactggcaggtgaccaactttcaaaggccggcaaaagaaaacctggtagtctatgaattattattaagagactttacacaggaaaagaactggcagtcattgatcaataaaatttcttatctgaagaatttaaaaatcaatgctattgaattgcttcccatcatggaatttgacggaaacctttcatggggatataatacttccttccattatgcattggacaaagcttatggaactcctgaaaaattcaaagaatttgtagacctgtgccatcagaacggaattgctgttattcttgatgtcgcatttaatcatgctacaggacgttcccctttggtaaggctttggaatatagatccggatggcgacggttatggaaatgtagctccggacaatccttactttaatcaggttccgaaacattcatataatgtattcaatgactttaaccatacaagtccttcaacgcaatattacgttgaaagatgccttcagcaatggctgacagaatatcacatagacggattccgctgggatctaaccaaaggattcactcagagctgttctgaaaatgatgaagcttgtaccaatgcctatcagcaggacagagtggatattatgaaacactatgccgacaggcaatgggcaatcgatccgaattcctacatgatttttgaacatttgggaacagatgcggaagagcagcagtgggccaactacagaatagccgaaggaaaaggcgttttgctttggaataaacagacagatccttataatcagaatacgatgggatataaggaaaacagcaattatgaccgtatgaaccacagccttcacggttttaccaacatgagtgctgtaggctacggagaaagccatgatgaggaaagactgatgtttaaaaaccttgcctatggtgcagtaaacggaaattatgatgttaaaaatctgaatactgctcttgacagaatgaaaactttcggtgcaactttctttaccattcccggcccgaaaatgatctggcagtttggagaattaggctatgaattcagtatcaacagatgtgcagacggtagtatcagcagtggctgcagaaccgatgagaaacctgttgcatttacgctgggatatgataccaatgccagcagaaaagcagtatatgatacctgggctaaaatcattaccatcagaaatgcccatcagatttttaaaaccaaaacatacagcatagaatctaataaccttgcgaatgaccctaacgggctgatcaccagaatttacctgtacgatacatctattactacaggaataaaaaatgttgtggtattggccaattatacaatttccgcacaaaacgtggttccttatttcccttatacaggtcaatggcagaacctgatggatgacagtatttcggatgtggcctctacaacggctcccatcactttgcagccgggagaattcagaatctttggaaattatgcaggtgctttgtctgcagcagatataaatgcaggcaacaaattatcgcttcagattgcggataatccggtacaaaacggtacggcaaaattaatttttaataaaatgaaaaacggagaaatttccatttttgatatgaccggtaaaaggttgagttcattcagactggataaagaaaacggcacatatgaggtcaaagtggactatccggccgggacctatctggtacatctgaaatcagacacaggaatagcaactcaaaaaatgattgttaagtaaactaaaaggcagatttgcaggcagcagatctgccttttttgtccatttaaaaaaatagtctacttttgcagtagatttatcaagaaaggtggagggatttggcccggtgaaaccttagcaacctgcacggttccggaagtgcgaaggtgctaattccaacccgaggggaagataagtgaaatgaatactctatatgattcccgtttcttgaagtcttatgtatctgcggaaaagaccgccggataagttatgatcaattgggaagaacaaaatgaaaaaaataagtacagctgtattattgcttggagcaatctgggttgctgctcaggagagcgggaataaagaaaaagaaattgaagatattatcatcgttggaaaccgtaatgttaaaagaacaaagctggagacaccggttccggtagatgtaattaatatcgacaaaattcagaggagtgctccgcaaatgactgctcaggatctgctgaactatgtgattccgtcatttaatgcagtaaggcaatccgcttcagatggcacagagcatattgaccccgttaccttaagaggaatggggccggatcaggttttggtattactgaacggaaaaagaagacatacaacatctttggtcaattatcagaacacagtcgggaatggttctgtgggaactgacctgagtaccatcccggtgattgccattgacagaattgaggttctgagagatggggcagcagcacaatacggatctgatgccattgcaggagtcatcaatattattcttaaaaagaatgccggggcttcagcaagccttacttatggtgtaagtggtagaaatgatggcgatacatatcaggcaggagcaaactacggagcttcattaggaaagaaagacggctacatcaatctttcaatgcagttaagccacagaggaaaaacaacaagaacacaaaatcatgatctggatatttttggggataattttgcctatgaatttgcagataatcctgagatagcaagagcagaagatgatgcagaaattcaaaaaagaggactgacgcgcgacgattttaatcttcagatcggggatgcacagatcaggcagggacagttatttttcaatgcagaatatccttttaatgaccattttaaactgtattctttcggaggcttcagcatcaaggaaggaaaaggttttggtttcagaaggcttccgagtgaaaaatccaatgtagtttcatccatttacccgaacggttttcaggcaacgctggcatcccagatatatgatgtatcttatgctgttggggcaaaatatactatcaatgactggctttttgacctcagtaatacatttggaagcaatactttcaattacaatgtaaacaatacgaataatgcttcattgggagcaaaatctccaacgagtttttacgccggagcacacagcttccttcaaaacaccattaatcttgatgtttccagaaatataaaccgttttaatattgccttcgggggagaattcaggtttgaacagtatcagatcaaagctggtgaagaggcatcttatgcccagtatgatatcaacgggaacattgctaccgaaggttccacagtgcttggtgcaggcggatcccaatcctttatcggattttctccggataatgcactcaggaaagacaggcattccacagccgtatatgcagatgtttcttatgatctggacaaaaagttgaacattgatgctgctgcaagatttgaaaactattcagatttcggaaataccttgaatggaaagcttgctgtacgatatgaatttgtaaaaaattatgcagtaagagcagctgtgggaacaggattcagggctccttcccttcagcagcagtattttaataactcttatgcagatatttctacttccggcgagaagattgttaccaaaggaatctttagtaatgatagcaaagctgcagaaattcttggatttgataagctcaagcaggaaacttcagtcaatgcaagtgccggatttaccctgaaacctttaaacaacctgaccatcactatagatggatactggatcaaagtgaaagatagaattgttattacaggaaatataacagattcaagattatcagaccctgctgtagtaggcaatggaaatgaggttgaaagcggaagattcttcgccaatgccattgatacagaaacaaaaggagtagatgtagtggtcacctatgactggattcttggtaacggaaaattaaatatgaatcttgccggaaattatacggagacaaaaatcacagatttccattttccggaaaatttaggaacgcctcaggaacagttttttggcccggatcagatcaatatcattgaaacgctgtctcccaaaacaaaagcttcattaggattaaattatggaatcggaaagtttaattttctcgtaagaaatacctattttggcaaagtcataagagatggctatccgtttggagaagtgcaggagttctctccaaaagtcgttactgacatcagtgttgggtatgatattacaaaaagtatcaactttacggtaggagccaataatatttttgatgttttcccggatcgccagatttacagaaattcatactatggggtattcaagtatgctccggtgcagatgggaacgctggggaattatttcttcggaagacttaattttaacttttaatcattaaatgagtactacctcacatcagattggctggaaaacagctgccgcaattgttgtttccaatatgatcggaacagggatttttaccactctgggatttcagctatccgatattatcaatacctacagtattttcctgctgtggatcattggaggcatcctggctctgtttggggccttttgctatgcggaattgggatcgcattttaaaggaaacggaggcgactttatttatctgaaagaaacctatcatcctttattcgggtatctcataagctggatttcgctgattatcggattttcttctcctgtagctttggctgcattggctatgtcaaaatatctttctgtattcaattattcttttggaaacggctttgctattgctgctatttttctgattgcagttactctgtcattcagtttgaaaacatccagtcggtttcataactttttcacattcattaagatagcgtttattgttgtactcattatcctgggcgtctggctttcagattcaccacagattggcagcagtttgaatttcagtgacagctggcagaatgagatcatgcttccggcttttgctacatcgctggtatttgtaacctattcttatacaggctggaactctgcttcttatattgcaggagaaattaaagatgtccagaaaaatcttccgaaatcactcattataggaactgttttcgtgacggtaagttatattctggtgaattatattatgctgaaacatgctcccgtgattcagttggcaggaaaagaagacgtcatgggagaggcggctatcaatatgcttggtcctgcttttggaaaaatcgttaatattttcattgctttgcagctgattgcaacaattagcggatatttatgggtgggttcaagattaacccaggcttttgcaaaacatacttatatctggaaaccattatcagctggaaatgcaaaaggaattccggtaagagccatttttgctcatgctgtgattgcggctattattattttaacaggaagtttcaaagagatttttgtttacactgcttttattttacagctttttgcaagtctggcaatttctaccgtattcttcctgaagaaaaaggacaggaaaatctttaaatcaaatgctttttacattttcccggctgtttttcttttgttcagtatgtatattctctattttacatttattcataatcctaaagaaagtcttataggattgggaattatcgttgtaggaattgttttatatcttattgacagaaggctttctaaagaatctcaggctcagtcttaataacaaggaaagacgaattaacaaattggctattcggcctttttgcagttttgtcctcttttcccctaaagctcaaaaatttatggtgattcggaattttaattttgaattaataattcttatctttgcacccacaaaatttctacaatgtctaaatcattaattccaaaattagaagctataaaacaaagatataatgaggttgcagaccttattatacagcctgatgtcatttcagaccaaaaaagatattcttctttgaacaaagaatacagtgatttgggaaaaattgtaagagtttacgatcagtataaaggcgcattggacagtattgcagaatctgaggaaatcattgcggatggttcagacagagacctggtagatttggctaaagaagaaaagctggaagcgcaggctaaaattcctggactggaagaagagctgaaagtattactgatccccaaagatccggctgatgataaaaacgttatcgtggaattacgtgcgggaacaggaggtgatgaagcggctattttcgtagaagatatctacaggatgtacactatgtacttcaaagccaagggatggagacacgaagtaacagattccaacgaagctgcaaaaggatacaaggaactgatcatgaaagtggaaggtgaaggggtttacggaatcatgaaattcgaatcgggagttcaccgtgtacagcgtgtccctgaaacggaatcccagggaagagtacatacttcagcaattacagtagcggttttaccggaagctgaagaggtagacgtagagatcaaccctgctgatatcgaaatgcagacttcacgttcaggaggtgccggaggtcagaacgtaaacaaggttgaaacaaaagttcagcttacccacaagccttcaggacttgtagtagtgtgccagcaggctcgttcccagttggctaaccgtgaattggcaatggaaatgcttcgtgccaagttatacgatatcaaacttcaggaagttcagggagatattgctgctcagagaaaaacgatggtatctacaggagaccgttctgcaaaaattaaaacttacaactatcctcagggaagagtaacagaccacagaatcaacaagtctatgtacaaccttgatgcttatatgaatggtgatatttctgaaatgattgatgcagtaatcatggcagaaaatgcagagaaaatgaaaggggaagaagaaaattattaaaaattataatagataagcaaagcctctgatccttcaggggctttgttttttaataccaaaacataaaatataaactatgaaaaattacaaaattattttgttattgctgcttacgatgatcgggcagaacctatttgctcagactgaagtaaagaaaccgaaagaagcttttgaattgttcttcggaacttttgtcaacaatgatgaaacagctttgaataagcttaatgagtacctgaaacctaccgttgaaggacagaatgcttaccaggtagatttcaaggaaacttccaaggaaatgatgaatggcagtgttgaaaatttccttgctgctttccccaaggctaccgctgcagcttgcaaaaaagaggcagaagattattttactgccatgcttggaaattttaaaaccggaaagctaacggttaaaaatgtaaaagtagtcccgaatgaatatcttaaggacgaaaaaatagcagagataagttattctgtgagtttccttgtcccatcaaaattaacacccggaccaaaaggtgatctcaataaaataaaaccggaagaactgaaaaaatatttgattcaggctgcccaggacttcaaaaatgcggataaaactgtaaccactgaacagaattttaatctttacgaattgaaggaaggagggaaaatatattattggaacggcagcccggatgaaattgttaccaatctcaccgatttctattttgaaagcttcggagcaaatgaatagttggaaaatacacctataaagaatgaaagtccccgtttaaagggactttttttatttcacatactttacgtatttttgagaaaaccgatcagtatgaattttaaacctatattgttaactgctggagtattgttttcagcatctttttattctcagaaaatgaattatcctaaagcattaaaaggaagccagacagatacctatttcggaacagctgtttcggaccctttcagagatctggaaaatgattctgaagccactaaaaaatgggtagatgaagaagttgcttacagtcagaattacctgtctaaaattccgttcagagacaaaattaaaaaccaattgaaagatatctggaattatgaaaagatttcagccccgttcaaagaaggagattatacctattacacaaaaaatgacgggcttcaggcacaggctgtgtactatagaaccaataataaaaccaaggcaacagaagttttcttagatccaaataaattctcagaaaaaggaaccacttctctttccaatctttctttcaataaaaaagggaatcttgcggcatattccatttcagaaggaggcagtgactggaacaagataatcattattgatgcggtgaccaaaaaacagattgatgaaacactgctggatgtgaaattcagtgggatttcatggcagggagatgaagggttctactactcaagttatgacaagccaaaagaaggaaccgtactttccggaatgactgataagcataaagtatactttcataagctgggtacaaaacagtctgaagatcaattaatctttggaggtgataaaacgccaagaagatatctgagcgcaggagtttctgaagatcagagatatcttatcatttctgcggcgaatgctaccaatggtaatgaactgtatatcaaagacctgaaaaaaggaggagattttgtacagattataagcggatttgatatcaatgcaagcattgtagatacacaaggcgatgatctttttatttttaccgataaagatgctccgaatatgcgtctggtaaaaacaacaataagcaatcctgctccctcaacgtggaaagatgtgattccgcagactgaaaatgtattgggaatttcttccggcggaggatatttctttgcaacatacatgattgatgcaatagaccaggtgaagcaatttgataaaaccggaaaactgatcagagaaatttcacttccaggtaaaggaaacgtttcaggattcggaggaaaagaaaaggagaaagatatttattattctttcagcaattatattacaccgggaaccacttataaattcaatgtagattcaggaaagtctgaagtatatcagaagcctaaagtgaaatttaatccggacgattatgtttcagagcaggtattctatacctcaaaggatggcacaaaagttcctatgatgatcaattataagaaaggaactaaacttgatggtaaaaatcctactatcctgtattcttacggaggtttcaatatcagtttacaaccttcattctctgtagtcaatgcgatctggatggaaaatgggggtatctatgccgttccaaacatccgaggaggaggtgagtatggtaagaaatggcatgatgcaggaacgaagcagcagaaaaaaaatgtttttgaagactttatcgctgccggagaataccttcagaataaaggctatacttcaaaacaatatatggccctttcaggaaggtcaaacggaggattactggtaggggcaaccatgacgatgcgtccggatctggcaagagtagccttcccgggagtaggcgttttagatatgttgaggtataataaatttacggctggtgctggctggtcttacgattacggtactgcagaggacagcaaagaaatgttcgaataccttaaatcatattctccggtacacaatgtaaaagcaggaacttgttatccatcaacaatgattatcacgagtgatcatgacgacagggtagtgccggcacattcattcaaattcggagccgagcttcaggaaaaacaggcatgtaaaaaccctattttgctgagaattgaaaagaacgcaggtcacggagcaggaagatcaacagatcaggtaatcagtgaaaatgcagatcttatatcattcgctttgtatgagatgggaataatgaaatagatatttaaaaatatttcaataaaaaggccgggcattgcccggccttttttatttctactaaatgtaagaaaaacaggatgttaacataagtttcatgtttcgttcaaaaaaattaactttacggagacaaaattaattggaatgcgaaagacaatttctgtgaaaaaaccggattttagtgtatcacctcaggaaagagagatttacaactttgaaaaagacggtcttgaactcaaatcatcctatgagagaaaagatataaaagatgaatcattaacacagacttctccgggaattgaaccttacctgagaggaccgtattctacgatgtatgtacagaaaccgtggacaatccgccagtatgcaggattttctactgctgaagaatccaacgctttttacagaagaaatcttgctgcaggtcagaaagggctttcagtggcatttgacctggcaacgcacagaggatatgactctgatcactcaagagtggtaggagacgtaggaaaggcaggagttgccattgattctgtggaagacatgaaaatccttttcaatgaaattccgttagatcagatttcagtatccatgactatgaatggtgctgtacttcctattttgtctttctatatcgttgccgcagaagagcagggtgtaaagcaggaacagctttcaggaaccattcagaatgatattctgaaagaattcatggtaagaaatacctacatctatccgccggcaccttccatgaagatcattgcagatatctttgaatatacttcgcaaaatattccaaaattcaattctatctctatctccgggtaccatatgcaggaagcaggggccactcccgtactggaaatggcatacacgctggcagacggccttgaatatgtaagaacaggaatcaaagcaggaatgaatgttgacgatttcgcaccaaggttatcattcttctgggccatcgggatgaaccattttatggaaattgctaaaatgcgtgccgcaagatacatctgggcaactcttttaaaacagtttaatcctcagaatccgaaatcgctggcactgagaacccattctcaaacttccggatggtctctgacggaacaggaaccttttaataatatcacaagaacagccattgaagctttgtcttcagcattaggaggaacgcagtctctacataccaatgcactggatgaagccattgctcttcctacagattattcagcgaaaattgcgagaaacacacagatcattcttcagcaggaaagcgggatatgtgatgtggtagatccgatgggaggaagcaatcttgtagaaagccttacccagcagatgattgaagaagcgatgaggtacattgatgaagtagaacaggaagggggaatgaccaaagctatcgaagccggaattccaaaaatgagaattgaagaagctgctgccaaaaaacaagctaagattgacagtggtgaagaattcattattggtgtgaactcattcaaatcctcattaaaacaggaccagatagaaatcttagacattgataataccgaagtccgaagaaaacagatcgaaagactgaatacaatcaaagcagaaagaaatactcaagctgttgagcagatcctgaatgagatccgtgaaagcgccaaaacaggaaaaggaaaccttctggcattatgcatcgaagcagcaagaagaagagttacccttggcgaaatgagtgatgccatggaagaaacctttggaagatataaagcaaatattaaaacaatctctggtgtatacgcaatgaatgccggtaaaaacgaatactttgaaaaagcgcttcaactgactcagaaatttgaagaagaagaaggacgtcgcccaagactgatggttgccaaaatgggccaggatggacacgacagaggtgcaaaagtagtagcaacagcatttgcggatatgggatttgacgtagatgtcgctccgctattccagacaccggaagaagtcgctaaacaggccgtggaaaacgatattcacattttgggagtttcttcattggccgcaggacacaaaacattagttccgcaagttgtggaagaattggctaaactgggagcggatgatatcacgatcgttgtaggaggagtaatccctcagcaggattatgaattcctgtatgccaacggtgcagattttattttcggacccggaaccaaccttccgaaatgtgctgtggaaatcttggaaaaatttctaaattaattcttagtaaagaataacttgcatggcttttgtatagtttaatgaaaaaatttcattatggcttatacagtagtttcagtatttccggtgactgtagatacagaggaaattaaaaaaggattaaaacaaaaaggctttgacgaagcgaacatcattatttcaaagtcaagagtagaaagtggaatgtctgctgatcagtatcaggaagataaacagacgcaggatttttttgactatgttttcgctcacgatgcggaaatgttggacgcttaccgcaaacacagcgtaggcagaagcaatgttattgtttataccgatgatcttgaacgggcaaaaactgccaaagaagtattaaatgaatatggagctcttgaagtttatcgcagaccttcagaaaaaagagacagcattccggacggtatgactgagcatgaatataatggaatcattgccaaagcaagacataatatctacttcctcggatcagaaagagtatatcattccaatcaggtaaaaggaatggatgacgaaatggatagtttaggctcaaaagattaatttttacaataaattataaggttgattattttttaatcagccttttttactgaaaaaaaatttgattatcagaaaaatttatatatttgcacctgaaaatcaagtttaaccaataaaaaacaacgaagcaatgttcagaactaagcagaattctacagttggattgccacttatggtggtaaggcttcgcggtttggtacattcttagaataacagtacaatgaaatatcaaaacccgaagtcgtagagatttcgggtttttaattgcgcaatatttcaaacttcacgtttccccgaaatcttttttagtgtcattaaggacaaaataggaggaggtacattcctcagaactattaagtctattattaatccattcaactaatattttagttgattaaaagttgtgtgagataaaaataattaagtttctataatctcacatcatacttctgtcaacaatggaaaatgataaccttctgtatttccgcctgagaagcgtgagaagcagaaaaagaacaattagaaaagatgtagaaaagcagataagaaaaaaatatcgacgtagtaatgaactttgggaaatcagacgaaatatcccatggattcctttgggtaagccttatcaaagaggatttgtaagattctttgtggtaagggaagatgtcatgagatctaaagacggagatttctttgaaggaatattgaagaaaattaatacctacatgtattcggaaagccgccggtttttgaaaaagaaaagaaaatttgggcggagaatatatgtagaaagagtacagaaactccagcatatttcttcatattcctggaatgaccccaagctaggacttacagcaagagaaagacagtattttttgagacaggaagaatattgtccggcccggaagtcttatgttccttattacgaatttattgaaccctggagatttatcctgcgtataagacctaatatgatcacccattataaacctgtagattttgaattggaaaaagaatgcgcagaactagacgattatttatggcagcataaaattgtaggaattatcaacaaaaaaatgtatggtaagtcatcttcatggaaaagaaaaagagaagatatttcacttatcgaaagcaggaaatatgttacctgcacaatgtctgcaacagagattgcagaaagcttacaggacgtataagtccgactgttatttaaaacaaaaaacaatgggaaatttaaaactaaaaggaaaagatatattaaaactgggctatccaaataaccaaagcgtaaacgtagcattggaagtcatgagaagaaattttgcaaccaaaaatattcaccatgtaaaatctcttttaaaggaaatcctgctgaatccggagagctttgaaaaagatctcaccttcgggcaaattgcagaaaccctgctttcgtcaaaaaaaacagaaaagagaatgctgaattcacagcgtgccccgtttcagatttttggaaacaacatttcggaagaggcaaaaaaccagctatacacagctttaaaactgcctgtttctactcagggagcattaatgccggatgcccacagcggatatggtcttccgataggaggggttctggcggtggaaaatgcagtaatcccttacggagtaggaatggacattggctgcagaatgagcctcagtattttggatacaccggtatcatatcttgaaggagcaagggataaatatgaaaaagctcttgctgaacatacaaaattcgggatgtatgaaacgcataaatctcacatagatcatgagattttcgagagggatacatttgatatgattccgatcctaagaagattaaaaggaaaagcggtcaaacagatgggatcctcgggcggcggaaatcactttgtagaattcggggaagtggaaatcactgaagaagacgaacaaattggtctcccaaaaggaaaatatctgggaatactttctcacagtggctcaagaggattgggagcagagattgcccaatattactcaagaatggctgtagaacagtgcccgttgccaaaagaagctcaaaatttcgcctggcttgatctgagtacccatctgggattggaatactggacagccatgaatcttgccggagattatgcttcagcctgtcatgatgatattcacagaaggctcgttaaagctgttggtggaagagtaaaagccagaattgagaaccatcacaattttgcatggaaagaaatccataatggaaaagaagtgattgttcaccgcaaaggagcaacacctgccaatgaagatgaattgggaatgattccgggatccatgacagcgaaaggatttattgtccgtggaaaaggaaatccggaatccctcaattctgcatcacatggagctggaagagcacattcaagaggagagtgcagaagtcttttcacccagcatgacatcaaaaaggaactgaagctgaaaaatgtcaccctgatgggcggaaatgcagaggaagcaccaatggcctacaaagacatcaatgaagtgatgaatgcacaaagcgaactggtagatgtcctgggaaccttccagccgcgaattgtgagaatggacaggtagccaacctgatattttacaaccttacaggtttcgaaaacctgtaaggtttaataaataaaatatttaaaaacaaaaaaatgggagcaccacataacataaaaagatacggtgaagtctggccggaattcagaatccggtttggacttgaaattttagataaattaaaagataaagtcattatatcaggtggctgggcatggcattttatgtctgaaacaggacatacagaatataagcatgctcatgaccataaggatattgatgtttttgtaaaaaaagaaaatgtagcagatgttgttatcatccttcaggaagaaggctttcagaaagtctggacccggtatgatcatctgcccagtgaagagaacttccgcaggtatgaaaaaacggtagagcttgaaaatgataaattccacagaatcaccatagatttttttgaaagaaatgatcttgaaaccataaacgctaatggttttaccattgtgaaacctgatattttactttcattttacagaaatattcactccagtgacaagtgctgggcagtgatggctgcaaaagatttattacaaaagggaataaatcctgttggacaccccttattaagcaaaatgcctatataaaaatggaaaaaattatacagatcacttcaggaagaggtcctttggaatgccagtgggtagccgccaaagttctgaagacctttcttgaagaggccaaacaaaatacaatagaatacgaaatcattcatcgtgaaaacggtgatgaaaacctgacattaaaatctgtgactatccttttgaaaggaagagaaataaatcttttcttaaaaaactggttgggaactgtatgctggacaggaaaaagtacattcagaaaactgcataaaagaagcaattggtttatcggggtctttgaactggaaaatgtaaaaatgattgatttcaatgaaagagatatcaggtttcagacagcgcgaagccagggtagtggagggcaaaatgtaaacaaggtgaataccgctgtgcgggctacccacattcccactaatgaaacggtctttgtacaggattcccgttcacagctggagaataaaaaacgatccgttatcagacttaaagaaaaggtaatggccgtttatatccaacagctggaaagaaagatgaaagatacatggtcccttcagatgcaggtagaacgtggaaatccggtccgtacattttccgggacggattttaaaaagaattatgaagacaggacattcaaaaaacaaaggaatgccttgaaaaacgaacttaaaaactatagaaatgaccttaactaaaagtaaatattattttgaagcattagactactttccattcaacctttctgaatgtattgatgcgctgaactatgcgttatcttatgaaccagaagatgcagacagcctctgtctgatgggaagagtatattccgaagaattaaaagattatgaaacggcaaagaaatatttcgatgaagcgatgcagaataatattggaaatgtcaatactcccaagtattatattgaatgtctcctgaataatgaagattatgaagaagccggaaaattaattgaatttgccctgaaactaaaaggaattgacaaatcagaaattctgaattgccgatcccttatgcaggaaagaaactttgagtataaacaggctttagttactcttaaagaagccaaaaaatttgcttatagcagagcagcgctggatgtacttgaagaaagagaaaaattaatcaaaggaaaagtaacacggtcaagaacagtaaagaaagcagagtaatctgccggacttcatactaaaaaaataagctttctattgaaagcttattttttatttacagaaatcagataatcgtacaccatttgatgttggtcatccgtcagcttggcttttggagccattctgcttaacgtattgatccatcctttgtcatcatgcttcgtaggttccggcagtttatgacattttgcacaggaattttcgaagatcgtttttccttgcgccaattgctcagatgaggtatactttggccctgttacagccacactttttggtccgcatgataccagaaatgctgatgttgcgaaaccggctaagatgatttttttcatactatttttgtttgttgattacttcttcacagaaacaatatagtcataaacccattgatgctgttcatccgtcagtttagcttttggcgccatcgaattcatgattcctacccattgtacagggttatgtgaagcaggatccggtaatttatggcatcttccgcaggaattttcaaaaatggttttcccctgagcaatctgttctgcagtagacgttgcagcgcctgtagtagcagtggatgtagcagctttcggcgtacaggaaaccagcagaatagcagttaacgaagccacagcaataagttttttcatgtttcttttttgatatataacaaatgtaataaattccttaagccgttgatacagggtgttgtagttttaatttagaagaaataaaaattgaactgatgaagaatcgtcagtgtcagatcaggcaattgatgccttttgtcctgtcattatgaggcagctattgatcattcccattttaattattaattttgaaacaatgaaattttctacagaagagctaatagacggaatacagtcaggaaacaaacgcctgattgcaaaagctattacattggttgaaagtaaaaaagcagaacacagagtacaggcagaggagcttctgaagaagattatgccccttaccggaaactctgtgagggtaggagtcaccggagttccgggagctggaaaatccacttttatagaaaatttcggaaggttggctattgcccagggaaaaaaagtagctgttttggctattgatcccagctcggcaatcaacaaaggaagtattctaggggataagaccagaatggaagagcttgccaaagaagaaaatgcctttatacgtccttccccaagttcaggctttttgggcggagtagccaatactacttttgaaaccatgatgatctgtgaggccgcagggtatgattatattttaatagaaaccgttggagtaggacaatcagaagtactggttgccgatattaccgatgttttcttattccttaaaatcattggaggaggagacgagcttcagggcataaagcgtggcatcatggaaatggtagacgttattttcatcaataaggtagaccgggacaatcttcagaaagcaaaaaatacaagacttgaattaaaaagagctttagactttattcctccaaaagaaaaaggatggaaaatccctgttttattaggctcagcccttcacaatgaggggttgcaggaagtttatgataaaatttatgagtttattgatctgaaaaagaagagcggccgttttgatgaaatccgtgttcagcaggctgaaaaacgcttcgagtattgggtgcaggaatatattttgtcactcatgaaaaagagcaatgctgtagaagaagcttaccatatgcacaaaaaaaatgcttcagcgatggtttccaatccaagtaccgaagcaaaattatttgttgaaaaatttttatctaatgaaaacagagactaaggtttgtccttttcctgtttaacctcagttttagagatataaccatcataagaaataggctgcctgtcattacttctcatagaaacaaaagctttaccgtttttaaagatctcaatattgatttcatcaacagttcttacatcttttggcttgaactttaaagtccattttccctttttattctgagttttagttactgtaaaatcttttgaagtaaatcggtagctgttatcacttgtatttccataagttgggttgaacagtcttccgaaataaggcagaactacatcaagcgtatttttactgacatcaatggtataatccccattcagattaagcattctcgttgcagtagcattaggcattgaattcatgacattaataacatcataattcgtaggattggctctttgtgcatagaaggtaaactcctgtgaatcaaccaaagcactcaccattttcggatctgaagccccctgtgacgcgcagctctgaaagagaaacaggaatccaaaaatcatcagtaaagaaatatactttttcataatgagataattattaaatttaaacagcaaaatgtatgcaaatatattctttccggaatattttggaataaaaattgttaaggttgaattattaacactcaaactatgaaagttacacatctatttggaataggagctattgctctgtcggctgttgcctgtactacaaacccgattacaggaaggtcttctttacagctggccaacaattcggaaattttaacaatgtcttcacaggaatacagaacgacattgtctaaaggtaaagtaattaccggtacggcagatgcaaagagagtggtaaatgtaggaaacagaattaaaaatgcagcagaaagatattatcagagtattggaagatcagcagatcttgccaactacagctgggaatttaatctgttgcagagcaacgagctgaacgcctggtgtatgcctggcggtaaagtagcggtttataccggaatattaccgataacaaaagacgataacggccttgcagtagtaatgggacatgaggtctcccatgcactggcaggtcacggaaacgaaagaatttctcaggcaatggtagctcagtacggaggtgctatcctgggaggaactatctccaatgcacaatgggccagcgttttccagaaggtatatcctatcgggtcacaggtggctttgctgaaatatggaagaggacaggaatctgaggcagatgaaatgggactttacctgatgtctatggccggatatgatccgagagcagccattcctttctggaacagaatggaagccgcttcttcaggagcaagacagcctgaattcttatctacccacccaagtccggaaacaagaatttcagatatcaataaagatcttccgaaagctttggaatactataaggctgcgggaggaaaattataattagaattttaatcttgagtaaggccttattaaatttttagtaaatttggtaaggcttttttatataaccactaaacacaatattatgaagagtttatcaattaccggacttatacttctggctgtttctgcattacttttctatttaacaactgattttgccgtagagcagataaaaatttctcacattatgggaatgatggctggtgtcggcattgggcttatcatcggaggaatggttggatatgtaagtaaaggaagcgctatcagagcggaacagaagaaaaaagaattcaagcaactgcagaaagacaaagaagagcttgaaaaaaaggctgcagaaattgcaaagcgtcaggctgaacttgaagaacaaaataaaaaccctcaaatataaaatctgagggtttaaagttgttattttcgatatcaaattaaaatttatatcctaaacctaccataaacaggttaggtctgttatcatatctgatttccgaaccggaaaccttgttgataaaatttctctgatctttactgaaagcgccttcatatttagcatttacaataagctttttgatttcaagctgagcaccaaactggtaccctactgtaaagtcatttttggcattttctttaaaatcgttgtaagtattgtctttatttaagttaaaacttcccacaggacctacaaaaacacccagcatatttcccagaaggttatatcctaaaagaaccggcacatcaatacggttgctttttacatcaaatgtagtattttctgtagtaaactcatttttaaaatgtgtatagtagatttccggcatcacaaacagggatgtaggaaggcccacttttaatgaaagtcccacattgaaccctacattgtttttaccagtcccctggatagcatcattcactgttcctttgatgttagaccaggaaggagagcctgttggaaaaattaagttagctttacccgccagtgaaatctgtgcagaagcccacattgaaaaccctaataacgctatactaagtacctttttcattatcgtctatttttgtatttgtcgtttcaatcgttttgttattctcaagtaaatattctctcagctccttaaacagttctgaagaataaacgaagtcaatcaggtttttattgcctgcagtaatcagaatgtctttgttaccttcccattctttaattcccagtcttaggtatacaattttctcgccaattgtcattacagagttcatatcgtgggtgttgacgatggttgtggtattgtattcttttgtgatttcatacagaagatcatctattaccttcgaggtataaggatcaagtccggaattgggctcatcacaaaacagatatttgggattattcacaatggctcttgcaatggctacccttttctgcattcctcctgaaatttcagaagggtattttttttctgctttatcaagatgtactcttcctattacttcaaaaacccttttctttttctcccggtaggtaagattggtgaacatgtcaagagggaacatgatattttcttccacagttaaagagtcaaataatgcacttccctggaatacagtcccgatttctgagcggagatgctgcttttcatcccttgtcatagtattgatatcttttccgtcaaacaggatttcccctgatgaaggcatatatacattcaataaacttttaagaaaaacagtttttcctgagccactctgtccgatgatcaggtttacctttcctttatcaaatgaagttgaaattcccttaagtacttcaacatctccaaaacttttcttaagatcttttacctcaatcatcagcttaatattaattgggttaaaattaattcggaaatgataatgaataccattgtccacactaccgcctgtgtactggctctacctacttccagcgatcctcctttcacattgtatccgaaataagaaggtacagtagcaatgatgaaggcaaaaacagtcgttttgataaatgcataatagatgaacagattgggcatatacatttgaattcccacaatatagtcgttctctgtccagttaccggtcagaattcctgcaatatatcctccgcctataccaaatacaatactgatggcaataagaagagggttaaagagaacacaggcaacaattttagggaaaatcagaaaatttggtgagttgacccccatgatgtccagggcatcaatctgttcggaaaccctcattgttccaatactggatgcaatataggaacctactttacctgccagaatgagactgataatggttggcgaaaactccagaaccaatactgcttttgtagcatatcctacaaatgaagtaggaataggaaatgatgaagcatcaaagttattgaacatttgaatggctactacagcccccacaaatattgatgtgaagactacaagcccgaaagaatttactcccaaatcattaatttctctcatgaacagcttccagaaaaccctcattttctgaggtttctgcagggattttcctaagaggataatgtactcccctaccgctgtgaaaaacttttttaacatactgctaaattagacttttttatttaattgggctagagtcagggataagactagagcctggttttgtgttaaaatttattctaccgtaacctggtctgttttcttattttgcatttttatctcctccgatgaccaaaaaagtagtttttaaaataatgaccagatcaagtacaaaactccagtttcttacataaaaagcatcggccagaactcttttcttcatctctacttccacatctccgaggtcaccacgcagtccgtttacctgtgccagtcctgtaatgcccggactaaccatacttcttaagctgtatcttccgatttttggtttataataattgtcaaccgacaacatgtgcgggcggggacctaccacagacatttctcctttcagaacattaataaactgaggaagttcatcaaggctggtttttcttaaaaatttccccactctggtgatcctggagtcattcaatgatgtggttttggtggtagattcatcattgacaaccattgttctgaatttgatacaattaaaaacttcttcgtgaaagccatatcttttctgaagaaaaaaaacaggtcctttggaagtagttttgattaaaatggcaataatagggaagagccatgaacagataaaaaccaaaataataacagaaaagacaatgtcaaacgttcttttcatcagataattagaataataatccagcggataccgggcctggttaagtaccggctgagtctgtatatatccaagatcataaaggaagaaatcactttgtgtaatacttggtatgagtgaaatatgaatcttgttatcttctgccagtttaaaaatttcgttttccatgttttcatcatacgagttttccattgataaaaacaaggtatgaatcccgttctttttccagaaagcgattaattcattgaggttaagctcagtatgtccgtattcaaatattctgtatccataatctttacgctcagtaaaaatattcttgagaatttctgtggaatggctgtcccccaaaaacatgacattcctgtaattggctccaagggatcgtatatacttgatggcgaaatagatcaaggatttcaccaaaaagatgaaaataaaaaggtaaagtgaaagccagtaaatatccgaattgaaaaatacatttttactaacctttcctataagcagaacaccaagtataaaaaaaaggaaatgaattaaaagacgttcaagaaacaaggtataggtaaggttcctcggaatattgtatatttttgttctgccgctcagaagcacccagaataaaaacaacagaatcagagaaaaaatattctgataccaggtttctctatggtattttaaattttcgtttctggttataaaaaagaatatgaagatagatgcaataaccatgaggtcaagcaacataatgatcgatttcaggtatctagagtatcgaattctctgcatctatcggtattatagcgaataacaccagctaatttacacttttttacgggatattcagatatttgtgagtctgaacagaagcctgccattcggggtgttccaggatgaaatctgtgatcttcggatacatgtcatttctcttgctccattcgctctgaagataaagcttacagttttcagaaacttttgccgcctgctcctgagcaaacgtaaaatcatgctgattgaaaataattactttaagctcattggccttttgataaatttcttctttcggaagacctgttttcttcggtgaaagagtaatccaatccagatgtccgctcataggataggctcctgaagtctcaatatggatcgtacatcccaattctttcagtttggatgtcaggatgtccagattccacattaaaggctcaccgccggtcaacacgattgttttacagtgtctggcagccgtttctgcaatttcttctgcattcataagagggtgaagctcagggtcccagctttctttcacatcacaccagtgacatcctacatcacaacctcccagcctgataaaataggctgcttttccggtatgtgccccttctccctgtaaagtgtaaaaatgctccatcacagggagcattttaccttcttttaataaaatatcttcttctttattcattttaaaattagtcgttatagaccgaagttttgtaagcaatgatggtatttttcatcaacattgctctcgtcattgggcctacacctccaggtaccggagtgatccagcttgcttttgctgcacagctgtcaaaatccacatcacctgcaaggtaatatccttttggagagtcgttgtctactcttgtaatacccacatcaataattacggctccttccttgatcatgtctccttttaagaagtgaggatctcctaaagcggtaattacgatgtctgctttcttcgtatattcttcgatgtcttttgtatatgagtgtgtaagggtaacggtagagtttccagggaaatcctttcttcccataagaatactcatcggtcttcctacaattttacttcttccgataattacacagtcttttccttttgtttcaatattatatctttccaataatgttaaaatcccgaaaggcgttgccggtaagaaagtatccatctcaagggccattttcccgaaattttcagggtggaaaccatccacatcttttctcggatcaattgcattgatgatcttctcctggtcaatctgatccggtaaaggcagctgaacgataaatccgtctactgctttagacttgttaagctcgtcaatcttttccaatagttcagattcagaaactgtgcttggaaatttgattaagctggattgaaatcctacttcttcacagtctttcactttggagtttacataagccttgcttgctccgttatttcctacaagaatagccaccagatgcggtgctcttcttttgctttccagaatcttttctacttcaaccttgatctccgctttaatttccttggatactttaagtccgtcaagaatttctgccatttttacttttttactttatagatttacttttactttcttttttacttactatttgtttttcttatagtaattgatcaatccgttggtagaactgtcgtgagagcttattgtttcattattctcaagctcaggaaggattttattggctaatacttttcctaattccactccaaactggtcaaagctgaaaatattccagattacaccctgaacaaaaattttatgctcatataaagcaatcagttgtcctagtgaaaaaggagttaattctttgaataatatagagttagttggcgtatttccgtggaagactttaaaattgataagtctgtctatttcctcatcagatttacctgcatttctaagttcttcctccacttcttcttccagttttccgaaggcaagtgcttcagtctgagcgaaaaagttggccaataatttatcctgatgatcagaaacatgattcgggcttttagcataagcaataaaatctgccggaatcaattctgttccctggtgaatcaattgatagaatgcgtgctgtccgtttgttcccggctctccccaaatgataggtcccgtttcatattctacgaattcaccgtttctgtcaacacattttccgttactttccatatctccctgctgaaaatacgctgcaaatctgtcaagatattgggaataaggaagaattgcgtaagtagttgctgcatagaaattacgataccagattcctaaaagacccattaatacaggaatattttcagagaattctgctgtctggaagtgctggtcagtatcataagcacccctcaaaagctgttcaaagttttcgtatcctacagaaagaacaatacttaatccgatagcgctccaaagagaatatcttccgccaacccaatcccagaattcaaaaatattttcttctgcgattccgaatttcttaacttcttcaatattggtagataaagcaacaaaatgcttcgccacatcttcctgttttcccgacttcaggaaccagtctttcgctgaatgcgcattcgtcatcgtttcctgggttgtaaaggtcttggaagcaatgatgaataaagtggtctccggattcagatttttcaccacttctgcaatatgatttccgtccacgttggaaacaaagtgagcgtttagtcttgttttaaaatgctttaacgctgaacaaaccatcacaggacccaaatctgaccctccgataccgatattgactacatctgtgatctctttgccgctgaaacctttatgctctcctgaaataattttttcagaaaaagatttcatatgctcaagcactcttttgatctgtggtttgatgttttctccatccacaaggatttcacggtcagaaaaatctctcaatgctgtgtgcaacaccgctcttccttctgtttcattgatcttatctccggagaacattttggaaatggcatctttcagctggcattcttctgccagttgtaataaaagatcttttgttcttgagtcaattaaatttttggaataatcaaaaaggtagttgtccttttgcagggaaaactcattaaaacggttcgggttatactggaaaagagttctaaggtcaaagtcatttccaccgaagtgctcgtcaagtgctttccagctgttggtttgtgttggatttatttttgatagcatattacagaatttttatcattcagaagatcatgtattggatgaaaattgctaataatccataatgatttatttctgatttgcaaatttacggaaaaataaaacctcagataaatttgaagatgataaataacaattttttaaaaaaacaaaaccccggagatactctgaggtcttatgacaagtcttttatgatgggcgccgggcattattcatccatttcattcagaatattttccaactgtttagcgcttcttccatagatgtattttgtccacagaacaatgcttataatgattgccaaagttccgatcagcactaagatgatcaacccctgctgatgagaagaagtaagctctgccaatgattttccctgtttttccatcgcattataaataatcaggcctgccgttaccagaaaatgagggagcagtaaaaatccgaatgactggtatcgttccatattcaggcgcacctcatgatatattttccagaggctgtttttcgtgtttcctgtataaagctctgtctctctgtaaaatttataaaatccagacagatagtaagacgatatgacaaccattaccgtataggaaacataataaataatgtactgtgaagacggaaactgaaattgaagaggaaacaagccaatgataatgatggcaagaatctgcatgggaaattctcttttcatatttttctgaatcttttctatcgggtgtttactttcctttaattgctttatgctgtcaggaatatggacatcgctgttttctttattccactgttcttttaattcatcaaaattcatagcctgatttttttatgatttgctgtattttttcttttgttctgctaagtttcacgcgggcattgccttcactgagtcccagattgtttccgatttctttatgtgacattccttccatgaaataaaatatgacggctttttccagaggattaagttcctgaacagcgctgtagaaaatttccagctgcctgtctttggcagggttgtaatcttcctgttgtacttcaaagtgatgaggaacttccgtatggctaccggatctctgtttttccttttttaaataagtaatagcggtgttgatggccacccggtacatccaggttgaaaactcactgttccctttgaagttctgataggatttccaaagctggataaggatttcctgctgaaggtcttcccggtcttctacagaatcagcatagatccgtgaggctttgtatacaatgcctttgtgccggttaacaagttttaaaaaagtagtttcagttgggttactcacaatggattcatggttgggttactgttataagtctgatatagggtttacagtgtaatttttggactaatgctgaggcctccaaattattacatttttcatagtattaatttttttgattttctgttcttttaaaaagttggtaaaacaaatgagttaatcgttacagttttttttcaaaaaaataaaaacctccccgaaagggaggctgtaaaatctaaaattatgatgataaccaattggttaggagtgttttgttattcctatattttttaatgttccggttttgaaacttttctttttcttaaaaaatagataatagcagctgcaattaataagatcggccagatgttgataagagcaactatgattctctgaatcagatagaatccgtatacaaaaccatctttagcgtcatagataaaattgtatctgtatttattgtcaatgcttgtagtattggtaacggcaatttcagcaatacgcaactggggttctttgatgtagatatcaatagtgctgtatttcagattgtctgccatattcatacttgccagcttttgggcattcccttcagacatattcccgtcatccatattcactttatctttatttgttttcagcttgctgatattttcagaggtcttttgatttcttttcccttccagttcagaatatttgatgttggcagttacatcttccgcattaatggatcttgaattaaggaataatttgttggcattgatggctgttaaaagctctcccagtttttctgtgggaatacggacctgcattgtattttccgtttggtatttttttaccagcatagcttcatcgtcggaagtattgtaagtattttcagaaaccacattactctgaagattgcttttagtaacaaaaccaccaagttcctgtacggatttttcaatagcaattgttgcattatacacatcttttacttccatattcacatccgcagttttgataaactgtttgtcttttattttcatactggctgcagatgatatactgtctgaaacaacagtgacagctgaatcagcagtggcataagcttcaagatcggaggtggtggcttctctttttttacatgaataaattcctaataaaagaacggctgacagagataatttaatgtaagtggttttcatagcgttgattttaaatgtttgcttgaaccaaagttcagtcaggatcttttgtaacgcttgaaaatcaaaagtaaaaaggttgtaaataatattttcagttttaatgaattgaaatttagtgttttgtaaaatagacttaggcttcagtcattgctttcggagcagtttttgcttatcttttacaaaccaaaactacaatctatcactatgtcaaatactttttctaaaatcagaaacgcaataggattattcacatccatagattttgatcagctgagtgccatttctcagaaagtggatctgccaaaactgatgcataatttttcaaaactggacgataaacagctttccgggttgatgaaaatgcttgatccggataagaaaaagaaagagcttcctcctattgacggggatttttatgatatctaccatacacttagtcccgaacagcgtgaaattcagctgaaagtaagagcattcatggaaaaagaagtcaaacctcttgtcaatcattactggctcagagatgaatttccttttgaactgatcccgaagttccagaaacttgatatctgtggagttacatatcaggggtatggctgcccgggaatgcctttcctgatggaaggtgtcatcgcaatggaaatggccagaattgatgcttcaattgctactttttttggagtacagtcaggtttggcaatgggttctatctatatctgcgggtcagaagaacagaagcaaaaatggcttccgcagatgcagaaatttgaaaaaattggagctttcgggcttacagagccggaagtaggttctggagcggcaggcggacttacggtaacctgcagaaaaacacctgaaggctgggtgcttaacggtcagaaaaaatggattggtaacgccacttttgctgatttggttattatctgggcaagagacctggatagcggagaagtaaaaggatttattgtagaaaaagataatcccggatactctgtggaaaaaatcaaagggaaaatggctttaaggattgtccagaacggattgatcaccttaaaagactgtttggtcactgaagaaaaccgtctgcagaatgccaattccttcaaagatacggggaaagtactgagaatgacgagagccggagtggcatggatggccacgggctgtgcaagaggagcttatgaaagtgcactggattataccaggaaaagagaacagtttggaagacctatcgcctcgtttcagatgattcaggggcatctggtagaaatgctgtctaatcttactgccatgcagaccatggtgttcagattatctgaaatgcaggacgaaggaattttaaaagatgaacatgcatcactggcaaaagtcttctgtacactgagaacaagagatattgtttccagagccagagaagtgatgggcggaaacggaattctgcttgaatatgatgtcgcgagatttgttgctgatgcagaagctatttattcctatgaaggaacaaaagaaatcaattcgctcatcgttggacgatcgattacaggtttcagtgcttttgtataggcaataggtagcagataacagataataggttgtaggcaatgcaacctgtaacctattacctgaaatctattatctgttacttacgaaactaagtgtttgtatttttctttattgtcaataatcatccaaaggttgatcaggaacatcactccggcaatacccattcccatcggagatttgtccaaagtgaaaacgtgagccacaattcctaccataacaggtagaataacaatggcacccagcgctctggtttttgggaaaataaacagtaatccgccaagtacttctacagtacctaccagtggcatcagccagctgatttctccaaaggcagcgaaaagtttcatttgttcaggagtaggtttctccattggcatataattaaagaacttgtttaatccggcattaataaacataagcccgaaaagtaaacataagataaattttattactttcatgattgatgattttacatcaaatgtataataaaaataggattcgttaattatatttttacaaaaaatatgcaattagtgttaatgtaaggttaacgttgtattttggataattttattgtttatatttgaaatgtattctaaactaataatattatgctgaaaaatcttaagaaattaaaccgtacaaatttgagaggaatccatgggggaattgataaatgtgatataggaccaatagactgtccatgtaaaatcccaccagggcattcttgtcttggaggtggaggaggaggtactcctgagccggataaaggatactgcccggatagccaaacttatatcctgtgtacagaaacttgtccaaatggaatgagccctttatgtgctctttcataatgaaataaaaacgactgccgtgaaaaaggtagtcgttttttatttgaagttattaattattactcattgtttattgcccattacccatattctagtccatttccttaagcgtaatattcttggaaatcttataacttttctttttcttatcaggcttctgttcttcaccgagtaatcttccccaaggtttaagatcatctactctttcacagataattttaataatggcaatggccggaatacaaaggaacattcctgcaattccccaaagatgctctcccagaagaataccgataaatgaaaataaagcattgatttttacttttgagcccactacaaatggcagaacaatatttccatctacagcatgaatagcaatataccccaaagcaacataaatacacgttgaaggagtagaagtggcaaacgctataaagcaggaaattaaaagagaaataaaaattccaagatatggaatgacgttcaataaaccggtcaaaactcctaaaagaatggcatattttactcccagaacagtaaggagagtagatgttagaatggaaacgataatcacctgaaggaacagtccgaagatgtatttcttggtcataatacggatctcattcaccgcttcctgcacgcttgctttatgtctttcattaaaaaccgtaacaatgaaattatttaaaagtcttctgtaatttaaaataaagataaaaaacagcgtgaaaaatataataaatccaaatcctgttgaaaaaattccgaaggtaaatcctaaaattacccctgaagaagataacagtttattcaagccctggttgatataatccacctgctcatccacttttacattgaaagttttggaaacccaatgctgaaggctgttaaaaacagtagtaaactgctcctgaagatgaggaagatctttactgaaatcagatagctggttggtaaagaaatagataataccacccaaaatcatcagcataatgaacacggaggtcattgtagacattgaccttggaaatcttaattttctttccataaaagtggctgccggtaaaaacagcatggccataaggaatgccaggaaaaacggagctaaaatactctggcctaatgccagaagatagccaagtccaatgatggaaaccaccacaagtgtaagcttgacaaggaaaggaagtctaagaaaattcataatctataaatgtgcagtgtggaataaaaataagaaaaaacctgcgtgaataaaaatttttattgaattctaaaggattttcttgtattgaagcaaattgtattccacaggctgggaaaattgtactttttacgttcaaacagaaacacgctctgatattcagaacgtgtttcattattgagaagttgatatgttataagttgttttattcttcgatagcgatgtctatgacttcctccattctgttgacgtaatgcactctcagatttttcagataatcctttttgatttcttctacatcttttctgttggcttcacaaagaataacatctttgattcctgctcttgttgctgcaagaagtttttctttgattccgcctacaggaagtacttttcctctcagtgtaatttctcctgtcatggccaggtgaggttttaccttcttatttttaaatgaagaaaccattgaagtcagcatggcaatacctgcagatggcccgtccttaggcgttgcaccttcaggaacgtgtacgtgaatatttttcttatccaggtcttcctgtggaattcccagttcgtcatgcttcgctttaatatattcgagcgcaatagtagctgattctttcattaccgttcccagatttcctgtcattgttaatgctcctttaccattgcttaggatactttcaatataaaggatgtctcctcctacacttgtccacgcaagaccagttacaacaccgggaactccggtgatttcagataagcttttcggtcttggtaccccaagaatttcgtctactttttcaactgaaatttttggatcatattcttttagcagagcggtctgtagtgctacccatcttgcaaccgcagcaattctcttctcgagcgttcttacaccgctttccgaagtatgagcctctataatatgtttaagctctgcatttccgagtttaaatgattttgcatccagaccattttcatcctgttgttttttgatcaaatgtcttttggcaatctcaattttttcctccagcgtataaccggcaatctgaatgatctccgttctgtccagaagaggagtctgtattgttgaaagtgagttggctgtagcaatgaacattacttttgacaaatcataacccatttcgaggaagttgtcgtagaaggatttattctgttcaggatcaagaacttccagtagtgctgagctagggtctccatgaagtccctgtccgatcttatcaatctcatcaagaacaataaccggatttgaagtaccggattttttgatagactgtaaaattctgcccgccatagctccgatataggtctttctgtgtccgcggatttcgctctcatcgtgcagaccgcctaaggataatcttacatattttcttcctaaagcgtctgcaatagatttccctaaagaagtcttaccaacacccggaggacctaccaataacagaataggagacttcatattgtttttcaattttaaaacagccatgtgctccaggattcttttcttaatgtcttccagtccgaaatgcgctttatcaagcactttttcagcttttgcgatgtcaaaaatatcttttgtataggtttcccacggaagatctgtaaagaaatccagataatttctctgtacgttatagtccggtgaattaggattctgacgctgaagtctgctgatttctttctgaaaatgttcttctacttccttgctccattttttggttttagcttttgcaataagatcttcaacatcactttcaggtcctccacccagttcttcctgaatggttctgatctgctgattcagaaaatattctctttgctgcttatccaggtcttttgaagttttctggtgaatctggtttctcagttccagctttctgaaatcttcatgcatcatttcatagcactggttagccctcgtcatcagacttttctcttcaagaagtttttgcttcgctactgaagagaaattagcattggtacagatgaaattcagaagatcatcattattgttaatatttttgatcgcgaagttagctgcattaggaatattaggatccagctcaatgatttttaaagcaaggtccttgatgttctccagcaatgcttcatactcttcctgatctttaggacgggtatcctttaattttgatatttctgctttgaaataaggctggttgtcaacaattttcttgatcttaaaccggtgaaaacccttggtgatagcagtaatattaccttccggaagcttaataatcttaatgatttttgctaatgtcccgacggtataaatatctttttcggaaggctgctccaggtccgaatttttctggcttacaattccaatgaaatctccgttcttctgtgcttcctcaagaagctgtattgatgtctttcttcctgcggtaataggaattaccacgttggggaacattaccatatttcttacaggaaggatagggaatattttttgttcggaatttttatcagtctctgcgaaatctgaaagattgatttcttcagtcacgatatcaaatccgtcactaatcatttcttctaaactaatatcttcaaattctgtcatagtcaatcgaatgacaaattgtcattttcgtttttatcgttaaagggaatttttacaatatacactgaaaacgtgtggcatattataatattctaaaaatgcacaatacttatgccatttgttttttacttaaaaatacggtcaaaatttcctttttcagataatctttgcattaaaaatcaaaataaagcagttctgtttctgtaatttcttaaaaatgtgtattttcgcaaactgataaaaaactataatttataaaatggcaattttaggacagattaggagtaagccttggcttttaatgggagtaatagccttagcgcttttagcgtttttggtgaacccggatagtatcgacaaggtttttggtaagaatcctgatgttttaggaaaagtaaatggtgagaaaatcacccgcgaagagttcaatgatcagcttttcgtgttgcagcagcaggctgaacagcaaggtcgtccaaaaaacggtcttgaagagcaggcatggcagttacttgtacaatctaaacttatcaaacaacagtttgagaagctgggctttgaaatgactgatgattatttctggaaccaaatccagtatgatcagatgtttgctcagaatcagcagttctttgatgagaaaggtaactttaaaactcaagagcttaaaaaagaaattgaaacattacaaaacaccaaccctcagggatatgctcaatggctgaaaaccagaaaaacaattgagtacagactgatggcaagacaggtgtttactaatctttcagcaggtatcactacaggtaagaaagaagctgaggaactgatgaagcagagagatcagcttgcagatatcgactttgtgaaagtggattatgcagcatatcttcaaaaaacaaagatcaatgtgactacacaagatcttgctgattacatcaaacagcatcctgtaatgttcaaagctgagccaagcagaaatataggtattgtatttttcccttccaagcctagtgcagcagatgatgcagcagccttgaaagaaattacaaaattgtattcaggaggtacagatgcaagcggaggtactgaaaacttccagaatactaaaaatgactcaatgtttgtaactgcaaactctgatgcgccattcaatcctcagtatctgaacccagctcaattgcctccaacgatcaaagatcagattacttcagcagcagtaggtcagacttttggtccttataaagaacaagatgtttatgtagtctctaaactggtaggtaaaagaccttcagattctacattatcaagacatatccttattgcattcaaaggaagccctgcaggggaaggggtaacaagaaccaaagaacaggctaagaaattggccgactccatcggtgctattgtaaaagctactcctgctaaatttacagaattccttaagctttccagcgatccgaattctgcagctcaggggggtagccttggatggacaactccggaaacacctttcgttcctgaattccttgcttaccttgccaataatcctaaaggagcaacaggggtagtagaaactcagttcggttatcatatcatcaatattgaggataagaaatcaggatcaatggggtataaagttgccaaccttgtaaaagcaattaaaccttcagatgctactgaggctgaaacagacaaaaaatctagaaaattcattcaacaggttcaggggaaatctttcaacgatttcgtgaatattgccaagaaaaataattaccagttctctaatccaaaagcggctaaaagatttgaaggtcagcttcagggcttaggtactgaaaaagatgcagatatccttacatgggctttcgataagaaaagaacaaaaggagatactgaattatttacagtagacggaacaggtgataaaattgtagtttatctgaacggaaaacaggaggcaggtcttgctgaccctgaatctgtaagagatcagattgaagttatcgttaaaaataaactggcagcaaaacaaatttctgaaaaaattgcagcagcaaaagcttcaaatttagatcagattgctaaattatttgcggctccaaaacaatcagctcaggtgaacttgttgaacccttcagtagctggtgctatggaacctaaagttgccggtgcagcattcggtgttgcaaaaggtaaactttctaacccggttgaaggtggaacaggagtttatgttctgatcaaaaaatcagaaacagtgaacaagcagcctggagatcttaagcagtttacagaatctcttacacagagaagtgcaggaatgttcggacaggcttggatgaaaagccttcaggacaatgcagatattgaagattacagaatcgagatctggaacaagctgggaaatcagcaacaataagaaattcatttcaatgatataaaaagcgacaaatttttttgtcgctttttttgtatttaacgcagaataataaaggaaaagatttatttaaaatgtattatatttgcttattagaaaaaaattagcaagtgaagttcagtaaagaattaaaagctggtgtgatcgcacttctagctatcgtaggctttgtggtattgtttcagtttatgaaagggaaaagcctttttactaccgacaatatattttacgcaaaatatgacaatgtagaaggtctggcgcagtctgcggcagtttctatcaatggtcttaaagtagggcaggtagacaagattattcctgtcacctcaaaagatggaaaaattaattttgttgtaaaagttactgtcgacaataaatttgaattttcaaaaaactcatcactggagatctttgagccgggattaatgtccggtaaagaaatgagagtaaaccttatgtatggaggaccgacagcaaaagacggcgatacattgaaaggagctttcaaactgggaacgctgggaagcctttcttctcaggtaggtcctgtaaaagatcagttacaggtggttcttcatagagtagactccctgatggccaatgcaaatcaggttttcgacgctcagaacagagctgaaattaaagctttgttagcgaaccttaacaaaacggttggtgcattacaggctacagcaggaagtgtaaacaatctggtaggacataatgatccaaaactgcaaaaagtgctggatgatgcaagccttaccatgcagagcggaaaagtaacgttagataaatacggacatcttgcagaaagtattgacactaaacagttgaatgctaccattgcaagtttagatgctacagtaggaaaattgaatcaggtaattggaggtattgataaaggagaaggaagtttaggtaaactgatgaaggatgaccagctttacaacaacctgaattcagcttcttccaatctgaacacattaatcgaagatatgaaagcgaatccgaagagatatatcaacttctcggttttcggtaaaaataacaaagactaatacgccttatgcagtacatcgataacattattttcctgattttattagtagccggatttgggctgtttgccaaaagcctgcagaagatctacagaaatatcaggctgggtcgtgaaatcaatagaagtgacagaaaatctgaacgctggagcaccatggccaatgtggctatgggacagagtaagatggtaaaacgtccagttgcaggaattttacacatttttgtctatgttggttttattatcattaatatagaactcattgaaataattgttgatggactgtttggaactcatcgttttctggcctcggttttggggcacggattctacagcttctttacagctacattagaagtcctggcacttctggttgtaataggtgtcgttatatttttcatcagaagaaacttttacggggttaaaagattaacaatgaaggaacttttcggatggccgaaagaagatgccaactggattcttatcattgaatttgccctgatgatggctttctttaaaatgaatgcttcagattttattttacagtcgagaggtgttttaccagtacatggaagcttcccgatcagtgaaatgacatttgttccgtttttggaaatcttcaattttgataacggatttttgatgttcacagagaaagctgcctggtggttccactttgtagggattcttttcttcatgaactatttgtattattcaaagcatttacacattattcttgcgtttccgagtacatggtatgccaatcttgagaaaaaaggaaaattcaacaatcttgactctgtaacaaaggagatcaaattaatgatggatccaaatgcagatccttacgctgcaccggctgaaggtgcagaagctgatgtcccttcaaaatttggagctgaagatgtttttgatctgaatcaggtacaattgcttaatgcttattcatgtacagaatgcggacgttgtacttcggtgtgcccggctaatattaccggtaaaaaactttctccgagactgatcctgatgaaaaccagagaccgattggaagaagtaggaagaaacatcgataaaaacggaaaatttgtagacgacggtaaaaaactgttaaacgattatattaccaaagaagaactttgggcctgtacaacatgtaatgcatgtacagaagcctgtccggtattgcttgatccgctttccattatttttgaaatgagaagattccttgtgatggaacagtccgctgctccacaggaactgaatctgatgatgaccaacgtggaaaacaatgctgctccatggcagtacaatcaggcagaccgtctgaactgggcatcggaaaactaaataattaatcagtttgaaagtttgaaaattgatgcccgttgatatcattttcaaattctcaaattctcacattttcaaattgaaaaagaaatggatttcaatataaaaacaatggcagaatatgctgccgaaggaaaagcaccggaagttttattttgggttggatgtgcgggaagttttgacgaccgtgcaaagaaaattacaaaagccttctgcaagatattaaataaaataggagttgaatttgccgttctgggacaggaagaaagctgtaccggagatcctgcgaaaagagcaggaaacgaattcgttttccagatgatggcgcttaccaatattgaagtattgaatgcttacgaagtaaaaaaaatcgtcacggcttgtccgcattgttttaatactcttaaaaacgaatatccaagcttaggcgggcactttgaagtggttcaccatacacagttcctgaagagtctgatggaagagggaagactgaaaattgaaggaggtgcattcagagggaaaaagattaccttccatgatccatgctacctgggccgtgccaatgatgaatatgaagctccgagaatgcttcttgaaaagctggatgcagagcttgtagaaatgaaacgctgcaaaaccaatggactttgctgtggagcaggaggtgcacagatgtttaaagaacctgagaagggaaataaagacatcaatattgaaagaacagaagaagctttgtcttttgaacctaaagtaattgctacaggatgtcctttctgtaacaccatgatgacagacggggtaaaacactttaataaaaatactgaagttgccgtaaaagatatcgtagaacttcttgctgaagcagaagacttataattgtaatcctatacaggtttatgaaactgaaatggagactctcctttttgtttatcacttcgatacttgcccttcttacattctggaactatcagaacagagtctatgactgggacatgccggggtacatgggatgtatgtatacctccgagtttccgggttcaccggataaagttcggatcattacgtatgaggaaataaaaaaagaggctcctgcagagcattacacagatattatcggaattaagcaatgggatattccaaggcagtacttcgtaaaagatacacaatcctttacagaacagttaccctattttcagattaaagtagggtatattcttgtcataacccttttttataagctcggattttcatctccaatggcagtgctttttaccagccttatttcttattttttttcaggattattattcttttatattctaaagcttctattcccagagaaatactggctggcaattatattaacgattgccgcaatgcttttgccacccatgacttacatgtcaagagtatctactccggatatgtttatctttcagtttatgctgatctttattattggcttgatcaaacaatggaataaatggggaatgtttgtacttttatttgccattacctttatccgcccggattatattacattcacgctcacttatattatcgctgttttctttttccagtattttcagaaaaagaaaattgatgtttcctatattgcgcagggaacagttcttctggcgatgtatctgataattattaaattttaccattacccgggctggaaagatcttttttatgatactttcattgacagaagacctattatttccacgcatccaattgatgttagcttaaaagattatctgagtattatttacattaaaatcatttattttaaaaaagttactttatcggtagctgttatgattggcgtaatcttctggcgtactaaagatacttgggtgagaatgatttcagttctttttctggtcaatgtatatatcaagtttttcttctttccgcagtcggcagccttaagatttttcttcccgtttatctttccacttttcattatgatgctctatgtgctgagcaagaaatacaatgatcttaaactcaggaaaattgcgtaattttgcctttaagataataaggatttaaaatcaatagtaaaagaatatcttactcagtgatgagcatttgaaattgattttaatattctgataaataaatatttacattatgaaaatcgaagaatctaatattgtagaaaccaacgactacagagtcattatatatccggcttcaagaccttttgaaaccaaagaagcaaaagccattactgagaaattatttgatttccttgcaacatgggcggctcatggaaagccactttcttcttcatttaaaattgaaaaaaatcaatttatcatcgtttgcgtagatgaagaaaaagaaatggcttcaggttgcagcattgatgccttgggaaaagtaatgagagaaattgatgaagaatatcagctgggtcttttcgacagaatgaaagcaagttttgtggagaatggtgaagtaaaaactttaaaattaatggatttcaaaacaaaactgagaaacggagaactttcagacgatattcaggtttttgacttctccaagaacacttatctggattttttaagccacttccttcttcctttagagaaaagctgggcagcctctataaaataaaacgctataagttcaatacagcagaatcatcataaagtggaaaatatatttccacttttttgttttaatgtatctttgtgtagattcgagtagaaactaatgcctaaagtactttttttaacaacatcccataattataatgatgaccgtattttctatcatcaggcgaaggctcttagagatgaggggtttgaagtaaaaatatgtagtttatatacgcgttacaacggtattattgatggcattgacatagaatcttacgatgtgctgatagaaagtattgaaaaaaaaatggaaactttcaggaaggtttgccatacgtttcagcctcaatgcatcatttgctccgaacccctcgcagtggtagcagtaaggaaatttgtaaaacagtataaagcggtttgtatttatgatgttacagaatggtatccttccatgtctatgctcagaaagtaccgttttcctgttaaaatttttcaggctgtaaagttttctcttgtgcagttgtatgcaggttttttaggtactcattttatttttggtgaagcaaccaagaaattccctttagcctattttttcggatttaaaaaacagatgattcttccttattacccggatgctatttacatcagagaaagtgttaaacaacttgaaccgggtagaattaccctttgctataccggtcagatttctaaagataaagggattgataacttttttaaggctgtagataaacttcgtcagaaagcttcttcacttcatatcagaatcctgattatagggtccgctgtagaagaaaatgataagctatatttttcctcattgttgaagaaatatactttcgatgatattgagatcagaaaaccaacggattttgaacagtttacagaagaattggctgatgcagacatttgttttgatcttcgggaaatcaactttgaaaacaaccattctttgccgataaagctgttttattttatgggagcgggaaaaccggtaatgtattcaaatctgaaagggatacggaaacatatgggagagctttcttttggaagtctcgtaaatcctcatgatgctgatgggatttcagatattattattaattatatcatgaatcctgagttatatcacgctcatgcgctcaatgctggaaaagaatttaaagaaaaatataattgggagatgataaaagattccttcgttgattttgtgaaaaaatccattgataaataatcaccatgcagctcactatcattaaaacatttgtctcacgctttcttattctgatcctcagtttcggactggtgatctattctacgaatatgtggggaagtgagggtaagggcaccatttccatcgtaattgccaatgcagctgcagtgagtttcttcagtaatattttttcaggaagcagcgcttcttattttgcttcaagatttaaaatagaaaaagtcttactctatgcctatctctggtcggtcctgacaggacttttaattccttttttattcagtctggcttctattcagggtgaatatcttttctatcttatcgggatttcagtgttttcttcacttttatctacgaatatcagtttatttattggcacacaggatattaaaaagttcaatgtgtatactgttctgcagcaacttgtacatattgtatttattggaatattggtttatctgtttggaaagaaagatgtatctgtatattttctcgcccagatcagttgcctggcacttcttttcctgaccagtttttttcagattattaaaaagtgtaagatttccgaaataacattctgtaaagaggtaggcaagaatatgtttgaatatggctggaaaacccagctgagtgcttttgtacagtttctgaattacaggctctcgttttattttttagaacattttgaaggaattgccagcgtagggattttttccataggagttactttttcagaagctatatggaccattacccgtagtatcgctgtgattttatactcagatgtagtcaatagcaaaagcagggaagaatctataggaaagactaaagaatctttaaaactgactttttttctgatgataggttttgtactgggaatcatggtcataccgtctcaggtttacgaatttattttcgggaaagaattcagagataccaaagaaataatgcttcttttatcaccgggaatttttgccattgcggtaagtgatatggtaggacattacttttcaggaatgagagatctgaaaattcttaatgtgaaatcgattgcaggtctggcggttaccgtcgtactgtctttcataatgatacccagatggggaattttgggagcctgtatagcaactacatcatcctattttgtttcagccttgctgttgttcatgaaattttatagttcaactccgtttattttgaaagactatatgatttcaaaagaggaagtacagcttttaaagcaaaaatttttaaagaaataattacttccggcacatctataaaataaagtcattttcctatttttacaaatctattaactctttactatgtgcggaatcagtggctattattcatttcataaaagcatttcctctacaaatattctggaaatgaatcaggccatcaaacaccgcgggccggatgatgaaggattctggatgtatagtaacggagagggagtttctttttcagggaatgattccacacaaaaaattaaagaacagtttccggttttaaaagaggaatattctgatattgctctaggtttccgtagattatcgattattgatctttctgaaaaaggacatcagccaatgctttcagaaaatgaacagattatcattacgtttaatggtgagatttataattttaaaaagttaaggaaagaacttgaaagttccgggtatgttttccaaagtacttctgatactgaagttattctcaaggcatatgaagagtggggaactacagtttttgaaaagctggatggtatgtttgctgtttgtattgtggatcttatctcgcaaaaacttatcctggcaagagacagggtaggaatgaaacctttattttatcatcagagtgaaaaagggctggtttgggcatcggaaataaaagcattgctcaaaaatgagtttgtaaagcctgaaatcaactggaatggagtatataccaatttcctttttcagaccacgttagctccgcaaacctgttttcagcatattttttctctggaaccggcttcttttatgacggttgatttaaagaatcagaacatcaccaaagagaagttctggaatctgcctctaccttctgagaatatttctgaagaagaagctgtaaaaaagatagataagcttctttccgaaagcatatcagaacaattatatgctgatgttcctgtagccgtaatgataagcggaggaatagattctaccttaattacttcgaaatcaaaagctttcaatgctgatatcaacacctataccatatcatatccgttttcagaagaagaagtgaaaaatgcggctttagctgctcaacactttggtgtttcgcatgaggtgaaagaagtgagtgatgaagaagcgcttgaacatcttaaagaaaatattcagcattttgaagaaccctacagcagttttgaagtgttaatcaatgcggcaaaatatgcacacgataaaaattttaaggtcgtactgagcggaaatggcgccgatgagctttttgcaggctattcccatacactaaagctcaacagatggctttttatgagaaattttaattgtataagtgcttttatcttcacgaaagacaagttttcacagcgcttaaaaaactatttttcgcaggataatatgtttgattttttcaggcagagccagatcagtatgaggcctttggaagctaaaagtgtcataaaacaggaaatttataatacaattgatccggatcttacaaaatatcatctttcggaaacaaaaaactattccggttattttgaatatgatatgaaatactcgctttcatcccatcatgttttccgtgatgacctgagtgccatgaaatacagtgttgaatttcgttatccttatctgagcaacagcctgatagattatgtagcggcactgccggagaacatcagatttaatggagctcagaataaacctttattacgtaaaactgcaaaaaaatatcttccggaatcagttttgaatatgcctaaaaaaggattttcatttcctgtcaattatttcattaaaaacgaaaaaaaagtaagagactttatcgttgaaaatcttgaaagcttaaaaaggagaaatttctttaatgctgcagtgattgacgaatggtggaatcaccaggaacatgaatatgactgggtgaaaatatggcagctggttacttttgagctatggtatcagaaatattttgaaaaataaagaaggtgtctaaagattaatattttacctttgtagctatgatgaaatatttttggagtatacttgttgcggtatttgcactgataagttgcaaaagtgatgatgattctttgcagagaatagatcaggtactgaatatctacatgaggaacagtgccggccaggatttgctgaacagtaaaaaagcagggtcttatacaggattttccgtcaatgatatttttggggccaaagataattctccggtaagcattccattgaaaatgactacagattcactgttttatatggaatatcttgcaggtgccaaaagaagacgtctggactctataagtcctgacaatccgggtacaggtaattcatattattcgagaatgcagattacatttacaaaaagtactaatgcaagtgataatgttgtggacactttggaagttcagtatcgcaatacaccaacggtatttcaggtttcaaaagttttgtataacagggttcaggtattttcaaaagatgcagatgctcctacttcgataaataccgttacgatcacaaaataatttttaaatttgtacaagtgttagctgattgtaagctaaccatctaatatttaacatctaaataaaatgttacaagtcaattttttgcgcgacaataaggaacgcgttttagaaggtcttaagaaaagacaattcaaaaatcttgagttggtagacgaggctatcgctgccgacgacgaaagaaaaagaatccagtttgaactagattcccagctttccgaaatcaacaaaatttcgaaagaaatcggacttttgatgaaagaagggaaaaaagaagaagcggaatcggcaaaatctaaaacagcacaatacaaagagtcgagctcagaattgaaatctcagttggaagtaaaggaaaacgacttactgaatatcctgtaccagcttccaaacattccaaatgaattggtaaaaagcggtgcttcagctgatgacaacgaaatcattttccagtctcatcctgtagaagggcttggtgaaggagcaatccctcactgggaactggcaaaaaaatataaccttatcgattttgaactgggagttaaaattgccggagccggtttccctgtttatttagggaaaggagcaagactacagagagctttggttcagtatttcttagataaaaacgtagaaaaaggatatacagaagtgaatcctcctcacgttgtgaatgaagcttcaggttttggaaccggacaattgccggataaagaaggacagatgtattatatcaacgaagataaattatatttgattcctacggctgaagttcctgtaaccaacctttaccgtgatgttctttttgatgaaaaggatcttccggttaaaaatacagcattctctcaatgctacagaagagaagcgggaagttacggagcccacgtaagaggattgaaccgtcttcaccagttcgaaaaggtagaaattgtaagaattgagaaaccggaaaattcttatgctgtgttggaagaaatggtagaacacatcaaagaaattcttacagatcttgagcttccgttcagagtattaagactttgtggtggtgatacaggttttgcctctgcaatgacgtatgactttgaagtatggagtgcagctcaggaaatgtggctggaagtaagctctgtgtctaactttgaaaccttccaggccaacagactgaagtgccgttacaaagctgatggtaaatctcaattggtacatacattaaacggttctgcaatggcattaccaagaattatggcagcattgctggaaaacaaccagacagcagatggaattaagcttccaaagaagattgctgaatatgcaagatttgatgtgattaactaaactaatcttttgattaagtatataataaaaaaaccaccggattccggtggtttttactttattctgtaacgataataatctttttatcagcgtttttaagttttgtatccttatcataaatggatttcagatcatattctattcttatggaatgatcatcaacctgcttcacccagtcatgctttcctgaaattgattttataggattctcaaattttaaggtagtaccgatctctttgaaaaacatgaccatcatacctgctattttttcagcttcttcctttgagcttttggtcttgatagcttcttcaatactttttagatttaaattctcagtatcaatggtgagggtttttccgtcccagctgttataaatattctgatccagaggaattttttcagttttggtaaagtttttcagggctttatagtcgtccgaagcaaagtgttccattttaaaagaaaatcctgccagtttgttgttttcttttgcagatttcatgaagatttttttcatgatcctgactgaatccggattttcagtttttaattttccttcttttttggcaagatcatacatacttgtccagacagttggaagtttatccacttctccaaattctttttgtttcagcgaatccggcgtcatagccatcatttctgccataaactccctcgtatcgatatcggtaacagaagtagaagcggcatccctatgatagacaatttcagaattcacactgcaggattgcagcataaaaaggcttattaaaaataagacaacagttttcttcatggtttatgtaaatacaaatttaatggcagttaacagctccgttgggatctttaacaattgtcatggcttctgctttcggagaaacgtaagggattcccagttcaagacctctcagaatgaataatcctccaagaataatcataattaccggaacagctttcaaaacttttattctgaaggcctgattcataagatttccggccagaacaatggcaaacatgaagggaagggttcccaatccgaataaagccatgtataacgctccctgccatattcctcctcccgcaaggctggcggtaagggccatatagaccatcccgcacggtaagaatccattaagaagccctgtagtaaatctcgaacggtaatctgccttttgaagaagtcttcccagattcatttttacgctgtacaggaatttagaaagaaaaggaatctttgaagcaaaatcttttcctccaaatgaaaatacagccataatgatcagaagaactccggcagtaatggtcagatatttctgaaagcctgccatttcaaatccttgtccgatgatccccagaagcgcacctaataatgaataggtgaaaattcttccgaactgataggtaagattctgaaggtagaaattagcagcctgttttttggttaatcccatcgataaagcaataggtccgcacattccgatacaatgaaaaccggaagcaaatcctaatgcaatagccgacacaataagtcctatttccatatcacatcataatccattctgtagtctgttttatctttcgtccagctcagtcttaatgtataatttcctactttcaatacctgtgaaggaattgtgaaagactgcgcggcgtcaagctgtacagattttttgatatctaaattctggtcgtcggttctgtttaaaacaaattttaccgtagtattagagttgttataatctttcgggaaagtaattttaattcctttggtatcctggctgtaaacaggtttttcctgtaattcgtcagcttttttcttcgcatcaattacatcctggtattttaattcctcttcataataattatcggttaccatttccgagttcttctgtccgttcgggaacaggaacatcatggataatataaaaactatgaatgcaagtaatgcaattacaacaccgtgtccccaactaaagttcttcatttttttctaaaattaaaattgcagtttgaatggtccttcaaaataagtctgataagaatcaatcagtttacctttcatgtcatacacaccaatcgtgatattctgtttagagagtttcatttcattttccgggaagctgatattaattgttccttttgaaattttatctctgtcaacctgaatcttgctggatgcactgtaagtaatttctccatgcgccggatcgattactttgatggtaactattttcttgtcattcgttttattaaggaacgtataattataggtattggtaattttaccgtctcgtacaaagaatgtgcttccagccggcttaatgaatttagcttccatttcaccacgactgtaaagaagatatcctaagaatcctacaagaaggagtaagaatatggagaaacccttcattcttcctgtaaacttaaactgggtttgtttttcaatttcgttttcagaagcatatctgattaatcctttcggaaggcctactttctccatgacttcatcacaggcatcgatacaagctgtacagttgatacattccagctgctgtccgtctctgatgtcaattccggtaggacaaaccactacacactgatggcaatcaatacaatcaccctttccggcagctttccggtcttctccttttctccatttcgctctgttttctcctcttttgaaatcgtagaaaacattgatggtatctttgtcaatcaatactccctgaagtcttccataaggacataccaatgtacagacctgttctctgaaccatgcaaatacaaagtagaatgccgcagtaagaaggatcattacaatgaaattggtaggatgagcaaatggcccttctccaacaatcttaaatacctcttcatatccaacaatgtacatgaacatgaagtgggtgatgatcaatgatatgatgatatagaccgtccattttaaacttctcttccagatcttctcactgttccactcctgtctgtccagcttcatctgcttatttctgtcaccttcaatcaggtattctattttacggaagatagattccataaaaattgtctgagggcaaatccacccgcagaaaattcttccgaatgcaatcgtaaaaacaataataaagattaaagatgcgatagcacctaaagtaaggataaaaaagtcctgtggatagaaaggctgtccgaagatgaaaaactccctgtctataacattgaacatcaataatgggttaccattgattttgatgaacggtaatgtaaaataaataattaatagtaaatagcttacaatatttctatagttggtatatttccctttaggttttcttggaaatacccatttcctttttccggattgctccattgtccctatagaatctctgtaagtttcagggtccagaacctgtccctgtccgcctcgtacttctatttcttctatgtctgacatatataataggttttaaaaaagaaaaaacataattcgttactattttaatctaataacaaattatgtttttttcatatgtttctaattttttaaattattctttttcccaatgcgcttcagttccttgaggagctgctcctccctgagccggagtcactggcggttgttcctgattgatgtgatatacatatgctgcaatcttttcaatctctgcacctgaaacttctccgtttttaccgaaaggtctcatcgcagggttggtaggagaaccattccagtccatatggaatacgtttttgaataatgttttctcaggctggttgatccagtagttatcagtaaggtttggtccaatacctccactaccgtcttccttgtgacaagatgcacagtttgttttaaataattctttaccttctgcgatattatccgctgaatacttagctgtttcaatggttacaggaggctgagatttctgatattcttcaatacttgccaactgctctttatattctttttcatattcgcttaacgggtgagcgaagtctgtgaaagagtatgctgcaatatatacaatacaaaaagcggtcccaaaatagaataaacctacccaccattttggtaattggttatccagctccataattccgtcgaaaccgtggtcgataaggatatccttttcttcggaagcagattgctttttgaatgcactttgatataatcttttgaagtaaggtactttcttctcagctaaataagctgccttttcttcaggagataatttcttgaatttgttgttctcgataaggtccccgatagctccatgaatgtaagcaaggatcccagcgatcacaacagttccccagaagtaaggtgaagaaaggaacgcgtagctctgtacaaataaataataaaaaactattaaaagtccgattattattaagatgtttataacaacaggtgttctttgtttcataaaaaatagtttaattttttaaattaaaatcgtcatcttcatcatccccaagaggagcctcttcttcttctttgtaatattttttaggtctgctaaaaacatagattaccaaagcgatgaagaacagcataaagaaaatcagagccagtgtctggtagaagccagcattttctgtattggataatatatctttaaagttctgaggaatcatatgaaccttttaatgtttagttattacttgctgttttgatttcagttgttttgatatctgtacctaatctctgaagataagaaataagagctacaatttcttttttctctaattctccctgaggtctcttagcataagcctgtttaaggtcatttgcttcagagaagatatcttttacaatttttgctgattggttgttagcccatttgtctgcagagtcgatttcagcctttgtataaggtacatcaaatacattcttcatcagcttcattttatctaccatcttggttctgtctaagtcagtagcaattaaccaagggtaacgaggcatgatagaacctgcagaagtagatcttgggttatacatgtgcttgtagtgccaagaacttgggtttttaccaccttctctatgtaaatccggtcctgttctcttagaaccccataggaatggtctgtcgtatacgaattctccggctttggagtattgtccgtttttaccgttaaatctaacgatctcatctctgaacggtcttaccatctgagagtgacaagcgttacatccttcacggatatagatatctctaccttctaattccaggggtgaataaggtttcaccgcagaaatggtaggtacacttttcttaagagatagtgtagggataatttcaattgaactaccgatagatattgtgatgaaagatagaattcctaataatacaggagttctttctaaccaaaggtgagtaccttctccttcttttctgttcttactgatgtttgccaacgcaggagcttcagcaggaacatctttctggaatgatccttttcttaccgtagcaactacgtttacgatcattaagatggctcctgaaatatagaatgcacctcctaagaatctcattttgaagtaagggataattgcagttacagtatccagccagtttttccataataatgttccgtccgggttgaattgtttccacattaaaccttgtgtaaatcctgaaatatacattggtactgcatagaagatgattcctaaagtacctaaccagaaatgccagttagctaattttacagaccaaagttttgttctccacataattggtaccaggtaatagataaccccaaatgccatgaaaccattccatccaagtgctcctaagtgtacgtgaccgataacccagtctgtaaagtgaccaattttgttgatgtttttagttgccaaaagcggtccttcaaatgttgccataccataacaagtaacagcaactacaaagaacttaaggataggattttctcttaccttatcccaagcccctcttaatgtaagaagaccatttaacatacctccccatgatggtgcaataagcatgatagagaaacctgttcctaccgcctgagcccaagccggaagagctgtatactgaaggtggtgaggaccagcccagatatatacgaaaattaatgaccagaagtgaataatagacagtttataagagaataccggtctgtctgcagccttcggaaggaagtaatacattaaacctaaaaccggagtcgtcaatacgaatgcaaccgcattgtgtccataccaccactgtacaatagcatcttttacccctgcgtatgctgaataagatttccagcctgtgaaagatagaggtacttcaagattgttgaaaatgtgaagcattgctactgcaatccaggtaccgatatagaaccaaattgctacgtaaaggtgtctcactcttctcttcgaaatagtcaggaacatattgataccgaaaatgatccatgagaatgcgatcaatatgtcgatcggccactcgtgctcagcatattctttagaggtattgatccccataaagaacgtaatgaacgtagcaacgatcataaactgccaagtccagaaatgtagccatgacaatgtatcactgtacattcttgtttttaataatctttgtaatgagtaataaatacccgtgtaaacaatgttacaaacgaatgcaaagattacggtattggtgtgcagcattctgattctaccaaaaccaaatgcaccatgtgtgtttattaacccttgaatattacctgatgccaaacttttaatggtcgtatcatctgtcccgaaaaagaattcaggtaactctgggtagaaaagcattaatgccgccgtaagcccgaatgtgaaacctataagaccaaagacaatggtcgcatataggaacgcacggacaatactgttgtcataactaaacttttgtgtttccatatcaactattcactatttttctcaatttttattattttctcctatttctttctcgtctttacttttgtcgccggtctcatcattttctttgattttttcatcatcaaaaaggattctgacagcaggagattcatcatcctcaaactgtccttttcgggcatacactataaatacgaccaagaaaatcgcagctaaagaaacactgcagaggatcattaaatatagaatatccattggacaacaaaattaacctattttcggggttcaaatttagtgaaaaataatgacattcatcacgaaatgccgatttcagctaatttaaaatcagtctaaataagggcttttacgcctgttttttgaaatattttcgacctaaaatccaggttgaaagtgttgtaaaggtaaccactgtgatcgagctgattggcataatgatagcggcaaaaagcggatgcatatgtcctgtaacagcgtaacttaaaccaacgatattgtataaaaaactgattataaatgtcattttcacaatcgtgatagagcccttacaaacgttcagatagttgtcaagtgtaaccactttttcaccattcataatcacatcagaagatggtgtaaaactgtttgtatcatcagcaatagcaattcctacattactttgttttaaagctcctgcgtcattaagcccgtctccgagcattgctaccttcatgtgctggtcctgaagatttttaatataattcaacttatcttccgggctctgattaaaggccattcctttatagttgggaatgagttctttaagctgattttcttctgaagaattatctccgctgagaataaatattttgtattgggttaatttcgtgaaaagctctttcagtttcgggcggtattcatttttaaagatgaatttaccaaggtattcaccgtttttactgatataaactgcggtctcaagattcttgggttcctgattgttatagcgggcagaaccaattttataaagatttcctcttacgttggcctcatatccttttcctgaaatttcaacgaaattttctacagggaaatattcatcatttacatcaatgaattcatacagtgattttgaaagcgggtggttggagttttttaataatgttttgatattcagagagtcaaattcattaatgtcagctccttcatatttgatgtttgatttttttctgtgcgtaatcgttccggttttatcaaaaacaatcgtatccagcttcgcgattttttcaatcgttaatgtatcttttacataaaacttgtttcgccctaaaatcctcataatgtgtccgaaagtgaacggtgcagacaatgcaagtgcacatggacatgcaatgataagaatggctgaaataacctggaacattttttccaaatcaataaatgaccagtaaatccccgaaattaaagcaatacttaaaataataaacgtgaaatatttactgatgttgtttgtcagggtatcaagacccgtttcgtgttttttgaaagcttctttattccaaagctgagtaagataactctgatctacgtctttgattacttccagttccagagatgacccgatctgtttacctccggcaaaaatcttgtcaccgggttgcttactgatgctttcgctttctccggtaataaaactgttgtcaatatttccttctccgttgatcagtatggcatctaccggaatgatttcctggtttctcactaaaatcctgtctcctacttttacctcagaaagaaggatgttctcctgttttccttcaaagtctactttggtaaccgcaataggatagaatgatttgtaatctctgtcataagaaagagcactgtacgttcttttctggaaaattttccccatcagcatgaagaaaagcagtccgcaaagcgtatcaaaatatccaggaccgtaatccgtgaccacttcatagatgcttctgccaaagagaacaaaaattcccaatacaataggtacatcaatgttgacaatcttattttttaatccgtaccaagcagatttataataatcagaagccgagtaaaagacaaccggacaggccagcaggaacatcagggttctgaaaagccctttgtaatgctccatccagtaatcttcccctcctacatattcaggaaatgccaggaacattccgtttccaaatgcaaaaccggcgatggcaaattttaccagaagtgatttatcaagatgatcaacgtttttttcagcggtttcaagactgataacaggtttgtatcccagattggttaagaaattagctagttcgcttaacttcaaatcattatggttgaatgaaatctgtaaggtcttccttgtaaagttaacctgggaatatttgatgtgctgatttaaagtatggaggctttccaataaccagatacaggaagaacagtgaattacagggattttaaatgtaacaaggctggtgtttccttcagagaaatctgttactttttcaaaaatctcaggagtgtccaaatagtcaaactgggtagaattttcatcactcggacgaattcctgcccctttgttaagctgataaaaattgcttaagttattcgtatttagaatttcataaacagacttgcagccattgcaacagaaagtcttttcatcaaataaaattctctctttttctataccttgaccacaatgaaaacagttctcgctcaccaccataaaatattgaactacaaaattataacaaatttttttgtttatcgcgttaaaaagttctatttttgtgataaatatcatataaaatgccgcaggaacaacagatagcaattgaagagaggttcgccagagtttttaatgataaatcatttaaggaaagactttctagcgcagattttgaaaaatatattaatggcaaaaagaaactgagttttcagaaacatgaaaccattttcgaggatggggaaactccaaaaggagtatatgtcctggaaaaaggtgcggccaaactttcaaaatcaggagcgttcggaaaagatcagattttaagatttatcaaagaaggggatattatcggctatcgttctttgctttgcggggaaaactttcaggctaaagcagaggccatgacagatattgaatgtgtatttttaccagcagatatctttatgtatcttctggaagtagatccacagctttctttcgtaatgcttcagaaaatttcttacgaattgggagaatcatccaataccattactttccttgctcagaaaacggtaagagaaagactggcagaaatcctgctgcttctggagcagaaactgggagtagaccctgaaggtttcatcaagatctcattgacgagagaagaaattgccaacattatcggtactgccacagaaagtgccatccgtctgatctctgaattcaagcaggataatctgattgaagttgacgggagaaatatcaagattctaaatcacgacaaactcatgaaactcggtcacgtagttttataaaaatcataaaaaacttaagtcggctcagggccgactttttaacttttaaaaaatagataaattatgtctgttcactctgaaattaaaaaagttacgactgaaaccttgcgtaaaatgaaattcgacaaggaaaaaataacaatgcttacggcctatgattttactaccgcaaagatggtagatgccggcggagtagatgctattttgattggagactctgcagcgaatgtaatggctggttttgaaactacattgcccattacgctggatcagatgatctaccatgcccaaagtgtggtgagaggaactgacagagctttggtggtagcagatttacctttcggaacttatcagagtaaccctgaaaaagcattggagtctgcggtaagaatgatgaaggaaggcggtgcacatgccgttaaaattgaaggagggaaagaaatttccaaatcaattaaaaaaatcatcaatgccggaattccggtaatgggacatttgggattaacaccacagtctatctataagttcggaacgtataaagtaagagctaaagaagaagccgaagcggaaaaactgatcgctgatgcacagcttttagaagaacttggatgtttttctatcgtattggaaaagattccggcagatttagcgaaaaaagtaacagacagtatttccattccaacgatcggaatcggggccggatcacattgtgacggacaggttttggtataccatgatatggtaggaatgaacaaagggttcagtccgaaattcttaagaagataccttgacctttacacagaaattacaggagctgtttcccaatatgtaaaagatgtgaaaagcgttgagtttcctaacgaaaatgaaagttattaatattcatcaatgcagaatcaacaacaatctatccagggaatattatctatcgcagccttgatttgtcttgctgtaggatggtttaatcttttctctccggaaatcaatcatttgctttcaagaaaagttttttatgttttaatcggagcgagcttttttattcaggctccgttacttacgaataagaattttgtttatgctatgtatgctgctgccgcaatctgtgtattcggagcattcattccggaaggctcaaaactttcagccatcaaaaccgttggacttcttgcaggaattatcttgtcattgtccaatagaagaagatagacttaagatatgaaggagcagattatatatgaggacaatcatcttctggtggtcaataaaaaagtcggacaacttgttcagggtgataagaccggtgatgaatcactattggaatccatcaagaactttataaaaataagagatgctaagccgggaaatgtttttctcggcttggttcatcgtatagatcgtcccacatcaggattagtgatctatgcaaaaacttccaaagcgctttcccgtcttacgcagatggtgaaaaaccgggaagtgaaaaaaacatattgggcagtcgtgggaaaagaaatgattccgcaaagccagagactggtacattatttaaagaaaaacgaaaaaaataataaagccatcgtctttccaaaagctacggaaggagccaaagaagctattctgacgtatcatgtaatcaaaacattagacaattatttgttgctggaaattgatcttgagaccggaaggcatcaccagatcagggctcagctgtctaaaacaggagttccgattaaaggtgacttaaaatatggagcacctcgctctaatccggatggaggtattaatcttcacgccagaaaactggaatttattcatccggttactaaagaaaacataaaaatcatagctcctgttccgcagaatgatgcgatctggagagcttgtgaagaataacatatcataaactataacatgaaactcaaatcacttttattagccacattgctggttatgacatcttgttcagacaatgatgaattgccgcatgataattcacaacagacgattcctgaaaatacaagtaaaatatcatggaattatcctgttttgtcacctgcctttaatggattggaacaaaattatatgttcgaatatgatgctcagggaagaattataaaaagaacaggaggaaaactggaactttccggaagtaccgggtttccttatgcttattcaaaatctgtctatacaatggtaacatatacaggagatacagcgattatgagaaattatagctctgatcctggtttcactgttcagttgaaggaaagaaggtttgaatttgataatcaaggtagagttattaaagcagttattccacaggttaataattcatatatggatatgtatttgacctatacttatgatggttcaggaaagttaactgagattttaactgaatatccaaatattccatatgatccaactgatcctcaagattatattttaacatacgtagaaaagtttatttataatacgtcaggaaatctagaaaaggcaattaaaactgaaaagcataataatattgatgcttacattaccaatgaaattacattggataattttgattctgcacaaaatccatttaagaatctgggtatttttgaagagtatttctacttttcattatcaaaaaataatcctcaaagaaaaatttcaaaagagtttaaaccttatagctccgaattttttctaagccaatcaaattggactaatcaatataattctgatggaagcctgaagcttttttactaaagaactatttaaaataaaagtgaagactatctcaaaattgagatggtctttttctttaaagtcatttaagattttgcttattctgaaaaaatgtctaccttcgttccaaactttaggggtgtctgttgccaacagactgagactttaccctttgaacctgatctggatcataccagcgtagggaaaagtagatgactttgctgtacattctattgtacaataatggccattcctgaagtgtatttaaattatttaggaatggaacttataatcaaccacacccgaaaaacattcgatatacttcctgcaaacctggaagcattactggctattgagctacctggaaaaaagaaaggcattgctgtggctctcaataatcgtattattccgttatccatctgggcggaaaccatcctcaacaacaacgattcaattttaatcattactgccactcagggcggttaattttcatatttaaaaccaatacttatggctcactccattacatgttcgccatttccgaactcaaagaaaatctatgttgaaggaaaactacaccctatcaatgtagccatgcgtgaaatacagcttagcccaaccaaactgaccaatggtggctttgaacataatgctccggtaacgatctatgatacttcagggccttataccgatgaaaatgcagttattgatattcagaaaggacttccgagaatcagagaacaatggattctggacagaaatgatgtgaatatcctggacggaattacgtctgaatacggaaaggcacgtttggcagatccacgtcttgacgaactgaggttttcctatgaccataaacctaaagttgccaaagaaggaaaagaactgacacagctttattatgctaagcagggaatcatcaccccggaaatggagtatgtggctatcagggaaaaccagagaatagagcagcttgattccgtatcgaaagaaatggcttttcagcatccgggacacagttttggagccaatactccaaaaggcaagatcacgccggaatttgtaagagacgaaattgccgccggaagagccattattcccaataacatcaaccaccctgaaagcgaaccaatgattatagggagaaatttcctggtgaaaattaatgccaatatcggaaacagtgccgtttcatccagtattgaagaagaagtggaaaaagccgtatgggcctgccgatggggagcagataccattatggacctttcaacagggaaaaatattcacgaaacaagagaatggatcatcagaaacagtccggttccgattggtaccgttcctatttatcaggcattggaaaaagtaaaaggtgttcctgaagatcttacatgggaaatcttcagagatacgctgattgaacaggcagagcagggagtttcttactttaccatccacgcaggagttttactgagatatattcacctgacagccaacagagtaaccggaattgtttcccgaggtggatcaattatggcaaaatggtgcctgtttcatcataaagaaagcttcctgtacactcattttgaggagatttgcgagatcatgaagaagtatgacgttgctttctctctgggagacggtcttcgtccgggatctattgcagatgccaatgatgcagctcagtttgcagaactggaaactttaggtgaactgaccaaaattgcctggaaacataatgtacaggtaatgatagaaggtcctggccatgtaccgatgcacatgatcaaggaaaatatggataagcagctgaaggaatgccatgaagctccgttttataccttaggccctttaaccacggatattgcaccgggttatgatcatattacttccgggatcggagccgcaatgattggatggtttggctgtgccatgctttgctatgtaacaccgaaggaacatttaggacttccgaataaagaagatgtaaaagttggggtgatcacttataaactggcagctcatgcggcagatttagcaaaaggtcatccgggcgcacaatacagagacaatgccttaagcaaagcaagattcgaattcagatgggaagatcagttcaacctttcgttagatcctgaaacggcaagggcttatcacgatgaaactcttccggcagaaggcgcaaaaattgcccatttctgttctatgtgcggaccgaagttctgctccatgaaaatcactcaggaaatccgtgaatctgcagaaaaaggaatgctggataaatcacaggaatttattgaaaaagggaaagaaatatatatatgatcctcgttatcactcctgaattgattgttccgaacgaaactgatagtattaatcagatgtttcaggaaggacttaacttgcttcatatccgaaagccatggatcagccgtaatgaaatgattgaatttatcacccaaattgatgaaccttttcattcacagctggtacttcatacgcattatgaccttaggaaagaatatcatatttcaagatttcatttcagggagattgatcggcaggaagaaatgtataagtcttttgtgaaagaaaataccatttcaacttcagtacacgatatcacaacctacaatactttgaataaagaatgggaatatgctttcataagcccgttctttccaagtatatccaaaaaaggatatgggacagattctactattaaagaagaaatacaatatcggaacaatccggatgtcaaattaattgcccttggaggcattaatcatgataatattcatgaagtctttgaatcaggagcagacggagcagcgctgttaggtgctgtctgggaaagtgaagaacctttaaaagtattcagaaaatgcaggaacgtccttatgtcataagcattgcgggctttgatccaagtggtggagcaggcttattatcagacagtaaaacctttgagcaatccaaagtaatgggactgggagtatgtactgcattaacactgcaaaccgcttcccaatgtcttagccttgaatggcgtcctttggatgaagtgactgaagccattcagatcttgatggaaaactatcccgtttcagcagtgaaaatcggaattgtgaaagatgccggttttttaagcaaaattgtagaaacggttcaaaaaagtaactctgaagttaaagttgtttgggatcctgtcctgaaaagcacttccgaattcacttttttcgatcttgacacacttcctcaattaaaaaataccattaatgagctcagtttaataactccgaattataatgaatacagtgttttaaaggaaaataatcttctaccggatacccgtcaatgtgcattgctgatcaaaggagggcatagaaaagatctgttgggaacggatattttagttgaaaacggaaaagaatctcttttagttccagccgaaaacgatagagtatattttcccaaacatggttcaggttgtgttttatcctctgccattacagcagaacttgcgaaagggaaaaatatggaaacggcctgccggaacgggaaattatatatcggaaaatttttaaaaagcaatccctctttgctgggaacacattcatagaaaatatggaaaaattacaatacatatcacagggaaataccaggcaggaacaggaacttcatatccgtaaagctctggataacggaatcaaatgggtgcaggtccgatggaaaaatgctcctgaaaatgaattaataaacctttgtgaaatttcaaaaaaactttgttcagaatatcagtcggtttgtatcatcaatgatcatgtagaaatagcaaagaaaatagatgctgacggggtgcatttaggattgagtgatagctctgttgaaaccgcaaaacaggttctgggtgaaaacaaaatcattggcggaacagccaatacgctttcggatgtcattcagagaatcaatgaatcctgcgactatatcggtttgggaccattgaggtttaccacaactaaagaaaaactaagtcctgttcttgggcttgaaggatatcagaaaatcatagatggattaagagagcaatccattgatatacctaaaatatttgctatcggaagtgttgcttttgaagatatcttacccttacaggaaatcggaatttacggtgttgccgtttctgggcttattacaaagcagcctgaaattattaatgaactaaaaaaagtaatgatatgaaccatcagaaattagaaatagcaggaagaacttttgaatccagactgtttttaggaacaggaaaattcggaagtatgagagatatggtacaatctgttatcgcatcagaaaccgatatggtaacaatggccttaaagagaattgatgcacaatccaatgaagatgatctgcttgattcactgaaagaaacccgtgttcatcttctgcctaacacttccggagccagaaccgcaaaagaagctgtactggcagcacaattagccagagaagcgctggaaacgaactgggtaaaactggaaattcatccggatccgaaatatttactgccggatcccattgaaacattatatgccactgaagaattagccaaacttggatttgtggtaatgccttatattcatgctgaccctgttttgtgcaaacgtctcgaagacgccggaacagctgtagtgatgcctttgggtgctcctattggaacgaataaaggtttaaaaacacaggactttcttgaaataatcatcagccagagtaatgttcctgtagtggtagatgctggaatcggagcaccatcagatgcagcaaaagccatggaaatgggagctgacgctgttttggtgaatactgcgattgctgttgcgagaaatccattgaatatggctgttgcttttaaagaaggagttattgccggaagaagagcttttgaatcggggttgggagccatttccagtcatgctgaagcttcaagtccgctgacttcgtttttatttgaataaatgaaggttatgaaaagctttaaagaggtttttgaaaactaccaatgggatgcggtaaaggataagcttgaaaaagtaagcccagctgatgtaaggtacagccttcagaaaaagaataaaaatcttgatgatttcctgaatcttctgtcacctgccgcttctggggaacttgagctgatggcagtgatgacgaggtcacttacccagaaacgattcggaaaaaccattcagctttatgcgccgttgtatctcagcaatgaatgccagaatatctgtacctattgcggtttcagtcttgataatcatctgaaaaggaaaaccctctccgatacggagctattgatagaggcatcagtcctgaaatcaatgggtgtgaatcatgtactgctggtaagcggtgaagccaataaaatagtaggtgtaccttattttcaaaatgctgtccgtaaactaaagcctcatttttccaatatttccattgaagttcagcctttaatggaagaagaatataaactgcttcacgaagaaggagtacattctgttttagtgtatcaggaaacctatcatcaggatgtctacagggaataccatccgaaaggtaaaaaatcaaacttccatttccgcctggaaactcctgacaggataggaagagcaggaattcataaaatagggctgggagtcctgcttgggcttgaagactggagagtagacagctttttcaatgctttgcacattgattatcttcagaaacaatactggaaaagtaagttttcggtttcctttccaaggctcagacccgctgaaggaattattgagcccaattttatcatggaagatagagatcttcttcagttgatttgtgcctatagaatctggaatgaagaccttgaaatttccatatctaccagggaaaatgaagtgttcagaaataatattgtttctctgggggcaacagcaatgagtgcagggtcaaagaccaatccgggaggttatgccgtagataaagaatctctggaacagtttgaaaccagtgatgaacggagtatggaagagattaaaaccatgattagaaaagcaggttacgatcctgtgatgaaagattgggattctgtttatagtggattttaaatttttaaaccattaaggactttgaagagatgaagttgaattaaaagaaatcaaagatttttaagacagctttttcaagcgaagctcaacttaactattcttaaaagcttaaaaaaccttaatggttcaattatcataaagcatgaaaaaagaagattatttttcccggtacagccggcagatctttattgaagaaataggattggaaggacaaaagaaaataagagcttccaaagtgcttgttatcggggcaggaggtttgggaagtcctgttattcaatatctggctgccgctggggtaggaactttaggtgttgcagattttgatgaggtagaacttcataatctgaaccgacagatcattcatgccgaaagcagagtaggattatccaaagttataagtgctgaaacctttgtaaatgaactcaatcatcaggttacattcaaagggattgaagaaaaaatcaatgaagataatgttgaagaaatcattactcagtacgatgttgttattgacggttcagacaatttttcaacaagatatctggtgaatgatacctgtgtgcaattacaaaaaactctggtttacgggagtattttaggtttcgcagggcaagttgctgtatttaatcataacggaagtaaaaacttaagggatattttcccggaaccgccttttgatgaagatgtaccggattgtgacagtttgggagtactgggagcactgcctgggatcataggcagtatgatggctcttcagacactgaaaattataacagatcttccggtaagtgtaaatcagctgacattggttgatacgctgagctggagatttcagacgattgatttttgatgtaaatgtaaacactcatatcacaaatggtttcacaaataacacgaattcaatatcaataggaacgggctttagcccgttctaattttaatatcttccattggctttagccaaaacctaaaaaaacaggtgataatcttttttaccacctgtttttatttctattgttaaaagtattattgtgcctgttgcattacgcctccggtatcctcttttttagtctgatttaagatattcggatcttctttcgctaatttatttctcgtcggaattttataattaatagaaagcccgaaatttcttgtgtcatatttactgtaaatcattaccggatttcctgatggcggattagaacttacctgcattacctgtccgttgaaaatatcattggcaaaaacagaaagggtcagacggttgttcataaactttttcgttaatgtaatatcaaacgagttgttgaacggtttctctgccgtaaagtagaaatatcctgcctttggagtcagataactgtaattcgcggtaagcttgatgtctttaggtaaaataatctgagtcatgatattgaagatccagaaccctttattgttcagattgtcgatttcatgtttctgatagccagcatataagtacatgaaattaattttatcaggattgaaattaaatttcatgatttcgctcaaaggtttactgaaaatcataaaaggaaccggtaatcccacattaaaattatgaattctcatattggaaatattcacctgctcattgaaaagtttccttccgtcttttcgaatgatctgtgctacctgattgcttgctgaacttacactgtatccgataaacgcataatcaaaagctgatattttcaattcataattatcaaaaatagtaggctgaaggttcgggttaccgtttacttccgtacttggtccggagaatgtgacgttattcggattcagggcagaaatgcttggcaaactgattttcctgttgtaattcgcagcaatataaacttggttcatcatgttatactgtacacttgcattcgggaaaaatttaaatttgttgaaaggaatcagatcagcttcaaccagttttttatccttatcaatatatcttgtgatcccagaaatatcatagttttcagcacgggaacccaatgtgaaatcaaactttttcagcttagcctgaaactctaaatacgttgaagcagtctgtctctgatattcaagattggtgaggccaaagctttccgtgttataatcctgcttttcatacaatcctccaaagcttacctttccgccatcaagaagcttgataggctgtgcgtaatctactttaaagttagcaatattcatcacagatttattgttcagaatatcttttaatccattggtagggctatcaagaggttcagtaggatagtttacaaaggtcccatcctggaaataattatcctgtgaaaacttgctgtctgaccttgtatacccaaactggaagtccagtttctgagatttgtcagcaaagcgcttctgatacgttacaacagcttcctgtctaaggttattggtatgcgcaacatcggaagaagtataaaaagcttctctcaaatcctgcagatttcttttgaaaggcaaatcaccatgtccgtcacttaaagtgtagttgtcattattgttgtgataaatatcgtagtttaacaataatcggtcctgtcctaaatcaaaagttaacccggattttgcaaaatatccgcgtccatatctgttggtatgacttgttaaaagctcatcctgctggccattcagcatactttcgcgataattctgcccaacattcagttgccatccgaaatatttatttcttgcatttaaattaacggaattcgtagttctgcttctgtatttgtcataattcgtgaaagaataatttcctgaataagtagccgtcaaatatttatttgcatttttattggtaatgatattcatgatggcacctccggaagttgccggaaattcagcacccggctgtgtgatcacttcaattctttctacagaattggcgggcatcccttccagaaaggaattcaattcattggaggtgatgttcagaggtcttccgttaaggtatacttccagcatttttccctgatacatcattcctgcaatatcggtagatacaagtcccggaagtttttttattccttccagaacgtttccgttattcagctgaggctgttcagaaaagtcaaaaatagtacggtctgctttttgttcaacggcttttttagttttggtaatgactacgccttcaatttgcttttcctgaggtttattatttttttcctgtgaaaaaacaaaaacagagcttagtaaggataaagcgaaaattgtttttttcataatgtttttactgttatccggttagacgcagaaaaagagaatttgttacggtaaatgtttgaaaaccgaaaatttaggctaactatttttttatttccgaaataattatatctttgccaggtaattatcaagaatctctagatgggatagcaacctgcaaaaacaagcaaggtgctgcaatcgataagccggatctcccggaaaaaatgtttatcattctatcattactcccatcttgaatttttgttttaaagttaaaatcaaatgtttaaagacaagggaaatcactcaacatcagtaattttttattcttcaggtcatgaggtaaatcttcattactctgatatgttctcatgccatttctatatgcgcatgtgttgttgtttctagtcttttctatttctaaaaaataatacaaacattttgaattctatggtaaccttacaatttagggttacaggatttgtattgcccaaaaaacaaattttatcaacaaaaagtacacaacaacatgcataatttcaaaaaaagaatctttgttccttctattgcacttatctccacattttactatgcacagacggataccttacaatctaagaaaatagatgatgtagtcatccttggatcaagaggttccggaagatcattaacagaaacacctgttccggtagatattattaacatatcaaaaattttaaaacaaagtccgtctaacagcatcagccaggctttaaattatatcgtaccctcattctcatccacctctcacaccgttaatgacggaactgattttgtagatcctgcgctcctgagaggattaggaccagatcaggttttggttctggtaaatggaaaaagaagatatcagtcttcactggttaacgttacccttacgccgggaagaggttctgtgggaactgaccttaatgctattcctgcctttgcattggaaaaaattgaagttttaagagatggggctgctgcccagtatggttctgacgctattgcaggagtactaaaccttggactgaaaaaaagactgggactttccggacaggtatttttaggaggatacgcttctcctgttaccaataatttctccggcggagtagatgggcagacgatttccgtagacctcaactacggagccaaaataggtaaaaccggattttttaacgttaccggttccgcccaataccgtaatccttattccagagccggagtaagggaaggtgatatcttcaatgcctataatgctattaactaccgggcattacaggatggagtgaatattgacggactctataaaaatattaccaatactcccaatactcagcaaatcatcaataccattaagcaatatacgactaaggtagattattttgggaatgattttcaaactcagatctcaggggcaaacagcatttctgagcttcaaaaaatattaggtaaagattttacttctcaggaacttaactacagaggattggagaggaaagacttcagtctgagagccgggcaatctaaactgcagtcagggcagctctttttcaactctgaaattcctgttaatgatgaatggaaagtttattcatttggaggttacagttatcgtcttggaaatgccggaggattttacaggcttccgaacaatgaaagaaacatcaatgcagttacacccaatggatatcttccacagattgaagccactgtgaatgattattccctagccgccggaatcaaaggaaaatgggatggctggaatatcgatttcagtaatacattcgggaaaaacgtctttggttttggtgttgtcaatacttttaatgcttcgcttacagatgcttctccaaggacttttgatgccggaggatctgagttttcacaaaacacggttaatttggatttctccaaaaaatatgatgttctgaaaggattgaacattgcctttggaggtgaataccgacacgagaattataaagtaaatgctggaaaagaaaactcttatgcttcttatgatatctatggccgtgtagtaacagccaaaactcctgaaaatgaaaaagtaaccgatttctttggaaatgtaagacccgcaggtgcccaggtctttccgggattcagtcctgaaaatgcagtttccggtaacagaaacagtattgcagcttatgccgatgcagaattggaaattacagacagatggctgttggaaggagctgtacgatatgagaattattcagatttcgggtctacattcaattataaggtggcaaccaatgtaaagctggcttccaatctcaactggagaggtgctgtttctacggggttcagagctccttcactggctcaaatctattacagttctacttctacgttgattcagcagggaaaaacaacacaggtaggtactttcagaaataattctgaggctgcacaggcattagggattccaaagctaaaacaggaaacctcacaatcctacagcacaggaattacatggaaggttccggccttgaacctgactttcacagcagatgcttacttaatcaagattaaagacagagtagtactgactgatcttttctaccgtcctgatggtagtttttctcctggctcagatcaggccgttctacaggatgcttttgatctcgcaagagccagcgcagccaatttctttgctaatgctgtagattctcagacgaaaggtctggatattacgatttcccaaaactcaaaaatcttatccggggtttctttggagaataacctgggaatcaattttaatcaaactaaaagaatcggggatatccatgcatctccaaaattggtaagccagattaataattatttttcggaacccaacagaatttattttgaagaagctgtaccccgtgtaaaagctacattgggcaatacagtaagagtttccggctttactttcgtactgcgtaattctttcttcggtaaagtgacggatgcagatgttttggatgccaattttgacggagtaacgggaagtacagagcatttcgttcttaacagccgtttggtaacagatctatctgtaggctatagttttaataaaaatatttcagcaacagtaggaagcaataatatctttaatattttgccttctaaaagccctgccataagctcattaacagcagataaccagtttgtctattccagacaggtttcgcagtatggtataggcggaaggttcttatttgcaagaattgaattcagtttctaatataaagactgacgttttgattaaaaaagacagaggttcaatctctgtctttttatttatttcagtgaagaaaactcagtgaaatcatattccgcggaagaggtaaaaagctgccttaatactgcggcatgtccatttccggcaatcacaagaattctgtcttcagcgttgtgaggaatgttttgaatattacggaacattctcagatttctgctgtaccagtaaagtgctagcatatcggcaccgtcatgttctcttagtttgaaatcaccgcttaaataagctccgtatccatattgatggctttctttggaattcatataagtaaaagtatcaagcagtgatttgaagtttttaggctccgaactcttgtaaaaggtagtgaattgttgggatatcggatcatcacttctgaaatcataatctttactaagatttttaaaaaatgcagaatcagttttcccaaaatgtttttcaagatcatccagaacagattctgcgtcaatgctgaacaattcgtttattgtaagctcactggctagtctcatagctagctgataacgctcatctcttttgtcacggtgtttgccttcgctgtattcctttagcttttgattggcattccagcctggccaggcttcaattgcaatctttgtcggcttaaatcttttaatatactctacaagttcagtgacttcttttgctgttttaggagaaagtacatctacctgatcttccttattggttttatgagcatccagattaggataatcaaaatgaaaggtgcctaccaccaggacttttgtctttggatttttaaaataatctgaaggttttttttgagcaactactgatgtagaaaggcatacaagaaggatataaataaaagttttcatgagtttattttttaaaattactgttaattattattgtgcgcggtttttttcttcgaaattcaccgctctgttattggatttgattttttggtttccaaaattataagtgatgctgagtgtcattcttctggcatcccagtagttgttgaatgactgtgtattatctgtaaaatacatatctcccttatatccggactgtttgaaaatatcgctcaccgaaagatttacctgaagtgctttttccacaaagctcatctttattccggcgtcaaggctggctctgttccttacagcggtgtatccgtcacgggaaggaagattatgccagtagttgacaaatagcatgaacgttttagccttattaagctggaatgtattattgagagaataataaaacgactgtccgtttttaggaaccagattgaatcttgtaatctgagtctcattataactgaacgaagtcgaaatattgctttcccatattttgaagaaagtatctgtataattcagattgatgccgtaattatcctgattatagtaattctcgaatgtgctaacgaggtcaatcccggtcaggaatgtgatctggtcaaagttatttgttgttctctggtagtaaagattggccgaaaatttacttttgaacatatagttgagttctatattatgattgaaagaaggctgcagacttgggttccctgaataatacgtgttcggattggaataccatcggaacggatccaaagcccggaaatacggacggttgattcttctggaataattaatactaaactgattatcctgattggccttataagacagataagctgttgggaagaactttccgtaattattctcagattttgtctgtgtagtaggagagaaaccgctggtttgtgaatattcataacggagtcctgctttcacagaccatttttcaccaaggtctttactggcactcagataggcggcataattcttttcattataatcaaaaagattgcttctcgaaggatctataaggtaatctccattgataaaattaaaatatccgatgtccgaattattagaaaacaggctgtattttgctccggtttccagctgtatttttttgaagtttaaagttaaatctgcctgccctgaatatattttataatccactgttgaaagatttcttaccacctgtgctgaattgttagcaacatttcttgtagtaaaatttacctccgtatccggaagatttccataataattggctcccaggcttagcttatgttccccgaatttctgatcaaaatatacattcagcatctgtgaagtaaaagaagaacgatgcttggaatccgtatctgtttgtaaagtaggagtattgtcggtaaaatagttttgtttagagttgatatccatattggaatgtcccttcgaaatatcatataccaatccgatattggaatttttggaaagagaataatcaacattaacatttagccccaatccgtcattcatatcccgtctttcatccctgctgacggaagaactttggccgattatcttataattttctaccgatcttttatctccgtcatatccctgaagttttattgaggctttcactttttcattctgatagtttactcctgccacactactgaaagctgcataagttttttgcgtataattcgtggtcaggtagccgctccatccaagattctgattctttttaagaacaatattaataatcccgctgtttccctgagcttcgtatttggcaggaggagtggtgattacttcaattttcaatatgttttccgaacgaaggtttctcagataattgatcagttcggcccctgaaagattcagcatccggtcattaaccatcacagaaacgccgttttttccagcaatggaaagcagtcctttattttcatccacctgtaataaaggtgtgccggccaaaacttcagttcccgagcttccttgtgaaagcatggaattctggacattgtaaacaagacggtccactttacgttctacaagaacctttttaccgttcaccataaccgcttctattttgttgacattagcggtgtctttggtttgagctgctgaaaaagaacaaatcagggtagctataattaaaatatgtttttccatattataaatgacagattgaatggtatttatattacatttctctgacaaaagtaccggaagaggttctatgagaaaacagcatttagatgaagaacacaattattcatgtcaaaaaagtttcgtcgggaaaaaacaggtttttatcgaaaacaattgatgaattatgcctttagagatttatatttgaatatgaataaaaaacaaattatctggcttcaaattatttactgggggttcaatttcataggaactgtcattacgcctaatttttttgttccggatacaaatcgtcgggaagtacacattctgagggttacatttttcattgtgaaaattgtcacattttatatatcctatttctttattttcccaaaagtttttaaacttgagaaactgtattctgccgttttcgtttttattctgacccttttatgttttgccggtatgagatatgctcttgaagaattgatactgccttctactcttggctttcgcaattatgatgaaggtacggggcttctctactatctttttgataatatatataatagttcgctgactactttcattgcaggtattctatggatactggaaaaatatggagtggctgaaaatgataaaaagcagcttctgatcgaaaagaaacaggcagaactccaggcattgaagacccagatcaatccacattttatttttaattcattaaataatatctattcgcttgtctatcagaagtcggataaggcgcttcctgctattgaagagcttgggcagctgctgaggtacagcacaaaagatcttgaaaaagataccatttctctggataaggaaattggatatattgatagtctgattgcactggagaaactcaggatcagaaatccggaactgctgatcattgagaaaaatattcagtatcctcacctgaagatttctccgatgctgttggttccttttgtggaaaatgctttcaaacatggtgatttccgtggtaaaggttttgaaatgaaaatctcagatcatgatgaggttttgcatttttatctttttaattataaaacacagaaaatgaaagatgttgtttccggcatcggaattcaaaatgtgaaaaaaaggctggaaatattgtacccaaaacatcagcttgagatcaaagattcggaaacggaatttgttgtagatttaaaaattgatttaaagaatgaataagataaagtgcattatcgttgatgatgagcctctggcaatctcacttctggaacattatgcagaaaagattccttttcttgaacttgttttctccacagagaatccgatacatgccttggaatatctgcagaagaatgattctgatcttatctttctggatatccagatgccggaacttacggggatcaattttatgaagattgtaggggcagatcaaaaatatattttaaccactgcctattcggagtatgcactggaagggtatgagcataatgttgttgattatcttctgaagcctgtttctttcgaaaggtttcagaaaagcgtattaaaagctcaggaacggttttcttttccacaggaagaaaatacctatttctttgtaaagtcttcagggcagagacatcgcataagtttcaatgaaatcctgtacatcgaaagtatcaaagactatgtcaatatccgaacagaaaatgatgagtatatcgttttggatacgcttaaatctatggaaagccagcttactgaaaaatttgtacgggtacataaatcttttattatcaatctggataaaatcaaaagtatcggggcaaaaaaaatcattcttcctgaatatgagattcctattggggaaagctatagagcaggccttcttgatagaatatcataatattcatatgagaaataaactttacaggtttctaaaacctgtaaggtttggagaatatcaaagttcagcagaggaaatgtaaaggcagttaaaataaaaaagacggcttcaactgaagccgtccctttattaattaatctaacaattaatcttatttttcctgttgtttgatcagattcagggcagaaccagccttaaaccagtcaatctgctgatcgttgtaagtatggttagccatgatgatgtctttagttccgtctgtatggatgaattctaaagtcagttgtttacccggagcaaactgatcaagatctaagaagttaacgatatcgtcttcctggattttgtcataatccgcttcgtttgcgaaagtgataccaagcatcccttgtttcttaaggttggtttcgtggattctcgcgaatgattttaccaatacggctttcactcctaaatgtctcggctccatcgcagcatgctctcttgaagaaccttcaccatagttctggtctcccacaacaattgtcgggatcccggcagctttgtaagctctttgtacagccggcacttcaccgtattcaccggttaattcgtttttaactttattggtttccatgttgtaagcattgacagccccgatcaacatgttatttgaaatattatctaagtgacctctgtatttcagccatggtccagccatagaaatgtggtcggtagtacattttccgaaagctttgatcagtactcttgctcctgtaatgtttttaccatcccaagccgggaattcttccaataactgaagcctgtctgaagttgggcttacattaacaacaactttagatccgtcttctgatggcgcctgatatccgttgtcatctactgcaaatccttttgaaggaagttcaaaacctttaggctcatcaagttttacctgctcgccagcttcgttagttaaagtatctgtaattggattgaagtcaagtctgcctgatattgcaactgcagcaaccatttccggagaagctacaaaagcatgggtattcgggttaccatcagctcttttggcaaagtttctgttgaaagagtggataatagagtttttctctcctttttctgctccttctctgtcccattgtccgatacatggtccgcaagcgttggtaaagattcttgcgttttcaaattttctgaaagaatctaagaaaccgtctctttctgcagtgaatttcacctgttcagaaccagggttgattcccaggatagctttaggttttactccttttgaaacggcatcttcaacaattgaagccgctcttgataaatcttcataagaagagttggtacaagaaccgataagagcccattcaacttctaaaggccatccgttagcttcagctttagctctgaattcagcaacaggagtcgctaagtccggagtgaaaggtccgtttaagtgaggagtcagttcagaaaggttgatttctattaattgatcgaaatattgttcaggattggcatatacttcagcatcacctgttaaatgttcagcaattttatctgctgcatctactacatcctgtcttcctgtagccgcaagatatcttctcatagaatcatcatacccgaaagtagaagtggtagccccgatttcagcacccatgttacagatagttcccttaccggttgctgaaagagattctgctccttccccgaaatattctacgatacatcctgtacctccttttaccgttaggatccctgctacttttaagatgacgtcttttgcagaagtccatccgttcattttaccggttaattttactccgataagtttaggcattttaagctcccacggcattcctgccattacatctacggcatcagcacctcctacaccaatggctaccattccaagtcctccggcatttactgtgtgagaatccgtaccgatcatcatacctcccgggaaagcatagttctccaatactacctggtgaatgattcctgctcccggtttccagaacccaattccgtatttatcgcatacggagcttaagaaattaaatacctcggaatttttgttgatcccttcctgtaggtctttatcagcacctacttttgcctggataaggtgatctgcatgcgcagtagaaggaacagctactttagcctttcccgcctgcatgaattgtaaaagtgccatctgtgctgtggcgtcctgcatcgctactctgtctggtgcgaagtctacataagagttccctctttcatgtgcctgtgtagcatttccttcccaaaggtgggtgtaaaggattttttctgaaagggtaagaggttttccaacgatttgtcttgctgctgcaattctttcaggataacgctcgtatacctttttgatcatatcaatatcaaaagtcatatcgtatttaattttgttcttgtctgttaaagtctcgttctttgatgataaaaagaaaaaaactatttctttatacatcaaaaaacgttcctattgtccattaataggaatgattttgactataaaatcaagagattttataactttcaatttaagaaaaaatagatttcgtttttcaggttatattgaaaaaaaatcgtatttaacttaaaatagaaacattctaaacaaaaaattgaaagatcttaaatcctaaaggactaaaatctttcaattatatagttttcaaaagtcttgcgacttatttgttaattctcttagtgagcgcttgtactggtcagttctttaatagatggtacaaacgttgtaagatcaatgccttcaacggctgctttatactcgtcaatgctaggaattctaccgataattgcagataataccacaaccggagtagaagcaagcagggattctcctttcttacgttcagaatcttcaacaactcttccctggaaaagacgggtagaagttgctaaaacagtatctcctttagccgctttttcctggttacccatacaaaggttacatcctgggcgctcaaggtacattacatttttatattctgtacgggcttctccttttggagcattgtcatcgaattcaaatccggaatatttctctaataattcccagtctccttctgcttttaattcatcaatgatattatacgtaggagctgccactacaagtggtgcattaaattctacttttccttgttgtttttcaaggtttctaagcatttgagaaacaatcttaagatcccctttgtgaaccatacaagatccaacgaaaccaaggtctacttttttctcacctccatagtaagaaaggtctctgatggtatcgtgggtatatcttttggaaacatcttcattgtttacatccgggtcagcaatcattggttcaacgatagcatcaagatctaccactacttcagcataatacttagcgtttgcatccggagtcagggcaggtttttctcctgatctgatctcttcaattctcttgttggctttatcaattaatccctgaagaactttattgtggttatccatacccttatcgatcatgatctggattctgttttttgcgatttccagtgattcgattaatgtattatcttcagaaatgttgatagaagcttttgccttcatttcagcagtccagtctgtaaatgtaaatgcctggtccgcaggaagtgttccgatgtgaacctcaatgattcttccctggaatacgttttctcctccaaactgcttcagcatctgagcctgcgttgcgtgtaccacatcacggaaatccatgtgttctttcatgtttcctttgaaggttacttttacagattcagggattggcatagatgcttcaccggtagctaatgcaagcgcaacagttcctgagtcagctccgaaagcgacaccttttgacattcttgtatgagagtcaccaccaataatgatagcccactcgtctacagtgatatcgttaagaactttgtggataacgtcagtcatggcatggtattcacctttcgggtcacgggctgtaataagaccgaactcgttcatgaatttcatcagcttcggaatattagcctgtgcttttttgtcccaaacagaagctgtgtgacatcctgactggtaagctccatctacagtaggggagattacggtcgcagccatagattcaagttcctgagcagtcataagacctgtggtatcctgtgaacctacgatatttacttttacacgaacatctgaacctgcgtgtaatacttttcctggggttactccgacagcatttctgttgaagatcttttctacagcagtaagtccttgtccttcgtgagaaatctcttttgacggagcaaaaacagcaggtgcttcaattcctaaaagctgagctgcaaatgtctgtagtttcttaccgaatacaatggcataagaaccacccgctctgataaattccatcttctgcggagtgaaagactttgtaaggtcgataagttccttatcgccgttgtataattttttttcttttgtattgattgttaaaacagttcctgttgctacagaataagcttcttcaagaacgggttcaccgttttcgttaagaacagggtttccgttctcatctactttctttacccagtttttaaggtcgatcccaatacctccggtaacgtctactgtggtaaggaagatcggagaaataccatttgttcctcctacaattggagcaatgttcacgaaaggtacataagggctggcttgctttcctgtccatagagcaacgttatttactcctgacattcttgatgatcctacacccattgtgcctttttcagcgataagcataacgcttgcatcaggatgttttgcttgtaaagctttaatttcttcttgagcctgaggggtaatcatgcatttaccatgaagttcacggtctgatcttgagtgagcctggttacccggagaaagtaaatctgtagagatatctccttcaccggcgatataggttactactttgatttcttcggcaacttcaggaagttgagtgaagaattcagcttttgcgtagctttcgatgatttcttttgcaatttcgttaccgctgttgaaggcttccttcagacggttggtatcggcttcataaaggaaaacctgtgttttaagaacgtctgctgctgctttagcaatagcaggatcattacctaaagcaaggtccagtagcacttcaatagaaggcccgcctttcatatgtgataataattcaaaagcaaatgccggggaaatttcttctactacggattctcccagaataatttcttttaaaaatttcgcttttactcctgctgcacttgttgttccgggtagtgtgttataaataaaaaatttaagagaatccggtcggtcaggattacctgagtctttaatttgtgtaatgatttcgcttagtaattcagcaccatcaataggctttggatgcagcccctgggtttttctttcttcaatttctttgatgtaatccttataaatactcataatagaaggtctttcaaaattaaaggtagccctgccttttctttaccggtctgtataaatacagtttaatgacattttgagttctcgcatttgacgcaacattaaccgaataaagtcagcataatctacactttttttaaaagttttttaaaattatcaaacatttcaaaatgttcccaaaattacgaaattttagtattttataagagtgaaattatttagattctttataaatatgaattttataatatctatttttggccgtatttttgtaaacaaatggagaatatgaaaaaattcctgaatgttttatgtgtttttatttcgtttttcgttttctcgcagacaaaatctgtgaagaaaacaggtgtgaaaaaaagtgcaaaaactacggccaataaaccgaatcccgatctggtaatcattaataaagacctcccggttttgatccctaaaaagaaaggtgaccagtttggatatgtaaaccaaaacggaaaattcatcattcaaccggaatatcatattgctgtatttttttacgaagactgcaaccttctgaattcacccaacgaaaaagtgagaaaattcgggacaaaaaattatgcaaccgtagaaaaagatatggtttcttacaggatagaccagtcaggaaagagagtatatcaatttaaggaagcagactttggaaaatgtaaattcgaagaatataagcagcagttgttccaagcctacattcttaatggtttttacggaatcatagaaaaatcaaagtttgtgaatgcagccgattacagacaatatcagatctatcctcaatatcagtacctctttatcctggaaggagatgatgtcgctaatcctatgattgtggcttccaataatgataaattcggggttattgatgttaacaataaaatcatcattccctttgaatatgctaatattaaaagaaatttcagctggaaactgggtaagatgtttgaagtgacaaaagacggacagaattactattatattgatgcaaacaataaaacgtactagggaataaatgataattgatgaatgatgattgatacatctgataattcctgtttttccatggtatttttatcccgtagcctaatatcccgtacctcgcacctcgatctcatatattttttgtaattttgcggctgaaataaaggggtgctttaacaggctgagattatacccaatgaacctggaacaggtaatgctgtttagggaaccatttaaataattgatagatgattagcgataaatgaccgataagcatcaattattatttaccatttatcaattatctcgtaatcaccccttttattcattaaatgtcaagatttatagaatgaaaggattattttttttagggcttagtataggctctgtagcttttatccaggctcaggataaagattccctgaaaataagggaaattgaagcggtcaattttactaaaagactgccggtagcgaaggaaatcatcaacgtgcagaaagatctggacgggaaaaacctggggcaggatctccctattcttttgaaaaatcaaacttccattatttctacttcagatgcaggaaacggagtagggtatacaggattcagaatccgtggtgtctcgggaagtgcaatcaatgtaatgatgaatggtgttccgtacaacgattcggaaagccagggaacattttttgtcaacgttccggatttaaccagttctgcatcgcagattgtgattcagagaggagtcggaacttccaataatggagtttctgcctttggggcaagtattaatgttctttctaaagatccggaagagaagttttactttaaaacagatgacagctatggttcattcaatacttacaaatattcagcagaaataggttccggaaaattctggaaaaaccgcctttccgtaatgggaagatatacgcatattcactctgacggctatattgacagggcttcctctaatttacattcctataactttactgctttatttgaagaaggaaatacgaagctgcgcttaatggctttcggaggaaaagagaaaacttatcaggcatggaacggcattgaccgtaaaacgtgggaaactgatccgaaattcaatatttcgggagcaatatatgatgccagctgggaaaatattgtaggattctacgataatgaaaccgataattacagacaaaaccattatcagttactgtgggaacagaaattcagtgaccgttggaatcttgaaaccacatttcattatacaaaaggaaaaggatattacgaaaattacaaacagggagaccctttctcaagatacaatctgccggatattactgaaggaggtgaaactgtaaaatattcagatttcatcagaaaaaaatggctgaataacgacttttacggaattgtttccacattgtatggaaagtttgaaaatctggacctgaactttggtgctgtagccaaccaatattacggaagacattatggaaatgttaccggtgttttctttcctcagattgatgaaagtgaatactacagaaaccgttctgtgaaaaatgaggtctcaggctttgcaaaggcattgttcagactggataattttgaattttttggtgatttacagcttaggaaaatcaactacaataccaaaatcctgacagcaggtgatgatgaaggagcagatttaagcaaaaactggctgttctttaatccaaaagccggagttaattacagaattaacggcggtaaaatatttctttcctatgctcatgctcaccgtgaacccaacagggatgacctgatggcgaacaatgatgtaaaagcagaaaagcttcacgatattgaagccggttttgaaaaacagttcggaatagtgtcgtttactgcgaatgtctattacatgtattatgtcaatcagttggttttgaatggagaattgaataatgtaggagcattcatcagaacaaattcgggaaaaagttacagaagaggaattgaaatcggggctttggcaaaactatccaaacaatgggaaatttccggtaacgtgacattaagccagaacagaaaccaggattttaatattcagaatggtgatgtgcctaaaagtctcgggaatacccagatttctttctcgccgaacgtgatagccaacttgggtttgaaatttaatcctgcaaagaatttccagtttgctttaatgaatcagtatgtcggaaagcaatatcttgacaatacggaagacgcaaatcttcagcttaaagattatttcctgacagatttcaatgcgcagtaccagtttaaaattgccaataatgaaattgccttaaaacttctggtgaataatctgtttaacaaaaaatatgtcaacaacggatctgtttatgagggacagccttattatttttcacaggctggcaccaatttcatgtttggggtaagctggaaaattcaataattgctaaaaggtgaaaggtcttgtaatgatatttaaatttacgaatcagccttttggcctttagtaaatttcccctttttaagcttgaaaaaagaagtttaattaacagtatatctattttaatacataataatcaaaggactgtttcggtagtctttttttataaaggttaaatatcctgaaaagtcatgaaaaagttataaatttgctgccaaatgaatatttcagcatacattttagaatacttaaaacaatttggaactgccacggttccaggctttggggtgttttcactgaaaaattctaaggcaattatcaattccgaaaacgggagcatcttacctccggccagtcagatagaatttaccatagactatgaagtacaggccgaagatcttactgcttttattgcagagcagaaacagatgtccctggaagcttcaagaagtgatcttaaaatccagactgatttctggaagaaaaaacttcaggctgagcagattcttgaaattcaaaaccttggaacagtcttcattgaagaaggacatactcatttcaagggaaaaagaatagaatccggccgcccggacttttacggattggaagagatccgcatatctgatatcaataacggggaaaaggtaaatacttcagttaaccgcgagaaagattttaaattcagaaaaacaattctctggattttccttctgattattccggttcttggaattttatacctggcatttacccagcaggagcttctttttgggaaaaaatctttcaataatgtttccgtacagacctctactcacagaattgtaaaagatacggtgaaagtgatggcacataccccggaaacgcccgtttcagattctttgaaaaaagattcattagtaaaatctgtcggaaaaggcgtaaaacctgctccggctgttccaaacaacactaagactagatggcaaaaataaaaaaagcgtcagaatccctgactattatgaccaatatcgttcttccgaacgaaaccaattctttaagaaaccttttcggtggtgagcttttggcaaaaatggaccgttgtgcgtctatttctgcagcaagacactgcgagagaagagtagtaacagcttctgtaaaccatgtttctttcaatcatccgattccggagggtggagttgtggttttggaatccaaagtttccagagcattttctacttcaatggaagtatatgtggatgtatggttggatgatccgatcaatcagaagaaagtccacactaatgcaggtatttatacttttgttgcggtggatgaattcaaccgtccgattcctattcctgaaatgattcctgaaacagatgaggaaaaagaaagatttgctgctgcattccgtagaaaagaactttcactgattctttccggaagaatgaaacctttggaatctgtagaacttaaaaagttattccaggaaccgcaggagtctaagaaagataaaaagtaaacttaaacacaaataacacgaatgactggcacaaattttcacaaatgatttgtgcctgatcaaatgaaaaaaaataatatggatatttctgaaaatgatatatcaaaaattgtttacgaagcaggatatatagttcataaaaccttagggccaggacttttggaaagtgcttatgaagaatgcctgttttatgaattaaataaacatgatattcttgtagaaagacaaaagccgatgccattaatttatgatgaggtcaaaatggatgtgggttacaggcttgactttatgattgagaaaaaatttgtgctggaaataaaatctgtggaatcactacaggatattcatttagctcaaatacttacctatctccgcctcagtaattgtaaacttggaatgttgattaacttcaatacacttcagtttaaaaacggtgttaaaagagtaattaatgggatattataatttgtgttatttgtgaaataaattagtgacattcgtgtttaaactatgaaaatacttcttttagataaaaaccatcctctcatcactgaacagcttttggctaagaattttatcctggaagaggattttacatcgtcctacgatgaggtttgtaataaaattgaaaactatgacggaattatcatcagaagccgtattccattagatcagaactttctggaaaaaggtaaaaacctgaagtttattgcaagagtaggagccggaatggagaatattgatatacctgtcgccgaaaggctgggaattcaactgatcaattctccggaaggaaacagggattcggtggcggagcacgtggtgggaatgttgcttgttatcatgaacaggctttttattgcctcccaggaagtgaaaaacgggatctggaaacgtgaagaaaacagaggtgatgaattgttgggaaaaacagtcgggttgatcggatatggaaatatgggtaaagcaactgccaaaaggctttccggattcggatgtaaagtgattttccacgatatccttccgggactttcagatgaatttgcaacacaggtttcactggaagaactgaaacagtctgcagaagttgtaagcttacatattcctttgacttcggaaacgcattatcttattgatgaaaccttcatcgcagaaatgaaaaatgatttttactttgtcaatacagcaagaggaaaaaatgtgaaaactaaaagcttagtagaagcgttaaaagccggaaaagtaaaaggtgtatgtctggatgtattggaatatgaaaagtcttctttcgaacatttggaagcagaaaatgaggatttgaaataccttcttgaatcagaaaaagccattgtcaccccacacattgccggctggacccatcagagcaaagaaaagctggcgcagtttattgtagataaaattgtagcctcacattgctaagcaaatattgtgaaataataaaaagtaaaaagacggatttgcaaaagggtgattcgtcttttttatttttgtaactaataattcattttttacttctctattcatttatgttaaataattcataatatccggctcatatttattatttattttgagttttattaaattgccgctcatttttgaatctcatgacgacgcgtaatttactacttatcttaactgtttttttatctctgttttcttgtaaaaaaaagtctgaagctaaagaagtttcagcagaaaataccaccaatcttcctaattacggaagcgtagatctgggaaatgttttcacaaaagctgacggacaactcctgaacagacagtcaacggtaaattacatcgatcagtattataaaaaagtttgggaaggaggagatctcagcgggggaattcttgttgccaaaggggatgagattttatatgaaaactacagaggtttcggaagagaaggaaaccagatgccaatcgataaaaatacacctttgcacgttgcttcagtttcgaagacgttaactgcaatggccatgatgaagcttgtagaggctggaaagataaagatgacggatcatcttacccagttttttccgggatttccctatccgaatgttactgtacaaactttattggatcaaagaagcggtcttccgaagtacgaatattttattaccaaaatacagccggctccggcagaactttccaagccgttcattaccaatcaggatgtattgaatatgatcatcaaatataaacctgatctggcaagagatacggatacaggatttatgtattgtaatacgaactttgctttattagccctgttaattgaaaaagtgaccaaaactccttttcctcaggcgatgaaagaaatggttttcacaccattgaaaatgaataacacttacattttccaggaaaaagatattcctaccgcttcacagtctttctattacggaggaaataagctttatcctttagacagacttgatctgatttacggagataaaaatgtctacactacgccaagagatttatacaacttctcaaaagcaatgttttcaaaaaacttcctgaagccggaactgatgcagatggtattcacgccttacagcaatgagaaggcaggaatgaataactatggattaggtttcagaatgaagatatttgacaatggtgaaaaacttacttatcataatggatggtggcatggtacaaactctgtatttgcccatcttttaaaatctaaagtgaccatcgtggcgattggaaacaaatattcaaacaaagtgtatacagcccttgctttatctggtttgttcgaagatttccctttgcagaaagataagcttcataccgtgatgaatgataataaagattctttgaattccggacaggaagtttttggagaataatgtttacttttgcctaaacattttcatgaaaaggtttcttttattatttgttatctgttttcttgtacactcatgtgcaagggtaggatcacctgttggtggacctaaagatactctggctccgaaatttttaagctcaaacattgataccacaagaattaatgtcaaaagagatatccgtgagctccgtcttgattttgacgaatatgtgacattgaaggatatcaataaaaacctgattatttcacctcccattaaagggataacaagaatacttccttcaaatatagccaacaaatttgtgttgattcaatggacggatactcttcaggctaatactacctataatttcaatttcgggaattccattgttgataataatgagtcgaatgtactgagatatttcaactttgccttttctaccggagataaactggatgatctttatatcagtggagaagtaaaagatgcattggataccaaaaagaaagccggtacaactactgaaaataagctggtagtcggcttgtatcaggtgaaagatacgatggattacaagaaaaagccttactatattacgaaggtagacgaagacggatattatgaattaaactatctgactcccgggaaatataaaatcatagcctttgaagatgagaatggcaattccatgtatgatccgggcaaagaaaaggtaggtttccagaaagatccgatcaatgttgagaaatcaatttcagggttaaacttaaaagtctatccttccagaaaaccggtgaaatatgtagaaatgaaagaaattgccggaggagttttaatgacgtttgaaggaaatcctgatgaagtgaaagtacagtcgctgaacgagaagttaaaggatgtcaaaatcacacacaatccaaaatcagactctgtgagaatctggtttgatgccgtaaaagataatgtaggacaggatgctaatgaaaaactgatcttcacccataacaaaggtccgaaaaaagacagtgtctacagtgtttctttattttacagatacaataagaagaatgctatggatgtcttcagtgataatgacggaacttctatcgctccaaaagcagatttgaaaattgcatctaactatattattgataaaattgatccttcaaaatggactttaagagcgaaaggagacagtttgacaacaataccgtttaatgctaaaatctcggaaacaaacccttaccagatcttggttcaatctgattttgtaatgggaaaaagttatgagcttaccgttcctaaagaaacggtatcttcattctttgcaaaaaatacccagtcaaaacgtttcgattttgatgttgccaaagtagaccagttcggaagtgttgaattttcaatttcgaatgctccggaagccaattattggattcaactgattgattcttccgacaaggtggcatatcagaaatacacaaaaggagataaggtaaagtttgatatcctgagacctggagaatatattgtaagaattcttgtagataacaacggaaacaaatattgggatgaagcagatttcgccaatgacatttttgctgaagatgcttatatcttctataagaaagtgatcgtaagaggattatgggaaacaagagaagattgggacctgaaagataccagaacacttgatagcccgaaatcatcgacatcaacgtctgccacatcgacacctgctccaacttcagcacctgcctctgcttctgcaccagaaacaacggttccagctgaatctacaacaaagcccgctttgaaaaaagaatttaaatccggtaatgctgttttaactccagctaagtaagcaatgaagactgctaagaaaatactattctggacattggttgcatttgcactgattcagtttttccctattgacaggaccaataaacctgttgatgctgctgtcaactttgttgatgcaaggaaatctccggaaaagatcagggcactgcttaaaaatgcctgttatgactgtcattccaatgagacggtttatccgaaatacgcttttattgctcccgtttcatggtctgtaaaaagccacgtgaatgaagggagggagcatcttaatttttctgtctggggaacatacaataaggatctgaaggagaacatgcttactaaatctgttcagacgatccggaacagaacaatgccgatgcctggctacattgtttatcataaagaggccaatctttcagaagcagaaagagcattactgactcagtattttgaagaaatgctgaagaataaaacctattaatttctaccataaaaaaactcccgcagattttacaaactaagcatattgtttaaacagtagtatgcctgatctgtaaaatctacaggagaatttttacaaaaattatttctttacatagctctcgaaaaatctcttctgggaatcaaaagcgatatcctcaagatccagattctgtaaaggaatccagacagcttccgagatctcggagagttcaaggtttacctcaaacttttccggaacattgtattcataaaagagatcaatcgtattataatcaatttctttatattgatatacattaggaaggctggtaaggtatttcaggttggaaatatcaatatcaagctgaagttcttcaaaaagttctcttttacaggcttcctctgcactttctttagggtctacgaatcctcctgcaagatcgagtttaccttttttaggatctctgtttcttcgggtaagataaatttcgtctccatatctgatgacaaccgctacagcgcctgccacattattgtacaaagtaaaaccacattccggacagctccattttttttcgccatcccagtgtaaggactccttgccgcagcttgggcaatatttcaatagtttcattgagtaatattaatatttctcgggtgataactcaaaataacatccctcaattcttcagttttcaggtgcgtatagatctccgttgttgtaatactggaatgtcccagcatttcctggatataacgtaaatctgcgccattctgtaataaatgggttgcaaatgaatgtctgaaagtgtgtggagatatttttttgttaacccctgctttatctgtaagttctttaataataagaaacacgattactctggacatggatgttccacggctgttcagaaacagagtatcttcatatttcttgttgattttacctttggaacgtacttctttgatatagctgtcaagcagatccgcggtatagtcggctaaaggaacaaaacgggttttgtttccctttccgtgtaccttgatgtattgctctttgaagttgatattggaaatcttcagatcaatcagttcagaaacacgaagaccgcagccatagagtacctctatgatgcattggtttctttttccgagatctgtattgacctcaatagcagcaataattttgttgatatcaggaaggcttaaagtatcgggcagatataatcccagtttagggccttcaagcagtgccgcaggattgtcttcacggtattcatcctcaagcagaaatttgaaaaaggctttaatggaggatatccatcttgcctgtgatctctcactgaatttctgtttggaaagattgaaaatgtattcctgcagattttcgtaggcaatagagtccggaccgacgttttccagatcctcttctgcgtaatcttttaattttttaatgtcccgaacataggcgtcgagtgtgttttctgaaaaatttctttcgaaacgaagaaatatttcaaaatctttgatcttttcatcccaagtcatttgtgcttatttttttagttcacagtccgatatttgttctatttcaatattatggtttctcaggaacgatattccatcgtcatctgaatactcattaatatacaccagtctcgtaattcctgcctgtaagatcagtttgctgcattccttacatggagacagcgtcagatataacgtagctccttttgcagattgagtagaagcggccagctttaatatagcgttggcttcagcatgcaatacgtaccagtgtgttttcccttcttcatcttcacagcagttttcgaatcccgaaggagtcccgttgtaaccatctgaaataatcatcctatcttttacgataagagctcccacctgttttctcttacagtaggagagttttgcccattcctgagccatttttagataagctttatcaaacttattcataccacagcattgtttttttttcgaaataatttggattaaagtcttttagaaagattagaagttcggctttctcttctctagaaacgcagtaactccttctttcttatctgccatttcaaaaagttcgccgaaatatttaatttcagtttcaaaacctttctctgtgtcagatagattcacggcatttattgcctttgatattgccattggtgaattgtaggcaatagtgtttgctaattctttagttttggttaataattcttcaatagggtatacttcattcaccagtccgatctcttttgctttttgagcaaggatcattttggcagagaagatcatttcgttggcaatgccttttcctacaagtttaggaagcctctgagttccgccataacccggaattaaaccgagcgttacttcaggaagccctaatctggcgttttcagatgcatatctgatgtggcatgccatggcaagctccaaacctcctcctaatgcaaaaccgttaacggcagcaataacaggctttgacatattttcaattttgttgaacaatgtattttgtccgtttcttgcaagttcttccgctctttcctgtccgaattcgctgaattccttgatgtcagctcccgctacaaaagatttttctccacttccggtaaggataattaccctgcaggaagtatcagcattaagttcatccagtgcggaactgatttcctgaattgtttttgcatttaaagcatttaaactctcaggtctgtttatggtaataatagataatttatcttctttttttaataatatattctcgtaactcatttttccactttaaaatatcattctttgcaaattatgaattttttacaaaaaaaaggaaaaaatattatttttttttccttttttttaatttattattcaatatgattatttggaatgattcatcatatttgcatcaatattgacgtttaactgagaagccactttcatgccaagctcaatgttggcgcggaaaaagtgacataactgacggttgataatttcgtctcttttaggcccgctgataccgttcatactgcccacgatgtttttgatcagatgatctctgtcttccgcattcattgcttttgaatacaaaagtccaggttgggtatagtggtcactgtcattatcatttctgttgtagctggcaacatgggcactgtctaactcatattcgtagtttttataagaagggtcaggcttaatatcatcaaagctgttcgggtgataatttggtttatcctgataatggcttgagtctgccataaagccgtctctctgataattgttgacggcaaaaggacatctgttcacttcaagctgatgagaattgactcctactctgtaacggtgtgcatcaggataagagaataatcttccctgcaacatcttgtccggggaaaaactgattccattgatcaggctgcttggcgaaaaagtagattgttccacatgggcaaaataattgacaggaatttcattaagttccatttcacctacttcaatcagaggaaagtcatcatggaaccatactttggttacgtcaaacggattccatctgaaatcttttgcctgttcttctgtcattacctgaatatacatcgtccattttgggaaatctccgttttcaatggcattgcaaagatcttcctgtgcaaaatcaggattttcaccagccatttttacagcttcttcatctgtgaagttttttacgccctgctttgttttgaaatggaattttacccagactctttcatttttatcattgatcatagaaaaagtatgggatccaaaaccatgcatatgtctgtatccataaggagttcctctgtctgacattaatatgagaacctgatgaagagattcagggtttaaactccagaaatcccacatcatggtggcgctttttaagtttgttttcggcactcttttctgagtatgaataaaatcagggaattttttagcatctttaataaagaatacaggagtgttgtttcctacaaggtcccagtttccgtcttcggtgtaaaattttaaagcaaaacctctcggatctcttgcggtatctgcacttcctttttcacctcctaccgtagaaaatcttgcgaacattctgcatgagtttcctacctttgaaaacagttttgctttcgtatactggctgatatcgtgtgttaccgtgaaagttccgtaagctccgcttcctttggcatgtactatcctttcaggaattctttccctaacgaagtgtgcaagattttcctggagaataaagtcctgcagcaataccgggcctcttggtcctaccgtctgggaatcctgatgctcataataaggcgctccgttacttaacgttaattttttagaatccatataattgatgatttgaataattgtttttcttttctaaatccaagtgtaaaggtaatgaatatcaaatttacttgaatttttaattgctaatagcaaaaacgttatatctttgtaatagataatattaatcaaatgaacattcagcaactggagtatcttatcgctgttgataagtataaacattttggtaaagccgctcaggcgtgttttattacccaacctacgttaagtgccatgatacagaaatttgaggatgaactggatgtaaaggttttcgataggacaactcacccgatccgtacaacggatgttggcctgcagattattgatcaggcaaaggtaatcatcgagtctgtcaatgagctgaagaacaaagcaaacctcttgaataatattctgggtggaaccatcaatctcggaatcattcctaccgtttcttctttcattctgccaacggaaattttcaagttccttgaggacaatccgaaaattcagatgaatgtaaaagaaatgaccactgataatattattaaagctctgaaagcaggagagctggatgcgggaattatctctactccttatgatactgctgacgagttttatcaggatttcctgttcaacgaagagctgatgatctacagttccaatacagaagccaataagaagaattcttacatcattccggaagatctgaatgtagaaaaagtatggctgctggaagaaggaaactgtctgagaaatcagtttgaaaacatctgccacctgaaagaaaatacattaaagcctaagaatttagactttttagcgtccaatattcagactttggtgcatatggtggataaagtaggaggaatcagtattctgccggagcttgcactgagccagctttctgaacagcagaagaaaaatgttttcagattcaaaaaaccttttccatatcgcgagatcagtattatttattataagcctacttttaaacaaaaaatcattgatgaattgtcacattctatcaagagttctttagaacttaaactgaattatcacgaaagtccgaaagaatttgtaagcatcaagcctcagtagcaggaatgtcttaaagtgatagaaatcatcaatttaaataaaattataattaataaacaaaatttttgagtattaggaaaatagtacttaaatttgctgacgtttattacgaggaaaaatttgacctgattgcaacctctataaaaaaatgctaaaacagtattcttttttttgggcaatttcattcatatttttcgcaaacactattttaaatctttaaaaacaaaagaattatatgtcttatttatttacatctgaatccgtttcagaaggacatccggataaaattgccgaccagatttccgatgcattaatcgatcatttcttagcatacgataaaaattcaaaagtagcatgtgaaactcttgtaacgaccggacaggtggtattggcaggagaagtaaaatcagatgcttaccttgatgtacagaccattgccagagaggtaatcaacggaatcggttatacaaagggagaatatatgttcaatggagattcttgcggagtgatctctgcgatccatgagcagtcacctgatatcaatcagggcgttgacagagctgtaaatgatgagtctttcgaagctaaagcaaatgcacagggtgccggggaccagggaatgatgtttgggtatgcaactaatgagacggctaattatatgcctcttgcactggatcttgcccacacaatcctgaaagagctttctgccattagaagagaaaataaggagatcacttatcttcgtcctgatgcaaagagccaggtgacaattgaatattctgatgatcataaacccatcagaattgattctattgtagtttctacacagcatgatgactttggaactgaagaagaaatgctgaacaagatccgcgaggatatcaaaaatattctggttccaagagtggttgcacagcaaactgaagagatcaaagctttatttaacgatcagatcaaatatcatatcaatcctacgggaaaattcgtaatcggaggacctcacggagataccggtcttacaggcagaaaaatcatcgtagatacttacggtggtaaaggagctcacggtggtggtgctttctctggaaaagatccttctaaagtagacagaagtgctgcgtatgcaacaagacatattgctaaaaatttagtggctgcaggagtggctgatgaagttttggtacaggtttcttatgctattggagtagctgagccttgtggtttatatatcaatacttacggaacggcaaaagtagatctgcatgatggagatatcgcgaaaaaagtttctgctatttttgatttaagaccttatgctattgagcagaacttaaaattaagaaaccctatttatcaggaaacagcttcttacggacacatgggtaaagagcattatgtagctgataaaactttcaacaaaggacataaaaatgagcttacattgaaagatcttgaattcttcacctgggagaaacttgacaaagtagaagagattaaaaccgcttttggaatttaatttctctttaaagaataataaatgaactgctttatctttggataaggcagttttttttaattttacaccttataatatagaaagatgatgaattttagaactgtagttgccatcctgtctctgtttttactaagtacagccgtaaaagctcaatataccatgcataaaatgatcagcgtgggctatacctaccagaatcaaagttttggcgaagtaggaggtaaattgcttttccttaaaaatgatgatgtgatctacagattgggagggtctgcaatgatggggtctgtggattccaaatttgccattatgccgaaactgcaggctgatgttcttcttaattttgaaaagaatgtggatttctatcactcatattattttttagcaggcgttgaaggaactaataaatatattgcccctaagattggagttaccttatttggtatgctggatcttacaggcggatatgcttttcccattggagatacccgtctgaacgggaaagaaatgaaagggcttaatgttaattttacattaaatattcctactgtctttattcacgacatgtttaagtgattttttttagatttttctctataaaatttaataataggttaacagttattaaaaaattattatatttacatcataataatttgtaccgcctatagaatagactctactctagaactgttttgttgatacagcaaaggccagatgaaatatctggaggaatgcctgtctgcgaattatttatattgagaagagttatgaaatcaaaatcggatagtttactaatttccctttaccagaaaggagacgagggcgcattatcgaccctcattcaccgacatcagagagagctgtttacattcattttttacaaaattaatgatgaagatttagccaacgatatctttcaggatacattcatgaagattattgtgatgctaaaagaagggcgctacaacgaagaaggtaaatttattctttgggcgaaaagaatttcccacaatttaatcatcgatcatttcaggtcaaaagccaagaatatcaaagtttcagaaactacttttgaaacagatgaatattctatttttgatttaatcagagaaccttcggagaatattgaggatcagctggtgaccaatcagattcaggaggaccttctgaagatgctgcagtttttaccacaaaaccagcaggaggtaataaaactgaggttttttgatggcttgagctttaaagaaattgcagaccatacggagatgagcattaatacaacgttaggcagagtaagatatgctttgataaacctgagaaaaatcatggatgaaaataatataatattgaccaggtaaataatatttcaaataaattcacgttttaaagaaaaacatacttcgcctatgaaaaaaaatgattctttaaaagtgaaaactttgaaacctaagaaacaaacaatcgattttttgctcaacttttctaaaagccttgaaattgtcaaaagcaagagcaagaattaccctgtctcgaaaaattaaaattactaactttgtgctgtatgaaaatgcagcacgttttttttgacctggacaatacgctctgggatcatcgcagaaatgcctatcttaccatcaaagatctttttgaaaagcaggaaatcacttcaaagtatcacattgactttgaagaatttcattctgtttatcatgatatcaacgaagaattatgggaaaagatcagagacggaattattggcaaagagtatttgagagaacaccgtttttatgattcattcaaacattttggaatagataataaggagcttgcctcttattttgaagaaaacttccttgataatattgtgagttataatgaactggtagaaggagcagaggatgttctggaatatctgaaagcgaaaaattatacattacacattatttccaacggatttcaggaggtgacagaaagaaaatgtacattatccggaattgcaccctattttaaaacgattaccagtgcagattctgtaggggtaagaaagcctaatccaaggatttttgaatattctctggggctttctgaagcaagaaaagaagaaagtatcctgattggtgacgattggattgcagatgcaatgggtgccacagatttcggaatgcatgctattttcttcgatgtatataaagaagataaacagaaggaaggattaaaagctattacccatcttcagcagattaaagaatacttataaacataagaacataagttcacaatataaaagccattaagattatcttagtggtttttttgttgtaatattttctaaaaaatcaacgtaaacatctgtggttaaatcttaaattttaccatatttatttttcgccgaatcatttttcccaattctttcccaaattgatcttgaactttgctccagaataacaacagaaaaatgtaatcatatgaaaaatgtaaagaaaatcacaggagtattgatgatcatgtttttattgatgggaagttttatttctgcgcaggatagagcaatctctcccaatcagttgccgaaaacagcaaaaaactttcttgctgtccattttaaaggcatacctgtaaactcagccatagaagacagggaaatctatggagttgatgaatacaaagtatatctgaccaatggaatgaaaatggagttcgacagcagcggaaactggaaagaagtagatggcaagcaccagaaaattccatatggttttattccggtatctatcagaaattacagttcgaaaaactttcctaatacttacatcattaaaatagaaaagaaaagatggtcatataaagctgagctttctaatggactggaacttgaatttgaccgaaacgggaacttcaaaaagatcgacgattaacactaacactaaacactaaattttaatattatggtcaactggaatatcataaacagcaacggaagaaagatttcttctgctcagatcagaaagaatatagtttcatttatgacaaggaatcatcctggcagtatcattgactctattgaaaaaaaatacaacgcttacaaaattcatttaatgaatggcctgtgccttgtttttgatgcagacggccgaaatgtgaaatcaaattagattactaatgaaaaggaacctgagagaagggggcagagtgtatttccattttgtagatatcttatcggtaatttatcatatcactcttatactgatcatattctcgtagactttcagatgggtatctctgcctccggcttccctccttataatttcctatatttgatataagttaaccatgcagcagagtaaatagatccagaaatatgaagattttaataatagaagatgaacccgaactgaaagataccgtacagaattttctggaagcagaacatttcattgttgaatacgcagagaattacagtgccgggctggaaaaaattatttcttacgaatacgactgtattttactcgatataatgctgcctgacggaaatggtatagatctgttgaaggagatcaaaaaaatgcataagaaagatccggtgatcatcctttctgctaaagactctgtggacgataaggttgcaggtttggaaataggagctgatgattatctggcaaagccttttcaccttgccgaacttctggccagaatcaaatctgtgatcagaagaaaaaatcaggatggagagaatatcatccgttacaaaaatataagcattgatccggagagcagaattgtgaaagtagggaatgaagagcttgtcctgaaccgtaaagaatatgatcttttgtattattttgtgattcatcctgaaaagactttgcagaaaacaacattggctgaagctatttggggagattatatcgatcaggcggatagtctcgattttatttattcccagattaagaatcttcgtaaaaaattgaaaaccctccatgcagaagcagattttcaggctgtatacggaataggatataaattgatctgatgaagacttcattaaaatattatacgataaaatatctgataatgatcctgctgctgattatagcagtttgggcagggcttttttatgcctatatcctggatgaagtacatgataatgtagatgatggtttaagggaccggaaaatacagattatcaaagcggtttatcttaatccgcagcttttgaagaataacgagtttggattcaatgaatttaaaatcaatccgattaaagctgaacaatatcaaaacaaaagcaggctttataataaaatgtactacatggagtatgatgataaagaccagccttacagagttctggaagcagactttatcgatcagttcaagggtcatcagcggcttgttataagaacttcaacggtggaggaagatgaattgatatacgatcttaccactgccctgattgtgctttatattcttttggtgataagtatagtggtagtcaacggatatttgttgaataaggcaatgaaacccttctatcagattctggataagcttaaaaaatatcagtttggaattcctttttcccgggaaaagtacaattataaaatcactgagtttgaagaattaaacaaagcaatcaatgaaatgattgaacgtaatgagcttgttttctatcagcagaagcagtttattgaaaatgcgtctcatgaacttcagactcctttggctattgtgattaataaaattgatctgatgatccagaatgatgatctggataaaaagaaccttacttttcttacaggagtgaagaacgacctgagaagaatggtaggtttaaataaatctttattaatgctttccaaaattgaaaacagtcagtttaacaaaacttcaaacgttgattttaatggaatgattatccagttggttcagaattacgaagattttatcgcttttaaaaaagtagaggtcggtattattgagaaaggaaaatttatagccgatttcaatcaggatctggcagatattctgttgtcaaatcttcttaagaatgccgtcaaatacaataatgaggaaggtatcctaaatattatcattgaaaataacagaataacatttcaaaacagcggaacccctgtgtctctggatacggcaaggatatttaacaggttctataagcagggttcagatcatacttctaccggattggggctgtctatcgttaaaactattatcaggcagtatccgggatgggaaattaactatgaatatgcagatcatatgcattactttattctcactaaaaataacagcagctatattaactagaaaagcctttcaaaacgaaaggctttcttatgataaaactaggtattaaaatcctaagcttgttcttactcttttaagagtttcctgagcaataggtctggttttctcagctccctgctgtagctttgcttcaagctcatcaagattgttcatatagtaattgaacgtttctctttccttctcaaaacgtaccagaatcaaatccagcaattcctttttagcatgtccgtatccgaagtttccggcaagatacttagctcttaattcctcggtttgttcaggagtagcaatcagctggtaaatggcaaaaactttatccgtttcgggatctttagggtcttctaaagctttagaatccgtttcaatgctcatcacctgttttttaagttccttttccggtaagaaaatattgataatatttcctctggattttgacattttctgaccatctgttccgggaacatatttggtgtcttcctgaagttcagactgaggcaatacaagaatttcacccatctgattgttgaatcttgacgcgacatctctggcgaactccagatgctgaagctgatcttttccaacaggaacaatctctgcatcatacagcaaaatatctgcagccatcagaatagggtaagtaaacaaacctgcattcacatcctgaagtctgtccgccttatccttaaatgaatgggccaatgttaatctttgataagggaaaaaacatgataaatgccaagaaagttcacaggtttcagcgatatcgctttgtctgtagaaatatgttttttcagtatccagtccacaagcaagccaagccgcagcaatctcgtaggtattttgtcttaaagtctgcgcatccttaatctgtgtaagtgtgtgaagattcgcaataaataaaaatgattcatttccttcctgcttggatagttcgattgcaggaataatggcccctaataaatttccaagatggggtgttccggtggcttgaatgccggtaagaattcttgacatttgttacaatttatatttaaaaattaatgaatagcaaatttacgaggtttgaggggaataacgaaagataaaagataaaagataaaagataaaagataaaagataaaagataaaagataaaagataaaagatgttgttattaaaattcaaaaggggtgggctttagcccatccagcttaaaatgtaacatccatccattggctttagccaaaatctatcaatcccaaataatcaatctatctttgtcaatcatctgtgaccatttgtgtaatacgtggttgaaaaaaattaaggaatcgcaatcttctcccctccgaatttcggttctactccgaaaagaagatcccaatatgccttagctttggctgcatactctctcatattagtctttaaccctgcatacttattcacatcagctgcattgtacccaaaggcttccattccattttttcgggccagaaaaacggctctttcattatggaacttctgagaaatgatgataagttttgtctggctgaaaatatccttggctcttactacagaatccagtgtcctgaatccggcatggtctaaaataattttatcctttggaactccttcctgtatcaatgcaaactgcatatcctcaggttcattataatctttggtactgttgtcgccactgacaataatgtattgtatttttccgcttttgtataaatcagctgcagcttttattctgttgtagaaataagcatttggctgtccgttgttcagaagtttcccggttcccagcaataaacctgttttggcttcaggcagatcagcaatattataagaaacgaaagactcactctcttttttgatgctgtaattcgcccaggtaataaaaataattcctgcaaccagaagaagcaggaaaattttaaaaatatttttgattatttttttcatccgaaatatatcattttaaaactccaggccgttcgggaaagctttttttctgaatatcaataagaatgctgcccctacagtaatcgcagaatccgcaacattgaaaatatatttgaagaactcaatgtgttttccgcctatcaaaggccagctttcaggaacataccagtctaccagcgggaagtgcagcatgtctaccacacatcctttcataaacgaagaatatccatgtccaaaaggaacaagcttagagactccaccgtaatccagccatctgtcaacacttgcatcataaatgcttccgctgtcgaagatcattccgtagaacattccgtcaataaggtttccgatagcccctgcaaaaatgatggccattggaatcaaaagatagttggaggcaccttcttttaaccattttttaaacatatacagcattcctccgatcaggaaaattcttaggataacaagaaaatattttccgataatacctccgaaatgaaacccgtaagccattcccggattctcaacaaaagtaagtttgaaacccggaaaaacaaaaacactgtcgcccagtccaaaatgagttttaatataaatttttgaagcctggtcaattaacaacactaaaaaggttatcgctaaaatctttttcattactgtcctttaggttttgaaggctttgctgccggctttacatttttgttgtcgcttgctttcttgactactttctgtccgttgaacgagcttttaacgtgagctttttcaaatttaatgcccatttccttcagaacacttttcagtgcactcagctccatagaatttttaggatgtactatgatagattccatttcttttgtttaattgttacattttagacagttcatcgagtctctttctgtctttctcagagagatcattcactccgtttttgcccattttgctcagaagtctgtcgatttctttctcccgctcccgtttatcagaattgaatttatcatcaatagtatagtttttctgtggatcaggaaaaaatctgtttttgatccatgctctgttgaaaaacaacaatactcctgcgatgataacgcccaaaattaataattcgctcatgggtatacattaaaaattaggtttataaagtatccgtaaatacgatataaacccaatattattttacaaaccttacggctatttctgcatatttttcgcttcgatgctcagcgtagcgtgaggaacagccagaagtctttccttaggaatcagttttcctgtcactctgcaaacaccatacgttttgttttcgattctgatcaaagcatttttaaggtcacgcacgaatttctcctgtcttcctgccaaaatagaattctgctctttgcttaacgtttctgctccttcttcaaaagctttgaaagtaggagaggtatcatccgtcccgttattctggtcattgatgaaactttctctgataagctgaagatctttttctgctttttctattttttctttaatgatcgctttaaattcctgtaaatcagcatcgctgtatctaactctttcgtctgacatattctttctcttttttaataaaattatgaaatggaatttgaaatacaataactacatgttaatttttttcaatatttatcttaaaattaacctcatctatttcgatttcgttaaaatttgaaagtgaagatacaatttctattttatttgacaagacttcagaagaaatatattcctcatttttcttaatatcattcaagaaaggagagctttcttccaatgcaattgaaattttgtctgtcagttcaaagtctttgtcttttcgcaggttttgaattctgttaatgaactctcttgcgatcccttcagattttaactcatcggttaacgtcaaatctaatgccacagttgtttttccgtcagaagttactgtccaccccggaatatctttagtagaaatctctacatcatcaagggtaatttcatatccctgaacatctgtttttccttctttttctagaccggcaatctgttctgcattaagattagcaatctctgcacctaccatcttcatgtcttttcctaatttaggaccaagcgctttgaagttaggttttatctgctttacaattaagtgggatgcttcttcagcattaattaattgtaattcttttacgtttacctcctgcttgatcaggtctgcaacagcaagaatctgttcttctgttttagaatccaatacaggaaccaatactttctgtaacggctgacgaacttttacattttctttctttctcaaagagaaaaccatacttgtaatgttctgggccaaatgcgttttttcaaccagatcctgatcaattaagctttcatcagctaccgggaaatctgtaaggtgtacagattcacagttttcttttcctgttactttattcaggtcctggtacaattgatccataaagaatggagcaataggagcggaaagcttggctactgtttcaagacaagtgtataaagtctggtaagcagagattttgtcatcagaatattctcctttccagaaacgtcttctgcatagtcttacgtaccagttactcaggttgtcattcacaaaagtgctgatcgctcttgctactcttgtcggttcataatcttcatagaatgcttttacttccttgatcagaagattcagctcagaaaggatccatctgtcgatttcaggacgattttccacttctttttctgaatagttgaaaccatcaacattcgcatacaaagcaaagaatgaatacgtattgtaaagtgttccgaagaactttcttcttacttcatcgattccttcaatgtcaaacttcaggttttcccaagggttggcattggagatcatataccaacgcgttgcatccggaccgtaaacagcaagtgtttcgaacggatccacagcatttcctaaacgttttgacatcttttgtccgttcttatccagaacaagaccgttactcattacatttttgtaagcaactgaatcaaacaccgcagttccgatggcgtgaagcgtatagaaccatccacgggtctggtcaacaccttccgcaatgaaatcagccgggaatgctttgttgttgtcgattaattctttattttcaaaaggataatgcaactgggcataaggcatagatcctgaatcgaaccaaacatcgatcaggtcgctctcacgtttcattgcttttcctgaatcagaaaccaataccactttgtctactacatttttgtgaagatccacaagctcatagttagactctgccatatttccgatgatgaaacctttaaacggattttcagtcatcagtcctgctgcaattgatttctcaatttcgttataaagttcttctacagaacctatgattttttcttctttcagatcgtctgttctccagatcggcaacggaataccccaatatcttgaacgggataaattccagtcgtttacattttccagccagttggcaaaacgtccctctccggtagcttttggcttccagttgatttctttgttcaggttaaccaatctatcttttacagcggtcattttcacaaaccatgaatccagcgggtaatataataccggtttgtctgttctccagcagtgtggataagagtggacatacttctctactttgaaggccttgttctccgttttcaacaggatcgcaagttctacatcccatgatttctcaggagctgttccttcatcataatattcgtttttgatatattttcctgaaaatacctctggaacattttctcctttgatgaatctcccctgtaaatctaccaatgggacaaggttgtcattttcatcttttaccaacataggagggacctcaggctgagccatcttagcaactctcgcatcatccgcaccaaaagtaggtgctgtgtgtacgataccggtaccgtcttctgtcgttacgaaatctcctaagattactctgaatgcattttcaggattatcgtttggtgtaaaccacggaactaattgctcatatcttgtgtcaacaagtttttctccggtaaattcttttaatattctgaaaggaattactttagtctccggagtatagttggcaaaatcttcatctgtaccttctgcatattttttaccgaaaactttaggtaaaagaacacttgataaaactacagttacaggttcaaatgtatactgattgaaggttttaaccaaaacatattcaatatctcttcctacggtaagagccgtattggacggaagtgtccacggagttgtcgtccatgcaaggatatgtacatccccgtcaacatcgttgaacaatgccgaagagtctttcttcactttaaactgagccacaaccgttgtatctgaaacatcacgataggtacctggctggttaagctcatgagaagaaagtcctgttcccgcttttggagagtaaggctggatggtgtagcctttgtacagtaaatttttatcatacaattgcttcaataaccaccaaacggtttccatatattttgacttgtacgtgatgtacggatcatcaaggtctacccaatatccgattttctccgtaaggttattccagacatcggtataacgcattacggcttcacgacaagctttgttatagtcttcaatagagatttttttgccaatatcttctttcgtgattcctaattctttttctacacccagttccacaggaagaccatgcgtatcccagcctgctttacggaaaacctgctttccgttttgcgtctggtaacggcagaaaatatctttcaatgctcttgccattacgtggtgaattccaggcataccgtttgctgaaggcggaccttcataaaaaacaaactcaggatttccctgacgaatctcaacactcttattgaaggttttattttgtttccaaaattccgctacattctctgctacgtcaataaggttgaggtttttgtattctttaaattggctcattgtaaatatctcaatatcgttgattaattaagtctgcaaatttactaaaatttgtcggtttataatatatgttttattttgatatcatctattaaaaagttcaatttcagaaatataaataaaatgtagggtaaaagtgaatggtgaatggtgaataagtgaatttttccgggtgttatttatataaaatttagcgtaatttattcaataagagcgggctttagcccgcttgaacaataaaaggcaaatccaacggctttagccaacctagttaatgattgcgcaaagttcataaagatcttaagaatgggttaacattgttcgcaaaggcgcttcactcagcagatgaatacgggaaaaaaacaaaactggtttgaaaaaggctggtgcagcaaccgcttattggccggaattttgtacatttaagtagacctataaacccaaatgctgtatgaaaatcttctgcaaactgatggttactatctgttttatctatacaatcatcataaacgcccagaataattatcctcaaaactatttccgtaacccgataaacattcccatgcagttggcggctaattttggtgctatcaggacgaaccattttcatatgggactggacttaagaaccaacagtcaggaaaatttaccggttctggctgcagcagaaggctatgtaagcaggataaaagtagaaagatatggttttggtaatgcaatctacattactcatcccaacggttatactacagtatatgcccacctgaataaatatttcaataaacttgatgaatatgtaaaggaaaagcagtacaaagacgaaaagtgggaacaggatattacctttcaacccgggcagtttccagtggaaaaaggacaacagattgcattgggtggaaatacaggaggttcggcgggtccgcacctgcatttcgagataagggataccaaaacagaagaatgtctcaatcctttattgtttggatttaatattccggattctgtagctcccattatcagtggattgtattggtatgaccgtagattcagtacatatgagcccggagcaaacggaattgaagtgaaaaaagtgggaagtgcttacactgcagaggttgtaaaagtcagttcaccgaagataagtttcggaattaaagctgtagataaagctaatcagggatttagtcttggaatttataatgcagaactattgatggatgataaactgatgtacagttttaaaattgataaagtacattatgatgatacccgatatatcaacggttgtatagattatacgaaattcatcagagacaaagtaggaattcagcatctgtctgctttgccagggatgaaactgcaaaattatattttgcctgaactttcaggaattatcaatcttcaggatgaagatgttcacaatatcgaaattgttgtaaaggatgtaaaaggtaataccagcaggctaaccgcgaaagttcagttgagtaattcaggaagcggaatttcatcttcaggtaaaacagttgtacctaatgaaggaaaaacgcttacaacggaaaatgcagaaatcagtttcagtaaaaatgcactctatgatgctgtaaatttcaatgcctatgaaaaaacatccgctaatccggatgcggtttcgaacagtattattttacataatccatatattcctgttcatgacgactatactttgaaaataaaacccaataggaaattatccaatacagaaaaagacaaggctattattattcttgattacggaagtgacaaagattttgtaaaagtaaaatggaatgctgaccgggcagaaggacgatttaacagattgggtacagtgcagttggtgattgataatactctgccatccgtttcgccaggttggaatgatggtgctttggtcagcagcagttctttgagactaaaaggaacaacaaaagtgggggatattgtttcattccgggccgaactggacggaaggtggctaaggtttgcccgtgtaaaagatgattttgtgtatatctttgatgaaaaatgttcaaaaggatcaggctctcatactctaaaagtaaccacgatcaataccgcaggaaataccaacacccaaacttttacattccggagataaaagctatggtagaaatcatgaatacattttccgtgaatacatcttacaatcatgtaattttaaataaatttgctttttaaaaattaaaatcattggaatttcatccgtcaattgagaaagcagggattcaggaaatcaaaaaatttcaggaagaaaaacttcatgaacttttggtttacctggaaagccattcgcctttttatcaaaagctgtttatagaaaataatattaatattgccgatattcgtatgttggaggatcttcagaaaatccctacgactacgaagaatgatcttcagcagcacaatcatgattttttctgcataacacctgataaaattgttgattacagtaccacttccggaacattgggagatcctgtgacattcggattgtctgacggtgatcttgaaagacttgcttacaatgaagccatatcatttgcctgtgcaggaattcagaaaggagatgttgtgcagatgattacaaccattgacaaacgttttatggcaggacttgcttactttttaggcctaagaaaaatgggggcaagtgtggtgagaatgggaccgggaattcctgaactgcaatgggattctattttcagatacaaaccgaaatacctgattacagtgccttcttttctgctgaaaatgattgactatgccgaaaaacacggtttggattataaaaattcaagtgtgtatggagctgtgtgtattggagaaagcatcaaaaatcaggattttacagataatattctttcccagaagattaaagaaaagtgggatatcaaacttttttccacctatgcttctaccgagatgagcaccgcttttacagaatgtgaatttcagatcggaggacatcaccatccggaactgatcatcacagaaattctggatgacgaaggcaatcccgtaaaagaaggagagagtggtgagcttaccattacaactttaggggtggaagccattcctttattgagatttaaaacaggcgatatcgtaaaagctcactatgagctgtgccaatgtggaaggaatacgatgaggttaggacctgtgataggcagaaaacagcagatgatcaaatataaaggaacaacattgtatccgccggcaatgaatgatatcctgaatgatttcaacaatattttatgctatcagattgttattcaggccaacgaaatagggcttgatgaaattatcatcaaattaagcacagaagaagagcatgaaacttttgtaaatgaagtcagggatcacttccgggccaaattaagagtaagccccaaaattgaaatcattgatttcgatattctgtctaaaacagtttttaatccaaacagtaggaaacctattacttttattgatttgagatagattaattttttaaaggaaaacatgatattggtttttataatatctttggcgctgaaaaaattaatactatgaaaaagttattattgtttgtacttgctatgaccatgacagttgctgtaactgctcaaaaagtgaaaattcaaagtggagatcttaaatttctgaagggggttgaaactgtaaatgttatttttgactatgccgatatgaagttgctgaaagaaaattacacagaagaacaatacattccaaaaagagtagaagaactaaacagaaaaattgaaggaaatggagatatttggaaaaagcagtgggaaagaagtaaggaggaactttggaaccctaaattcattactatttttaataagactcttgaaaaagaggggattaagatgaaattgaaggaacatgcccaaagtccatatactttaaaagttaatgtgaagtgggtttatccgggatgggatgcagggataatgaagcaggctgcaaaagtcactactcagcttgtttttgtagaaacagcaacgaataagatagtttgcgatattgatagccaggaagcaccgggagatcaatggggtagtaacttcaacaatgaaacaagaataggtgaaggctttgcgaaaacaggtaaaacactagcacagaaaatagaaaaagaagtaaaataataaaaaaaaacggtctgaatttttcagaccgtttttttatgcttgattttgttgttcctgtttttccagtttgatcaggttcgcaagatttttaatcactgtatcatgtttctttacgaaaggattgtctttgttccagacataacccgctaaaactgcacatatctttttctttacatcagggttttccggctgatggaaaaatagctcctggagatttccggtataccactcttttacataggtagtgaaaacatccactccatataaaatataatctgtgtattccttctgccagtcaattttttctccgtttagctgccttaaagccagtttagcggccagcattcctgattctgtggcaaaagccattcctgatgaaaacacaggatcaaggaattctgaagcattccccgttaaagcaaatccgtctccgaataaacttttaaccgaacaggaataatctttcaaatgtcttggttcaaaaaggaaatccacattcccgaaacgttttacataatagtcagaaagagagattgcctttttcaaagcttcagtggtatctccgttttcagataatttgtcgatatattcagtaggtcccactattcctaaacttgtgtttccgttggaaaaaggaatgacccaaagccaaacctctgtttcgatgatgtcaaaagaaattaaagttccttcctctccaggttccctgttaatatcatgtacatgagaaaaaatagcggagtggggtgatagttttgaaggtttttcaaggtcaagaagacgaggtaatactcttccgtaaccgctggaatcgataacaaactttgcgtggatctctttcgtttccccatctttatttcttactgtagtcacagaatctgttccgtcaaacttaatatcaataacttcagtttcgaattcaagatcaattcctttattaatgacttcctgagcaagtgtattgtcgaaatcagccctgggaacctgccaggtccagtcccagccttccccgaatttgttgctgaaatcaaaaatgcagatttcgtcgccgcgaagaaaacgtgcaccaagctttttttcaaagcccattttatctaatgcagggaaaagtccggcctcatcaaagtggtccatcaccctcggaattaagctttctcccactaccagtctggggaattttgttttttcgactactttcacgttgacgttattcttctttaagtacgaagaagacacgcatccggaaggtccggctccgattacaagaacgtcaacaaattctttgctcatctttgattttttattttaataataacttttatctttgccgcaaaattagtgacaaataattaatattttacaaaattatcaactattacttttaattgatgaaaataaataactttttagaactgaaagactttcaaaaaattatcattgagaatgaaaaaatagaactggatgaatcgcttttatcaagagtggataaaagttttcagtttttaaaagagttttcaaaaaataaagtaatatatggtgtgaacactggttttggcccgatggctcaattcaaaatcagtgacgaagatacacaccagcttcagtataacctgatcagaagccattcttcaggtatcggaaatcctttacctgccgaagaagtaaaagcatgtatgctggcgagactgaataccttgtcactgggaaattcaggagtacaccagtctgtaatttaccttcttcaggaattgatcaacagggatattgttcctttaatatttgaacacggaggagtaggagcaagcggggaccttgttcagctggctcacctggctttggtactgattggagagggagaagtattttataaaggagaaagaaaatcaaccaaagaggtttttgaaacagaaggcttagagccgataaaagtagagatccgtgaaggtcttgctttgatgaacggaacttccgtaatgtccggaatcggtattgtaaatgcctataaagcgaatcagcttacagatatttctcttagactttcttgtgctatcaatgaaattgtgcaggcttatgatgatcacttgtcagaagcgttgaatggaacaaaaagacattacggccagcagaaagtagcagaaaaaatgcgtgcccatctggcggacagtaagctgatcagaaaaagagaagatcatctgtatacccattttgaagaacaggaaaaagtattcaaggaaaaagttcaggaatattattctttaagatgtgttcctcagatcttaggtccggtattggacacactggaatatacagaaaaagttcttgaaaatgagatcaattcagcgaatgataacccgattatcaatgttgaagatcagcatgtttaccatggaggaaacttccatggagattacatctctctggaaatggataagcttaaaattgtagttaccaaactgacaatgcttgcagaaaggcagttgaactatcttctgaatgccaagatcaatgaaattttgccaccttttgtaaatttaggtaaattaggtttcaatttcgggatgcagggggtgcagtttacagcaacttccactacggcagaaagccagatgctgtcaaattctatgtacgttcacagcattccgaacaataatgataatcaggatatcgttagtatgggtacaaatgctgcggtaatctgcagaaaggtcattgagaatgcttttgaagtattgaccattgaagctattacaatcattcaggctgttgaatatcttgggttccaggataaggtttcatcatctacaaaagaactgtatgatgatatcagaaaaattattcctgctttctcagacgatatggtgatgtatccgtatctggaagaagtaaagaaatatctgaaaggaatgtaactattagctgttatggattgtctttaaaatagatatccggcatcaatttttaaaaaaactaaaaacgatataaacactaacgcatgaaatgtgcaattgtaacaggaggctccagaggaatcgggaaggcaatctgtataaaactggctgaagagaaaaactatcacatccttattaactacgcttcaaacgaaaccgcagctaaagaaactttgactaaagtggaagaacttgggtgtacaggagaaatccttaaatttgatgtaggaaataccgaagaaacacatgctgttttaacagcatggcaggaaagaaatcctgatgcagtagtagaagtgatcgtcaataatgcgggaatcacgagagacggcctctttatgtggatgcagaaagaagattggaataatgtgatcaacaccagtctggacggattcttcaatgtgaccaatttctttatccaaaagctgcttcgcaacaaatacggaagaatcatcaatatggtttctgtatccggagtaaaaggaacagcaggccagacgaattactctgcagcaaaaggagctttggtaggtgctacaaaagcccttgcacaggaagttgcaaaaagaaatgttaccgtaaatgcggtagctccgggctttatcagaacagatatgactcaggaattcaatgaagaagaactgaaagcaatgatccctgccaacagattcggagaagcagaagaagtggcggatcttgtcgcatttttagcatctaaaaaatcttcctacattacaggagaagtgattaatattaacggaggaatttattcataacatggaaaatagggttgtaattaccgggatgggaatttattcctgcatcgggacgtctttagaagaggtcagggaatccctatatcaaggaaaatccggtattgttttagatcagcagagaaaagaatttggtttcagatcaggtcttactggagtggttccaaaaccggatcttaagaatcttctgaacagacgtcagcgtgtcagcatgggagaagaaagtgaatatgcttatctggctaccattgatgccttgaagcaggcgaatctggacgaagaattcctggatgcccatgaagtgggaattttatacggtaatgacagtgtttcccaggcagttgtagaatctatcgatattgcaagggaaaaaaaagatactacattgatgggatcgggagcgatctttaaatcaatgaactcaacggtaacgatgaacctttccacgatctttaagctgaaagggatcaatcttaccatcagtgcagcatgtgcaagtggttcacactcattggggctggcgtatatgatgatcaaaaatggttttcaggacatgatcatctgtggaggagcccaggaaaccaacaaatattccatggcaagctttgacgggctgggagtattctcagtgagagaagatgagcctgcaaaagcttccagacctttcgattcaggaagagatgggttgattccaagtggaggtgcagccacgctgattgtggaaagtttggaatctgcccaaagaagaggagtacccattattgctgaaattatcggctatggattttcttcaaacggaggtcatatctcaacaccgaatgtggatggccccgcgctggctatggacagagcattaaaacagtcaggattaaacgcttcagatatcgattatatcaatgcccatgcaacttctactcccattggtgatgccaacgaggcaaaggcaatttatgaaatcttcggcagtaaagttccggtaagctctaccaaatctatgaccggacatgaatgctggatggcgggcgcaagtgaagttatctactcaattctgatgatgcagaacgattttgttgctccgaatatcaatctggaaaaccctgataatgaggctaaaaagataaatttagtcacaaaaacaaaaaatcaaaaaattgatgtatttttgtcgaattcttttgggtttgggggaaccaattctgcactaatagttaaaaaatttgattaaaaacatggaaagggaaaaaattgttgctatcgttaatgattttctggtaaacgaattcgaggtagacggagacgaaatcagtaatgatgccaaccttaaaaatacactgggcctggatagcctggattatatcgacatggtagtcgtgatcgaatccaatttcggggtgaaattaggagaagcagatttcaagaaaatggtgacatttgacgatttctatacaacgattgaacataagattgctgaaaaaaacgcttagttattgagtaaatctttattctataaaatgtgccaatgtaataatatcacagtgcttcagtaatgaacacagcaaggtatattacattggttctctgttatattaaactggattatgaacaagtggaaaggtaaatctaaaggaacagtgctcggatacaggatattcgtctggtgtattagaaatatcggaatcagaagttcatacggagtgctttattttgtggcagcttattattcactgtttcagaaaaaaagcaaccaatatattctttattacttccggaaaagactgaattacgggtactggaaatccaaggcttctatctttaaaagctattttaccttcggaaaagttctgattgataaaacagctatttctgccggactcagagaaaaatacacctatgaatttgacggtattgaaaatctcagaagccttttagccgctaaaaaaggaggggtactgatcagcgcccatatcggtaattttgaaattgcagaacatttctttgcggatatcgacttcgactgccagatcaatctggtgaccacagatcaggaagtgacggttattaaagaatatctggaaagtgttgctgtaaaaaaaagtaacattaagttcatttatgttaaagacgatatgtcgcatatctttgagatcaataaggctttatcagaaaatgaactgatctgcttcaccggagaccggtattttgaaggatccaaatacctggaggcagaactgctagggaaaagcgcaaaatttccggccggcccgtttttgattgcctcaagattaggagtgcctgttgtctatgtttatgtgatgaaagagaataatcttcattatcatctttacgccagagtggctcagaatatcaaaaaccgtgattcgcaggggcttttacagtcttatgttcagaatcttgaaatgatgttgaaaaaatatccccttcaatggttcaattattttgatttttgggatgatgttgattaatttttctatttttatcccgtaaaaactaacgaaaaactaaaaccattaagatgtaccgagaattaagatgattaaaataatatttccggataaattttctttgcttaccgcacaaagtaagctttaaatgtcttaaattccctgtttcttaatcattaaaagcacattctcttttgaagaaagaatatgacatacttgtaatcggcagcggattgggaggtcttgtttcggctcttattttggcgaaggaaggtatgaaagtatgcgttcttgagaaaaataaccaatacggtggaaatctgcagaccttttcaagagataagcttatttttgatacaggagttcattatcttggaggtttgagtaaaggacaaaatctgaatcaattcttttcctacctggaaatcatggatgatcttgaactctatcccatggatgaagacggctatgacaggatcagttttggggatgatgaaacagaatatccgcatgcacaaggatatcagaattttgtggaacagctttccagatactttcccgaagaaaaagaaaacctcgagaactactgtgaggaaattcaatatgtctgcagccagtttcccagatatcatgtggtagggaaagaccattacaacgaagaaatcctgcatctcaataccaaaagattcattgaatctgttacccataacaaaaagcttcagtcggtgctgctgggttccaattttttatatgccggagactctgaaaatgttcctttttatgtgcatgccttaacggtaaactcttatattcaaagtgcctacaaatgtgtaaaaggaggaagccagatttccaagcttctgatcagaaaacttcgcgaatatggggcagaggtacataaacattctgaggtttctgaatttgtcttcaatgaaaataacgcattgacggccgtaaaaacaaagacaggaaaagaatatgccgcaaaacaatttatttccaatattgagatccgttccaccattaagctgatcggcgaagaaagattaaagaaatcctttctgaacagagttttaagctggaaaccggtttcatcctgctttagtgtttatctggttttaaagcctcacagccttccgaattttaattacaacagataccactattcatcggaagatctggtttggaatgcatctcaataccaaaaagaatcatggccggaaacctatatgctctcatccacaccttcaaaacatcatcctgagtttgcagaaagcctcaccgctatttcctatatggattttgaggaggtgaaagaatgggaaaatactttcaataccgtggcagatgaacatgaaagaggtgaagcttatgaaaaatttaagcttgaaaagaccgagaagatgctggatgcgctggaaaagaagattcctaatataagacatgctatcaaaacaatatacacttcttctccgttatcttacagggactatataggaaactttgaaggcaatatgtacggatacatgaaaagttctgagaatcctcttaaaacaatggtttctccccgtaccaaaattgacaatctgtttctgacaggacagtccgttaatatgcacgggattttaggagtaaccataggagcttttaatacctgtgcagagattctcggaaaagatacaatagacaggaggctgacacaagtgattaataaaaactaaaagtgaaaaaaactaataccatatattcattctgtaaaagaactcttctttattttaccctttgtttttcactggcatcctgcggaatttcaaagtctgttcatcatattcctgacgtaaagcaatactcattaaagattccggaagtaaacagagtcaacgacagcactttcagttacaatcagaattatcttaccaaaaataagcagcagctctgggagctttacatcaaaggaaatcctttgcagctgggatataataatggtgcactgacacagaatctcatgcagaggcaggaagaaatctttttctcaaaagtggaagggttcgttccatcaaaatttaaacaaagaatcttaagaggctttttaaaatggtacaatagaaaaatgtacctcaatgtaagagaagactatcaggccgaattatacggcttatcacaatactcatctgatcggtatgattttattgcacccaaatatctaaggagcctttacctgcacggggctcacgatatcgggcatgcgatgcaggatctggcgatggtaggctgtacctctcttgctgtttggaatgaaaatacagaagatggagaccttctgatcggaagaaatttcgatttttatgtgggtgatgattttgcaaaaaataaactggtagaatttgttcagccggaagaaggaattccttacatgtcggtaagctggccgggaatgatcggtgtggtttccgggatgaataaagaaggcattacagtaacgattaatgcggggaaatcaaaaattcctttgacggcaaagactcctatctcccttgttacaagagaaattcttcagtatgctaaaaatatagatgaggcgattgctattgctaaaaaaagaaaagttttcgtttcagaatctattcttgtaggaagtgctgcagacaaaaatgccgtaatcattgaggtctcacctaaaaatttcggagtttacaaagtgcagaataccagcagggttctttgtaccaaccattttcagtcggaagcctataaagatgacaaaagaaatcagaaacatattgaagaaagccattcaaaatacagatatgaaaaactacaggaacttttgcgggaagagaaaaagatcactccggaaagaatggcttccattttaaggaacagatcaggcttaaaagacaaaccgattggttatggtaatgaaaaagcactcaatcagcttctggcgcatcatgcagttatattttcgcctcagaaaaaactggcctgggtttcttccaatccgtatcagttgggggaatttgtctgctatgacctgaatgaaattttttcaggaaaaccattatcacaaagtttaaagtctaaaacagacctcaatattaaaagagatgctttcgctgattctgaagaattccaaaactatgagctgtctaaaatgtatggcaaagaaatcaatgaggccgctgatgataaaaacatgctattgacggatgatattattccttcttatcaggccatgaatcctgacttttggttggtttattatcaatccggaaaatattattttagcaaaaaagaatattcaatggcaaaaacagcgtttgaaaaagctcttacaaaagagattacaaccgttccggacagaaaaaatgtggaaaaatatctgaagaaaactttaaacaagctgaaatgatccccaaatacataaaactgctgttctgcattccttttgttattatcatttgttattcaatgtatttatgctcagtttacagctcaatacctgccactattccgattcacggatacggaaatatgaaagataactacggaagtaaaatatttcttgtgtttccggtgctgatgaacctggctgttcttatttttatctggctgattatcagaaggccggataagataaaatttacctttgaaatcaatgaaaatgaaagagaaaaaacatatcatatcacccagcttgctctggtaattattgcgatatttgttaccataatgatgacgccgctatcattttctgatgtggtttataaataaatgattatgaaaaaacttttaacccttttttttaccgtatggtttctgttatcattttctcaggacaggaaagagatcggaaatacttttatcaaaacattactggcagacaaaaatgcagagaaggctcattcttattttgatccttcggtagctggccagattcctgtagaacagctcaaagctattccggaacagcttcagggtcagattggagcactgaaaaatatccttgaagtgaataacgaaggaaatatttattatttctacaccgaatttgaaaagacaaaactggatgtccagcttacctttggagagaacaataaactactgggtttctttctggttcctcataaaacatttgaaaaaagagatgagaaaacagagttcaggataaagagtgatgctgttgaacttaaggggacacttctggttcccccttccgataataaaaagagactggtgatttttgtgcatggttcgggagcccatgacagagatgaaacaattggagaaaacaaaccttttaaagatatcgcagaatatcttttcagccacggaattgcttcttaccggtatgataaaaggatctattcctaccctgaaacattcaacgaaaaatctacggtagaagatgaaaccattaatgatgcggtaaatgctgctctttatttcaaaaataatcctgagtataaaggatatgagattattatccttggacacagccagggagcgtatatgatgcccaaaattgctgaaaaggctcaggtttcgaaatatgtttttatggccgggaatgcaagacccttgcaggatttgttagttgagcaatacgaataccttcactccctggacccggcgaatgttccggcagaagctgttcaggaaataaaaaagcaggttgcatttttaaactcatcccgatttaatctaaattcacctaaatcagaactacctttaggtcagtccgcagcatactggaagtatttgaaagattacaatcagcttaatgaagtgaaaaagatcaaggctccaatgctttttgtacagggaggaagagattatcaggtaactgagaaagatttcaatctttggaaagaaacattgaagaataataaggcagtagtttttaagttttatccggcattaagccacctgtttatttcaggttccggaaagccctcaccaaaagattatgaaacaaaaggaaaggtggatgagcagtttttgaaagacctgacagattttatattgaaataaataaaataagatcattgatcctcatgagtctggaattttgtttcaggctttttaattgctttccggacttactttattcaaaaataaaaaagaggcaattcctgcaattgcagaaaacgtagtgcttaagataaaactgccgataacgtattgcagcagattgtttttgatgagttcaaaatttaaatcctggcttaaaatatcactgtctccactcacaaatggcgcacccagaaaaagagaggcagcaatgataaaaggaataaaaggaggaaggctcacattggaggctacaaatgcaaggactttattgagcttgaaaagtacagacaaactgatcacaagaagggtctggaatccccagaatggtgaaagtcctataaatactcccaatgctatggaaaatgcttttgtacggttgctcccgtcactttctaagacatcttcccggatgaatcttttaaagcttttttttttgaagttattcacgaagtttctcggaataatataaaacaaagtaatcgttaccagaattgtattcagaatactgatccttgtaaaatccttgaaaggcctgaaatgggaaacccgttcggcgggatcatacaaaaccttaatcggaacattttttaccggaacatgcctccaggcagttcttacaatgatttcaatttcaaattcaaacttaggggtaaaatatttctttggaattttatgcaaaggataaagcctgtaaccggactgcgtgtcttccagcttgataccggtctcaaaccagaaccagaaattggaaaaacggtttccgaaactgctttttttaggaatgccatcctgagacatatttctgtttccaatcaggagaacatcttctttttccaggagcagtgcttctacaaatacaggaatatcatccgggtaatgctgcccgtctgaatcaatcgtgatggcatagtcaaacccgagtttctttgctgctctgaaacctgttttaagcccgcttccttttcctttgttctccggtaaagagattaccgtgatctgaggatactgagcaagaatttgtggtgtagaatctgtggagccatcattgaccacaataatactttcggtgtagttaagaacaccgtcaattaccctcttcagggttttttcattattgtaggtaggtattaaaacacatattttcttttcagaaattgcattttgtacttcagcaagggacatttttttattttaaagtggctctttccgcctctgtaatggttttagactgcattgcaaaccttttgatatagccttttaatgctgtgttctgtttgctgtaattgtttagcaggaatgccttatcatccttcatgcttcctcggtagcccacaattttagggatgttttcctgaacactcagcctgatcaggcgcaattctgcattgttaggattatttttaatcacattttcaaggcttgtagcccctgtttttaccaaagcctttctgttatttttgacaatttttgcctccatgatcttagctgcagccttgtatcctacagttacaggatcggatccggactgcttttctgcagtatcaataaagttttgcgtattggtattggattcattggctttggcatagctgtttctcagcgtttcaagatctgactgaaagaaaaaaacaaatgccgttataaatgacaggattagtttcatgaggttacttttttatagcttacagacagtttcaatgcaatagtctcgccaaaggaagttgtgttttttactttaacatcctcattgtcttcattaatatcaagctgaagctgtaaatccggagtttcaaaaggattgataatcgccatgaattttacattcgatgctgtttttaagaataattttgaaccggtaaattcctccgtaagttctttgatgatctgcatcatacaaacaccaggagtcaccggatttccaggaaaatgacctttgaaaatatcatggtctttattaagatgaatatgagcagtaaactttccgtcctctgccttctcgtatgatgttaaagtataaaagtctgtaagaatggtttgcatgatcttatttttaagattaaatatatcatcagtttctttccgggaagctgcatttattttaagcagtattcctgtaggaaattattccgtttcagttatttgaaatagttttatattgattttaaagtctttgtgctgcagctgtaagctatccgcgaagataggtttttttgcatcaaaagtaaaatcgattttttcattgttgtttttcgtgtaaacaatctgtttcagcaaattattttctttgttgaagaataaatagtagattttattattaattttagaaagataaatcttagcattttcattctcaaagctttcgcttaccggatattgtcttttcagcagctgctggaaatcatttttcagaaaattaatgacaatttttttatccagatcgggaagtacataattcagtttgaaatcctgatcagaaacttcaaaatcaatcagtttattcccaaagtctgacgttagggcaacgcgatgtgttgtttcattcagttttttgataatcagaataccgctcacatggtttttataaatgtccatctggcatttgtacacataatcttcaccggaagagaaatataagttttccaccatcttttcagaagatgaaacaggttttactgctgttaacttataggttttacaggaaacagccaggatcagaatcaggctataaagaaaactctgacgcaggaatggaagcattgatcttggtatttttgaaaacaatattcgtggtatctccggaagcttcagtcatattcacctgtgaaactgtagactggcttttagggaaatacagctcgatctgtttgatgtatttcagcaattgggctgttttaggaacaaacttcgccacattgtaattcccatttttaaaatatgttacggtaaactcaggatcattgaacatcgttccgttggaacttcctacaataagtttattgattttttcaaatgttttgctcttcgcatctacagacgactttttcccctgatcattgatgtagatcttattgcttttaaaaacgatactgtactgataaggttttgtatacttccagctcagcatattgggtgtctgcagcgacattcggccgtaggtcacaatacttttatccagaaaatccatctttttggtctgggtaaaatcactctgtaacgttttaatctctttggtgtctgaagaaaccttcgacacaaatgctttagcttcagctcctgacattgccgtattctgggcaaaaaagaatcctgaaaccaataagaatgctccgaaagcaatatttttaatcatttctatctgaatttaaaactgtatcaacagtaaaagttgaatattttttgtcctccaaaaatactaataaattagccagcacgcgaaaggtcttttctgaagtgtcatgaaggaggataatactgccttttttcaggcccttggttactctgttgtagattttcttttcatcgtcaatgatggtgtccagagaacgtacattccatccgatgcttactttatgggttctcctgattgctttagcaatattggggtttgtcactccgaacggtggcctgtaaagatctgtgctgatatttccggcatttttcattacttcatcacatttttcaatttcctcaatcatttttgatgtggataaaaagcctgtggaattggaatgtgataatgtatgattcccaatggtatgtccttctgcgataattctctgaaatgtctcagggtatttttcaatctgcttcccgatacagaagaaggtggcttttacctgatgttttttaagcaggtctaaaaatttaggggtaaattctgtaggcccgtcatcaaaagtaagggcaacttctttaattctcgtgcgtttatgagtgatactcttgacaaaatatcccagttcaatatcaaaagaaccccagactactacagcagaaaaagcaaaaaaacaaaacagatatacccaaaaacttccatggaacgcataaataaaaacgttacagaaaagatagaacaggataaagggataatgtttcattgctgactgttttattacaagttttatagtcgtaatatttattgtataccattgtcactccgaaggagtccagactaatttctaatttagattccacgcttcacttcagaaccttgttcgcagaccttttgtctgtgctctgaatgacaaatggactgtttagtttacctttctaaacgaattcgtcaattaaaccttttccaataacaccagactgtggtcattaccagccagatgattgtaaagaagaacattctttacgttttcttttttctttgcgttgatcatcatcacttcaggaatctgctgttctttaaggatatgacaggccataaaggttgaaaaaccacttgctgtattgaactctccactcagatgcttataatacagctgggcggaatccggaaaaagatccattgcttttatatagtaagtatctgaatctgcatccccgctgaaccctaagataacagcatcaatatcatgagttgatagactgtttttcgctaagaaattcttgataaaatcctgtacttcattcaattcaactttgttgctgatatggatattcttaagctgggcataagaattttcagttttatctttacctataacaaaaaagctggcaccttcgccccaaatcactccgttggtagtagaatgcagataatcagcgggaagatctgcttctttttttatggtattatttaaagagtaaagctccattgttctggcagtctgctcatctgtagagcctacaagaatgttttctgcttctccgtcattaatctgaagcttggcatctaataatgagaactccagcgaagaagaagtattcacatacgtgaagttgtaagcatgacactgtaagcccagagcaatctgtcccgctaccgtgttatgggtagattggatgaaaaaagtaggggtaagaaactcttcatgattatcaatcacatttttcaggaacttttcagagtcctgcgaacagcccattccggttcctacaataatggcatccggctgttcaattccggcttctttcagtgcataatgtgaggctacagaactcatttttactgttttggacattcttctgatcatggcaggcggaataaattccttgtaattgggttctacagccttaaggatgtttgaagaattttcaggatgaaggttctgaaggatattttcatttaaagtgtcctgaacggagatacaggatgcactgttgatgtatactgcactcatgattttgaaaaaattagtgttgaacagtttcctccgaatccaaatgaattggaaagcacatgattgatgttcttttctttcaattcggttaccggagtaagatcaaactcttccattttcgttttaaaattcaggttagggaagataacattgttttgcagggctaaaattgaaaatacagcttcaattcctgcagcagcagctaaagtatgtcccgtaaatgcttttgtagagctgaattcaggaacctggttttctccaaagattctgatcatggcaatgccttctgataaatcattattaggagtcgctgttccatgaacgttgatatagtctatattttctttttccaagccggagattttcaaagcctgctgcatagctaaaaatgcgccctgtccgttttctgaagatgcagtctgatggtgggcatcattggcatttccatatcctgaaagataagccaggacttttttattttcttttctgaccacttcttcggactcaagcaccaggaaagctgctgcttctccaaggttcagtccttttctgttgttgtcaaagggtgtattgtaagaatctgtaagaatcattagggtattgaaaccattcaacgtaaattttgaaagagaatctgctccgccgacaatcacgcggtccaatacaccgtttttaatcagttttgcgcccatcataatagcattggctgctgatgaacaggctgtactgatggtagaaaccatgcctctcaatcccagataatcagcaatggccaatgaggaatttccggcatcgtgtgcgtcaatatatttttgcttttcggggaagtcttcataagagtagaaatatttttcagtaatatccatcccgcctacactggtagatgaaatcagaccggttctgtacccgttgatatctgaaattcctgcactttctacagcttctttagcagcaatcatacccagtaaagaagttcttgtgacattgttgttttcatcaagatgaagtttctgtacaagctcttcattggataattttatttcacccgttttaataagtccggcgtgacgcgtttcaaacatttcgatatctgaaattccatgttttccggattgtaatgaaataaaattttcctccacattgtttccgatggaggaaatgatgcccattcccgttatggcaattttttgactcatggtactacatcatataacaatgcagcaatttaacaatttaccaataattgctacattgatgcactattagattgttacgttaatttattttgttctgttgttctcgatgaatgcagccattgtatcgatagattggaaaatttcctttccttttttaggatcagctaattttattccgtaatctttatcaagaagaacgatcagttccaaagcatcaatagaatccagtcctaatcctcctccgaataatggatcagcatctttgatttcttccacagatacgtcttcaaggttaagaacttcgataattttgtgcttcaattccgtttttaagttttccataattaagttgatttaccagtgtatcagtatcattaagaccattatatcattacactgttatattgttatattttataaggttagcaaatatacaaaagctttgtaattttcctgatacaattctacccagccgcacaatactttgtcagcctttccggatctgagaatctgttcggaataattgtttaaaaaattttcgtcaaattcgtccaaaatgaaaaaagcattttccgtctgcattttgtgcttaatactgatttccccgacacagatgttaggtaaagtatatacaaaaacagcgggacttggatagtaattgtcagaatcgttgatgctttcctggtatttgaaatcggtatccagactggaagatctgttggcaaaaacaatagctgttctgctgtggtcttcatccttcaggatcatttcagcagaaagaaaagccagtttactcagatgatccattttatgaaatttaggatagctgagttctaaatttttataagcttccttagcaaattcctggaaggcttcgctttgactttcaaaaaccagatctccgccaactgttatttttgaatgctctatgatacaagtgtttattttcttcatcacgctcaatttaacatttttccagcacaacagctgcgttacaaccaccgaatcctgaagccgtcttcagaatatatttaatttctgcagcctggtttttcctgataatattcaaaggctgggttattcccgtttcctcaaagttctttgatggaagtaaggtgctgtgcagagcactttccatagaaataatgctttcaagaaggcctgatacacccagacaatgcccgtaatagcctttcatactgttgagaggaatgttttgaagtcccattctgttaaaggcaatggcctccatttcatcgttatataaagtcgccgttccgtgagcagaaataaaatcaatttgttcagccgaaacattcgcttctgtcatagcatttttgatactggcatataagccatctcctgttctagatggtccggaaatatgattggcatcattgactgcagaatctcccagaattttaaacctgaatttttcgttttgtgagattgcttcgttactctgttcttcgtaaagacatgaagtgatatacacagctgctgccgcttcaccgatgttgattccatccctgtttttatcataaggcttacaaggtccggaaccaatggcctgaaacgagttgaatcctgaaataacaaattcagaaagttcatctcccgcaatcacgtaagcatctttatactttcctgcccggatcatatttttagctgccgcaatggccattactcctgaaacgcaggcattggaaaccacaacaggtttcgttttgaatccgaaaaaattggctattttttgtgccagttttgataaataaacgccttccggcaattcagactgattttttagcagactgatatttccttttgttgtggaaaggataaaagccgtgtcttctgacaggatatgttttttaacaagagggtgcaggcttaaaagaagcattttttccagtcttgtaaaattatcactgttattctgagcgtcgccgaagattctgccgaactcttcattaagttgatcagaatctatcatggcagcataacaagcatcctgactgcctgtgattttatgtaaagcaacacccgattttcctcctagaagcgcattccagttagattctgtattgaatcctaaaggggttacacaattgtagtctgtgatataaatttccttcctcatgataatcccattttatctttccagttttgaaaaaattccgggttgtaaaggcacagggttccgttactgtccaggaaaacctggatagtttcaccgctgcacaccaattgatcttcctgattgaaaagctcgtatctgtagatcagcttggcggaaacagaattgataaaagttgtcacaattctgaatgtttccccatattttaaaggaagaaaatgttcacaggtactttttacaatcggtgttacatacccggcattctgaatatcaagatatgtcaggccatgctgacgtccgaaggcttcccttccgtcctcaaaatacacgatgtaatgcccatgccagacaattcccagcggatccgtctcattgaaccgtactcttacttcttcagtacagcttaatatattttctttagactgcattttgtttcttttcgtaaaatagggaaacagctactgtggcaaggtaaaataagaacagtaaaaccagttctttggcaattccaccgatgccgctgtttcttaaaataatatcatagtaggcattcagtccccagttcattggagagaatttcgctatggtctgcatgaattccggcattaaaaatacgggaacccagattcctcctacagccgccagaactactacagaagttgctccaaagggagcagactgttcctgtgtatcggcaatcgttcctaacagtacaccgaatccgatggctgccaaccctgcaaacaaagttacgatgataagctgaaacatttttccggatacatcaaaggccggaagatccatataaggaaatagataaattcccaccgccaccatcagtaaaaactgaatgatgcagataataagataagtaaatgtttttcctaatatatgcacaaaatacggagtagggcttattcttgctcttacgcttgttccctggcttttttcctttaccagattgatggataaaggaactacaataaagaagatggcaaaaagagtccatgcaggaacgttgtgctgaacggaattcggcataacatccatttccccttttttcggggtgatttctttaaagctgatcaggtttttgttttcgtcaagattctctgtggtacccaactgatcctgaaatgccttataaatctttttattttcaatttcaaaaaccattttgttgacagaattcatcactgagtttttgaatcctgcgttggttgccgggtcgaagtataagtgaatttctttggcctttggaataattttattcacttttgcagaatctccttccagcccgaacgagcttacgatagtctgaaccttagaatcaatatttgaatttaaatctttcgttaaattgtcaggaatgacgattgccatctgatagtctcctgaaaaaacagcatcctgcgcagatttttcattgaagttggtcagcagccggaatgtcttgctgttttccagttctgctttgatgttctttgagacctcagacttgtcgttatcaataaaaatgatcggaatctttgatccttcaaggtttttaaaggtagaatcctgaataagggtaatggttacaatcaaaagcagcggcatcacaaaaatgatgacgatacctccgatatctcttttcagaagaagaatttctttaataaagcttctccacaatttatacaacaacatctcttaattcttttccggttaatgaaatgaaaacatcttcaaggttttctgcgcttgctattctgtttaccagttcttcaggggttcctacagcatggatttttccatgatcaataatggcaatttttgtacagaattcttccgcttctgaaaggtggtgagaagtatagatgatacaggttccctgcttattcaaatccaaaagatagtcaataattgcttttttagactgaacatccacacctacagtaggttcatccagaaagagaactttaggattgtgaagcgttcctgcgatgaggttgcagcggcgcttcattccgcctgaaaactgtcctacctgcttattggcaaattttgaaagtcccatgatctccagggattcatcaatggcttttttgagcaggttgtgctttaaaccataaaggcttccgaaaaacatcagattttcttttgcggtaagcgtaggatacaacgcatattcctgtggaacaattccgatgatctgtctgattttgaaaccatctttctgcggagacagtccgttaatggtaaactgacctgatgtaggctttatcagtccggaaagcatagaaattaatgttgttttcccggcaccgttaggcccaagaattccatagatttcatttttgctgatatttaatgtgatatcatttacagaaaaatcttcagaatttttgtatttcttatataagtttttgatttcaatcatattttccgccatatcagatcgcttttctcagttttttatagaaagcttcttccagatctgcaatatgcagcattgtttttgaaagttcattgtagatattgcttttcgaattcctgtttttatatacccttgcaatatcaacggcaaaatccctccaaaggtcaccaatagcagtaatttctttggataattcttttagctcatcatttttaagaataacagcagcttcctgaagaaatgctccatagataaatctgaagccaccacctccggttccgatttcctcctgcatcctgatcagctgccccagataatggttggttacttttgttccttttttctctgcccatttcgggatgcttttcgcgacccatctcatggcttttaccccgataagcggtaccggagccagcatatttttgcaggtatctttgattccttttttaatggcttcttcaagattcacattttcaggaacataaacagggtagtacatgtgtcctttcggaggcagtgctccttttgcgtatcttactttttccagttctgcttcggaaagggaagttgtgtaatccattaccggatcactgatcagaaattttccgtcttcttttccatagaccacaaggttgtgggcattgaagtggaatttatattcttcaggaaagtaagtaaggttgaaaacccctacctgaagccctgtcggtatattttgttccagatttctttcgagcgctttctgggcatccttaggatttgagaatttctctcttttaattttaattcctaatcttttggccgctttactgaaaattgcacccggcatcgggcggtagctgaagcccggagcaaaatttacctttaaaaaagggagatagacaaaaaacagtccggaaccgatcccgaagatcataggttcactaagtttaaggcctttgttgagcagtagattagaagcaacaccgttttcgcaatgcgcagtctgatggtgttcaaagtttaatttcatttgctgattgtatctttttcataggtaaaatgaagccttgcttcattatttcccgtcgaagttttttaattcatccactgaaattccgaatgcatcggcatattttttcagtgcagtttcgcttagtgttttgaatacttttggtttaaaatgtcttttgaccctccattgccacattcctacataagaagaaagaacgccaatatccattttattcagttccataaaataaacgatggggcttgcggtattattggccacatttttccttgcttcctcaattctttcatgaataagttccatcgattcatccagagcagctttcttggcatcccagcctgtactgtttgctgtcgtgtaattgtcattctcatccgtcacatacaggacttcagtcatgttggcggatttcaggttactttcgtcttgaggcaggtcttgttttttcatctaaataatgttatttttttagattccagatgagaaatggttcacctgtttttgattcttttaatcaggtggctaaaatagtgaaaatacattatatgtaaatcatattaaatctgaggagttattacttcaaaactgaggccgtattaaaacattttgcagattccaacagaaaataattatgttgaattactggtattataaagttttgttaattatttcaaatatatatattgtttgattgttttatctatatttgtttcattcaacaacaaaaactaataacttaaaacgaatttaaaccatgaaaaatttaaggttacttacaaagaatcaattgaaaaaagtaaaaggaggaatcacagtgtatatttcttgtgctaatggcaccaatggccaaatccgtaacgtggatatcaataccgatattgcaggtcctgctgagcagatttgcggaggaaatgattatgaagttgttatttagaataatttataaagatttaaactcagtcatgatgtagcttacgtcatgacttttttattccttttgcttgataataagtgttccacggatttataaaatgtttcacgtgaaataattcaatttctgatgatatttaaggtgttttattggtttgattatcagtagtttttagtgcgttttttattgaagttgaaataaatataatgaaggttttattgtaagattttataatcaactcaatagaagcgggctttagcccgcttgcagataggaatcaattcaattggctttagccgaaacctgattcatcacaaatgtcaacaatctggagtgcaatagtaaaaaaagctgcacaaaaagtacagctttactatatctatattcaattgaattttacgattttacttcctgaataaacaggttgatttctgctctgatcaataattcatcatgattgaaggtttcacaaaatatatggcagatattctcaaactgcgagataagtgatgccctggagataattttgtcattcacctttggaagagcaaaaacctcaattttcttgatattggtaatgaagccaataactttggtatctgcttcgggattttcgaagaagctttgtccaagaatcgatgagcaggtttgggccaggttttcaattaatccggcttctacaaattcattattgtgaacaaatatattatcttctttaatttcaaaggaagtcactactttttctttggtcagttcaagaatataatctgccataagcatcggctcgcgatgtggtaaaaagttgtgtatattgatgatattttcttcctttatttccatttcggtttattttacagcggttttcatttgagattttgcaatcacttcaccgttaagtttggttacgatatctaccagggttactcccattacttcattcagaattgttacctcagacttcagatggtcgccaattttaggcagttgttcagcttcaaaagacttaatggctcctatatatccggtaggtgcatcttttccaagcaggtaatatttatatcctgtatgtaaagcaacgctttgtgcctggtgttcaataagtcctgaggcctgaaataatccatcctggataaagaggttatcttctttgatttcaaaacctgacaggagatgattttcagaatactcggtcaattcatgtaccatcacaaaagggaacctttgcggaataagactttctacaaaatctttatcagatgtcggcagcttgttttccattagcaaacggttagtaaagcacatgaataagcaaatcttccgctttcaggaacacaaagaagtactttttctccttttttcagtcttcctgaattcatcagttcttcaagagcaataaagatagatcctgctccaatgtttcctacttctgaaaggttatagaaccatttttccgcagggaagtccattccttttttagcaaattcttctttgagtccgtctttgaaatagcccgaagagatatgagccagcacatgatcaattttttcaggatctaaattatgtttgtcaaaagaagaccttaaactttcagctccttttacaaggatatatttatccagaattttcgtatcctgtttgatggcaaaaatagattgtttcagccattcatcagaagggtaatctgcccatgatttcaggctcccatcttcaagtttatcacatccggcatacatacatgcctcaatttcgtgggcatatgaatagaagtcaatgaattctatctttaatgaagtgctgttttctcgtggcttattttccaaaagaaaagctcctgctccgtcagaaagcatccatctcaggaattctcttttgaaagcgatgataggtctttcttctaataattttaaattttcagcttcatggttaaatttatcagcagtcatccatgcagacattctttcggagcctgcacatacagcattttcctgtacgcctgcttttacagaaaggaatccgtaattcagcgcattcattcctgaattgcaaagacctgttgaagtattaatttcaatagattttccgatgttcagttcaccatgaaccatcgaagcgtgtgatggctggatctggtctggtgaagtggttcctaccgataataatttcatgtcttcctttttgaaattttcatcaaaaaggccttcgattgcttttgccgtaagctgcgcattagagtgtgtaggatttccttccttatctaaagcatagtatcttgttgtgattttattatttcttagaataagtgattttgctttggatggcgcatcattgataagcccaagataagtctccatttcatcattcgctaccggctcattgggtaagtattttgatgcttttgttataaatacgtcgtacattctattttaaattaattccttgtaaatatcttttttgtttttgtcttttaaaccaaaatataggggtggtaagaaggtgtaataccaaaacgacaggtgagataatccatatcgcggccatcaaatataccttaaagaattttatcagcaatggacgtttctcttttttcttgataatcagattagaccatactgtgaaaattttatttcctaccttctctacacgtaccagaaatgcacggatttcaatggctccgtatttaacaagatccggttgcagattcatcagatcattgttgttgaaatgtctttcaataatctcgccatactttacagaacctgcaatttcttcatcagaaacaccggctgccggaagcattcctgatttttctttccggcctgtggtaagccatctgagaatggtcagtacgctggtataattgtcatgtctgtctaccaatgctatatttccgacaagttttgcctgcagatctcttaaatatacttttagtttttcctgggaaagcatccacatatttcgggttccggaaatggtaactacaggagtatctttaaggataaggcctgcatactcactttttaagaatgaaataataggaatggatggtgtgagataccatacctgatatccgaacaggataagatcatactttttattgagaacttcttctgaaggtggaaggatttcttttggaatctgcagataggattcgggaaaagtgttgaaaaaaacatcacttggccagggaaacggaaagtcttccttgagcttaatattataataggtaacatcatatttctccttttgagcttcaaaagggctggcgatgttcttcacaatatcctccagttggccggtttgtgaataatatatgacaagtatatttttcttcattagttttctttagggtttacaaaaatatgtttttcatatttattaagtagatttaaatacttttatgaattcagaactgaatttcagtgtataattttcactttgaaaccaggtgttttttgcatttacgaaaatgatagtttcaggaagttcctgaaggtcactcattgtagaatgctcatctgatatgagaagaacgtcaattttcttattaatctcagaaaggtctttgatataatgtatttttcttctttttaccagatagctgtgcgcggcagtttccctcttttcatcgttccggatcatagagaaaattcttctgtttgcctgatataatgttaataaagcatctttttgcccaaaatcatcagctatatgaaggatgccggcgtcattgggaatatgcttgttaagctcaaaatatactgatttgttggtgttaaaatcttcttttacgtctttcactacttcactgtctttgtaaagatagctcaggaataatttcttcttaaaataattttcatcctcaatctcttcccgaagttttgcaaactcttctctgaagtaagcattgatctttttggttctctcagaatagtttttaccaaaattcatatcatctttgctgattctgctgcccacttttacagtgatactgccatcatagataataaagtctccttttggcaatacttcagaatttccatggatgtagattgggagaatatccaggccgaactgttctgcaagataaaatgctcctttatgaaatcttttgatgtcattggtataagaacgttctgcttcagggaaaaccactaatgagtacccttgttcaactttttccttcagtttttccatcccattttcaattccctgtgatacggggtaaaacccaagagctcttaccagctttccaaaaataggagactggtatacccagtcattcacaagatagatgattttatgagtcgtcattgcaatcgccagtgtatccagaaaggatgtatggttggcaatgatcactgccggtttgctgaaatcttccgacggattcttaatgaccttcttctttacaaaaggattagaataaagaacagaagttaaaaaccttgctaaaattattttgataatattcagggtttttcctttggaatttttgacaaagaagcttccgaaagcggaaaacagtagtccgccaattccgtaatacaggaatgaaaatacagaccatatgaacagtctgaaagtaatcggtgaaagtccttttttcgctctgttggtaatcagcagtctgaaccagaacggatatagggtagaggtaataataataaccgagaacattccgattaaagcaaccaaagccagggaatgcagagccggatgtttggcgaaaatcagggagccaatggaaagaatcgtagtgaaaacggcaagaataatagaaattctgtatgtaggcagttcattttttccagtggtatgctctttctgcatggcttgcgtaaggaaaatactgaagtcatcaccaaccccaaaaaccaatgtgcacactacagtactgaaaatattcagttcaagtccaagaaaatagaggattccggctgtaacaactcccgttaaaacaatcgggaacatggtaagaaccgttaattcaaaatttctgaaaaaaacaataatggttaaaataatggctagaagagagtagttgatcaaggtattgaaatcccttttcaataatccaaggaaattttcattcatctgctggcggtcaatagcaatagcatcatgcttcttttcaatatctttgataaaagcatcccttttcttttcgtctacttttacaacgttggaaacggtataaaaaccattctcgctgctcatgaattctgaaatctgaagcgctttaacttgttgataatccttcagttttaatacagaataatctttatgcaaaacttcattgaaattatcaaatgcagaactgttgaaacctaatttatttccgttactgatcagctcagaaatggtctggcttttctttttctcattccagaaactgttccattcatcaatctttttctgttggtctttttctgaaagcacaacacttccaattgaattgtagcttaaaattttgccctctttcttctctttttcaaggaagctgcttagttcagagtttctgcttaaagcatcttcttcagaatttccgtaagaaatcgtataaatagattttgaagtgatgtcggaaagcttctgtagctttgcttcactgatttttaattctttcggaatataattcagatctccaatgtcttcattaaatcctacatgtctgaatccaaacaggcaggccagaataataatggaacagcctatgatcaaaggcttgtttttttcgtacggataagagccaatcttatcaataaagttggtgttcaggtgttctcccttttcttttggtttataaagctgaggaacgataatcaatgctgtgatcgaagaaagaatcacggtaatggctgcaaaaagtcctaagtccttcaatgcttcagaacgtacgaaaaccaggcataagaatgaaacggctgtcgttgcgctgcttaatatgatcggttgggtaatctctttataaagttcttcaatattattgttatgcttgtaatgggtaagaatatgcagggcgtaatcaatggtaattccaatcaaaatagctcccacacttagtgaaattgccgaaatcttatctttaataaaataaagaaccaataaagcaagcaatacagaaaatactgttggtaaaaaaacaatgatgggagtaaagaaattcctgaaataatagatcagaagaatcaaaaggacggtcatagaaatgacaactgtattctggatgtcttttttgatctgttttgcgttggccaccgcaattacaggggaaccgaaatagctgatttctgtttttcccttgaactgcttattgatgccgtctttgatggaattgagctgatctacaaatgcttcattggcttttgtgtcattgcttttgtttttaggatcaatgaaaagcaggaggtttttgccgtcttttgttacaatatagctgtcttcaagtttgaagtctttgctgatgtttaaggcatttaatttttttattcccaaaaaagtaagtcccaaaggatcttttttaataaactctttagtgacaaggcttgtgggagaagccagtgagatataattatcctctacctttttggcaatgctgtctttttgcaatttctgattaagctccttatagtcattttcattaaggaagagtggaaggttctgattgacaaaatcaaaagtttctgaaatctcattatcattcactttaccctgaacggaaccgatatatttttgcagaggctcaattttttttaagaaagtatctgccgtttcagaaagctgaaagctatcttcgccggatttgttttcaataataacaataattttatctgaaaaattgagttgcttgagaacttttgctgtaagatctgatttttcatttttagggataatctgattgatgtcttcctcaaaattgatctttgacgcaaagaaaatgcataaaacggcaattcccatggctgtcagtacagatagaattttatttttggaaatcagataatataaaaatataaaaaagcgatgcattgcatttaaatcaagtctgcaaatttaattttttaagtattagttcaaaatatttagcaataagttttgactgaaaatcaataaaatattctaggatgattcaaaaaatattctacttttgcaaaagttcccttttgaaaaatgtattttaaaccacaattattattaaaaaataagaatctgttttagatatgttgaaaagaaatgatgaaaaaataaacggatttctatttgtaatagtacttccgctcctgttgtttgcgatgtcttattatggatttgaatcctcttatacaagactgaaaacatcagaaaaaacgcctgactttttgttttcctcggtatatgcttacagagtgattcccaattatctgagtgtgcagatgacggatctgatgtattatctcatcaacggtcctctgtctttctttaaagattttttgtccaaaaacggaactcctttttatcacggtcttttcctgatgaacagtgttttctttattttatgttccctgattttgaatgctgtttttcaactgaaatcaacaggccttcttctgaatcttaatgcaagaagaatcatccatcttctgtctgtatttttcattgtaataacacagtatgcgccgacaaactgtgatactatagcgcttttctgttatctttcgggtgtttttttaaccctgaaatattcggataccggaaaaaatattttcttttttattcttatcggcttaattgcaatctcaactctggtaagagaaacagcctgtctgaatattgccttttttgctgctgttttttttaatattgacgatttaaaaaaaggaaattatcagattatctggaaaataataccattggtggttgcttttctgattccttatctgggattaagagccatactggtacaggaagaaactacttttgtggaagggttttatatcaacagaaacttttccagtcctttcaatcttgcggggctggtatttgcgttaattgtgatttattttatatataatctttgtacagcgccagaaaacaggagtgttttcggaaagtattttttcttttccattccttaccttctgatgattactttagtaggactgtattgggaggtgaggctgtttctgcctttaattctgaccggaataatcacagcatatcatcagtttaaaaaaacatccgagatttagcatgagtttactacatccatattatttagttgcaatcctctatatgctgttcttcagttttcaggaagtgtatggaaagaaggttgataaaaaatggttctggttccttgcggtttattttatcattattgttggttttagaaaagatgtaggtccggattatggaagttataaaggaatttatatttactctgataccaaaagctattacagtatctttatgaagatgctccatatggaaggaactgacaatctggatgtggaatggctgtatacgctcattaataaaattcttctgaatatctttgatgcccctttttatatccttacattggtcattgctatttttgcaatgatctttaaagtagaatatacggaagataacacattttatccttttacctttaccctttttatgtttattcctaacttctttataggagaaagcggacaaatcagacagaatctgggcacctttatcgtttactttgccatacggtatattaaagaaaggaaattctggcattacttattttttatattcataggatcaggtatacacagtgtatgttatttattcctccccatgtactggctggcacgtgtcccgatcaataagacagtgatgctgattatgattgtgggttcagtctttttatctccttttgagatatacaggagttttggtagtctattagatggaatggcttctgacagtaccctggtagaagggttcaacggatatattgatcagacggcgcagcgattgaacgggggtattggaattccggaggtgatgatggctattcttacttttttcctttttgcttttgataccaagatgaaagaattatatccttattacgaataccatagaaattatgccgtaattggaatatgtctttactttatctttagaaataaccctgtattctcgtcaagacttgcgggtgccttcatcggatttgcctatattataattccaaatgcaatgtacgtggtttcaggaagagtaagaaatatgatctatgcatttattatttcactggtcgtgttcaattttgtggtctttgctatctttaacaatatcaaggcagggcgattttcaattgagagctatcagaactacattcttccatagaatttgaaaattagcaatatattaattataaagacagtcattaggctgtcttttttttgtgaaaaccttgttcatgtttgtgctgtttactagctttgtttttaaattattaataacataatttaaatatgttgtttttatttataaaataaatctctttttgttgatataggcttaaaaattgcacttgggtaatgacactaaattataaggtatgaaaaggttagctgaaaaattagcggcagtcttctgtctgatatcattgggaatctgttctaaagggaatgtcagagaaagcttttcctcaaatgggcatattaaagcagtctggattgctgaaaagacggactcactcgctaggccgttacccgaattgacgaaattgttccttccggattggaaaaaagctcctaacagttacatttttgatcccggtcagaatagtgagggattgctggttccggtaaaaaaagcgtatgcaatgtgggaaggcggcggatatcttaacgggagtggtattccggctggtgttgtaacagcggatgttttgtgggaagatgttcatggacttataaaatcgggggtaaactatgctctggaaataacaggaaccggacaggatgccaagataaaagtcccgattaataaaacaaaaaagggaaatgccgtcattgccttcaaagtaaatggagaaatttattggagctggcatatttgggtgacggatgatcctacaaacggctccacctacaaaagttttaacaacattaagagaatgaaatcagacggaaccactgaagttattcctgactctgactggaaatggatggatagaaaccttggcgcaattacaagttctatcactgcatcagactggaacagaagcattggacttttatatcagtggggacgaaaagatcctattcctccattagttacaagaggtaacgatttttatgaagcttcagggtcaataggcagaataagacatagagaagcaaagaatattaacaatgctgtaagtattgatgacctcaggaaatttgttctgctttctgcagctgaagtaaccaataatataagactttctgtaaaaaatcctttgagccttatttatgtgaacaaagatgataactccggtcaggcgtactacaataataatctcaaccttcctgtcaattggtttggaaaatctacaaccttgcccacgaacaggctttcagaacttaatctctggtctgataatgcgcaggggaaaatagagactgtttacaatactgatgacaaagcaaagccttatagagataaatcaccttatgatccgtgtcccaacggatggcgaattccctctatgctggttgccaacctggcttcttcatcctatgtggacgatatcagaatagacttttcaccttttggagtgagaaccaatatggcgaaaaatgtttttgaaaccaataaataccatatcattaagcctactaatgcaggagttcctgcttttatgacgggatttaaagtttatcccaactggggttttgatctgtcagctgtcggaggatataatatgggaatcttcccaggaaacggacagctgatcagaggagcccaccagggacagtatacagatcagcatcacactgcactttggacagcgactatggcccggcagtttgatacctctcctgctgttacggtcagaggactttctatgattccggataaaacgcagtcagatgtcccggatgcaaattatcctactattaaaggacgctattattactttcctatgtccgtaatgtacacttcggatgcgaatggctgcagatgtataaaagatcctctttacacgatcaatgactatgattttccaacagaatatctccctgcagctacagaatataaagaagggtttaataatccgaatacataccagattgtaaaaagcggagctgtttctactattgaaattccggtcagcaaagcattctctgtacaaagtcaattactgaataatactgaaatattaaacccttccagttttaataatttaaaaggaaatgtcctttggactaccaatccgggtcttgtcaataaaattacagtagtaaacccttcaccttcgtcactgcaggatatcgcaaattctaaaatagttgtggaaattgcctccaatgaaagtggaaatgcggttgtaacacttcataacggcagtatatcttcaccggtatattggagctggcatatttgggtgacagattctcctgtgggatcttacacctatactaccgagactccggcagcagttacaaactatgtgaattatgtagataaagctgatgtagttttccagacgacttttatggatcgaaatcttggagctgtagatgcttttcctgctgttgccaacccgcaggctcctaccgctgacgaacttttgaaaatccgtgcctctaccggtttgcattatcaatggggaagaaaagatcctattcctgtatttcaatatgcagataacagaagctcctacaatgtatttttgggtgcggctgcagacaatggaacagttacatacagtacacttaatccgactgactataataatctttcaggaaattatattgttccttacaatacttatgctgcagcatcaaatgtacagactgccgataagccgatagataaaatttccaaaatattatcttattctgtgaaaaatcctttggtgtatatggttcccagttcttttgctctttataacagcacaacacctaattataccagcggaacagactggcttgcaacagagcctaacttagctccggacagatggggaagaggagggaaaaaatcgcctttcgatccttgccctgaaggatggagaattcctgaccttacgaacgtagccttggtttcaggagcagatttcggacaaactccctggtataagaaagataaaaatgtagcaacgtcatacagtattgtgactgattatctgggagcaagggtgagaaacgctgccaatgctacagtgggatatatctttaataaccctgcatatcctttaggaaattatcctgattccggttcaagaggattcagaagtgtgacggcaaatcagtctgcacagggaacatttaatgtgctcaactatcaatatccggctgtctggacagctgctttaaattctaattatctgggaagatcaatcaatgctttatttgatgcggcagctacaaccaatagactaatagtctttcatgataataatgatccatatttcggaacgggatgccgatgtgtgaaaatagaatatgatgccaatggcaacgaagaagggcctgcttcaagaactaccgtaataccaaatggttctacattaagtactgcaaatgccgtacttaaaaataccgataacaagatctctgtgtatcccagccctgtatccaatattctttatataaaaagtacggaagataaagaatacgattttcaaatttttaatgccctggggcagcttgtaaaatcaggacattttattaataatcagacagatctctcatctttaaatgccggagtatacctgataagaatcaatagttcagaagcgacttttaagattataaaacgctaaggttttaaaataaatagtaagtggataagttcctatagaatgttttttgtcaagacatatttcttctattacagatggtgaaaaattctatattattatctgcagagaattgtataatagtctaaaacctatactgcaaaagacttgtttcttcagaaagcgggtattaaaatatagtataaagcgttaggaatagtaaattaaacctgcttaacaaaaagtatataataaaaaagctttacttttgcaaaaaattttttttagaatgtcgaaaaatttagtaatcgtagagtccccggcaaaggcaaaaactattcagaaatatttaggtaaggatttcgaagtgaaatccagtttcggtcatatccgtgatctgcctaaaaaaggaatgggaatagatcttgccacctttaatcctgattacgaagtttcagcagacaagaagaaattagtgacagaattaaaagctgccgtaaagaaagctgatatggtttggctggcttccgatgaggaccgcgagggagaggctattgcctggcacctggcagatgagctgaagctgaagcctgaaaacagaaaaagaattgttttccacgagattactaaaaatgccattctaaaagcaattgacaatccgagagatattgatcagaatctggtaaatgcacagcaggcaagacgtgtgctggacagaatcgtaggttttgaaatgtcacccgttttatggaaaaaagtaaaaccggggctgtctgcaggtagagtacaatctgtagccgtaagattaatcgttgaaagagaaaaggagatccgtgagttcataccgaaagcaagctttaagcttgatggtatctttttaaataaaacagagcaggaaattgctgccaagctgaagaaagattttgaaaaagaagaagatgcagaaaaattcctggagcaggcaaaaactacagaatttaaagttctgaatgttgaaaccaaaccaggtacccgttcggcttcagcaccttttacaacctctacattacagcaggaagcttcttcaagacttggttataatgtaaccaacaccatgcgtcttgcacagagactgtatgaagaagggtatattacctatatgagaacagactccgtgaacctttctcaggaagctattgaaggagcaaaaaaacaaatcatctcagaatacggaacagaatattcttcaccaagaaactatactacaaaatctgcttcagcacaggaagcgcacgaggccatccgtcctacagattttggagtaaaaagtataggagatgcacaactgaataaattgtatcagttaatatacagaagaacacttgcttctcagatggctaatgctaaaattgaaaagactgtaattgaaattggaaatacatctttgccacatcattttgaagcgcagggagaagtgatcatatttgacggtttcctgaaagcatacggaattgtgaagactgaagatgatgatgaagaaaacaacgataaattgctgccgaaagtgagcgtaggagaagtattaagttacaaaaccattactgctactgaaaagtttacaagaccaagtgcaagatatactgaagcaggattggtaagaaaacttgaagaattagggatcggtagaccttctacctatgcgcctactattcagactatccagaacagagagtatgtggataaaagagaaattgagccacagacccgcgaagtgatcaaaatgtctttggtaaaagacaaaatcaaaaaagtagttcttgaggaaaaattcggaggcgataaaaataaattcgttcctacagatatcggtgaagttgttaatgacttccttacagataacttcagggaaattcttgattacggtttcacagcaagagttgaagaaagctttgacgaaattgcaagcggtgatcagaagtggaaagaaatgatgacgaatttctattcaaaattccacccgagaattgaagatgtagaagaaaatgcagaccgtgcaacaggagacagacttttaggagtagatccgaagaccggtaaaaatgtacatgcaagaatcggaagattcggagcaatgatccagattggagaaacggatgatgaggaaaaaccgatctttgcatccttaatggcaggtcagaatattgcaaccattacttttgaagaagctctggaactgtttaaattacctttcgatttaaatacagttgacggacagccggtttctgtgggagtaggtagattcggaccttatgtcaaatggggagaaacatatatcagtattccgaaaggtgaagatccgctttctgtagatcagaagcgtgctgaggaaattatcagtgaaaagaaaattgctgatgctcctattgcaacctataaaggagaaccggtaacaaaaggatccggaagattcggaccatttatcaaatacaaagatatctttgtaaatgttccaaagagatatgattttgaaaacctttctcaaagcgatattaatgaactgattgatgctaaattggaaaaagaggccaaccgctatatccagcagtgggaaaaagaaaaaatttccattgaaaacggaagatggggacctttcatcaagtttggaaaagcgatgttcaaaattccgaaaaaagcagacgatacaaaatatgaagctgaggaattgaaagaactttctttagatgaggtgaaaaaatggattacagatcaggatccgaaagcctttgccgaaaagaaaaaaccagctgccaaaaaagcaacaactacaaaaaaaacaactgcagccaaaaagccggcagccaaaaaaaagtaaatgtaaaataatgatacaaagccgttaacatctgttgacggctttttttatgaacaaaagcatccatgtcttactcagtttctatgttttttgtatgtttgttttatcaagcaattaatcaattattacattcaaattaaaatatggatttcgaagactttatcatttcaccaagaaatttcaaaaccgaaagctggcagataggaagtcggattactaaagatatcagagaagacagtattgttctgctgtttatgtcagattacagaggtgccggaggcgatgctgaggttcaggattttacagctgtgagaaaagagttttataagctttcacagatggatttcgaaattcctgtggtggatcttggagatctggtatccgggaagtcagttcaggatacccattatatcttacaggaagttctgtcagcatgtcattataaaagagccattccggtgattatcggaggttccaatgattttgccttttcactattttcagcattgaattttcacaagaaaagtctcaattatacccagatcagcaacatcatttcccttcagcaaggagaagcgatcaatgaacacacttttttaagcaaaattttcggagctaaaaatttctccattaaaaattatcatcacttaggttatcagaaacatctgaacgaaatggattctgtaaggctgatcaaagaagtagaatttgacattgtaaggctggctgaaatgatgaattccacagagaagacagagcctttcttcagaaaagcagatctggtgacggtaaactgcgatgctatcgaaagttttagcgaacctttttcaatgaatccgcaggtaaatggattgaacagaagagaaatctgtgcctacatgaaagaaataggattgagtgaaaatctgaagtccgtaggaatttttaattataatatttattcggaaaaccagctgaaccatcagcttttagcacaaatgttatggtatctgatcgaagggatcaatatccagcattcccatccgaaagaaagaaattatgagctgttctatgtgctgatagatgacaggcaatatgcattcaagcgtgatactttcagtaatttgtggtattttggtgatgatgaaaatatagaaaactgcattccctgctccagaaaagattttgatgaagctaaaaaaggatggctgaatgcaagactgacgaaaatttaatgtatgacaaatgttccctcaagagtatccattattgttcccgtttataatgtcgaaaattatttggcaaaatgtcttgactcgctggtgaagcaaagtcttccggatattgaaattcttgtagtgaatgatggaagtaaggataactccgaaaaaattattgaaggatatgcacaaaagtatccggagaaaataaaagcttataccaaagagaacggaggcttaagcgatgcccgtaatttcgggatcgatagagcaatcggtgattatataggttttgtagacagtgatgattatgttactgaaactatgtttgaggaaatgcttcttttagcagaaaagcataatgctaaaatggtgatctcaaatattcagaaagtggatgagaatggcaaagttgttcaaaaactcactcagcttcccaatatgcccgaaaagataacccttgaaaataacttttctgtattttcggatatcagctactttgcgtgtaataagctgttcaaaaaagaactttttaatcagaaaagatttaaaaaaggtgttcattttgaagacattcagcttattccacagcttttactggaatgtgaaaccatagcgcaaacccagaatttccattatcagtatcttgaacgtaccgattccattacaaaaacccatacggaaaaagggcttgacatgcttaaagcagtgtctaatgtagaacaggtattcagagaatccccatattcccacaaaaaagaagaattgaaaaatttccagatttttgaaggggtttactcgtttctggcctatctggcgtttgtgaaagaagaagaaatattttatagtatgtctgatcaattggttctttttatgaaggaaagacaaataaaaattcaagatatattgaagtataatcgttttggtaagaattatcttttatctttgccgttgaagaaaaagattttttatctgttattttttgctggacagaaaaaattgataagaaaattaatttagtaaacacaaatgtaagtactgttatttcgtccattaggaatgataatgaagactttgtaagtcctgcattataagccttattgaagaaatacaagtgctgaataagaaaagaatgaaaaactttgaattgttcttaagcggatcgggaatacctattttctacataaaaatagggctgggtttcgttttctcctttttaattacatttttctccattcctaccattgttaagatctcaagaagaaagaatctgatggatgagcctggaataagaagttcgcaccttagagagattcccaatctgggaggaatagccattttttattctataggaatctgtgcttctatttttgcctatgagctgtttgatctctacaagtttctatttgcctcattaattattctgctttatattggagtaatggacgatattgtggttatgagagcttacaaaaagcttgtagcgcagattgttgtatcttcattgattgttattggatcagatatcagaatcagaagcttattcggaatattcggagtatatgagctggagtattttgtaagtgtgatcttcagtattataacatttattattctgattaatgctttcaacctgattgatgggatagatggactggcaggcggatattctgttatctgcagcgccttatttggaataagctattaccgtttgggagaatataactatccactggtagttttatctgttgttattatcgggactgtactggcatttttatactataatttgtcaaattaccggacccgtaaaatatttatgggtgacaccggatctatgctgcttggctttttgctggcctttacctccatttgttttatagacattttcatcgataaaaatctggtagatgtaccaaggtatcaccttcagtctgctccggtagtggcagttgccattctcattcttccgattgtagatacattaaatgtcattatgatcaggctttacaacaagaaatcaccgtttgatgcagataagaaccatattcatcataagctgctgaaattgaatcttacccatagaagatctactttctatattattctgtactatctgatgattgttgcagtagcttattatctgagacatattaatgtcaatattttattattagtggtgctttcactgggctttttgggcgcttatctgccggatttgctatatcggctaagaaataacaaaaattaacaattaaatattacttttgtaaataatattatatatgatgaaaaactttaaatatttatttttaatattccctcttttagttacctcatgtattacaacaaaggatgtaagatacttacagccgagtgagagtcttgtaattaatgaagaaggtcttgttccctacaacatccctgtttacaggattacaaaaaacgatatccttaaccttaatattgtgactactcccaaaggagatgccgcacaattttactcctcttacaatacctccggaggtattgcaggtggaagcgcagccagtcctgcaataacaggagggggtgcattaggagtgagcggaaacggcggaggaagcagaggcggaaatataaacttttatttcaatggtttgaaagttgacgccaatggtgaaatcaatgtttttggaatcggatatgtaaaagccgaaggaagaacattagatgatattactaaagaaattcaggaaaaagtaaatgaaaatttccaggaaggtaaatctgaagtacgtctgaatacagatggtattacgttttatatccttggtgatgttgaaactacgggtctttcaggagaaaaagttgttcacaaaaatacacttaccattaccgaagctttagccattaatggtgggctgaacagaacgatagacaaaaaagagattgttattcacagaaaacttccggaaggaatcaaaatcgctaaaatagatcttacccgtgaagatctgatgaattctcctttctattacgtacagaacggagatgaaatttatctgaacacaagagcaaaaagcttgaatggatttggaaaagatcctattcagactttaactacgggagtttcggtaattactacagcattatctatttatttacttcttaaaaatctttagccatgattccagaaagagtaaccgctgcagagaagaacaattctcagaaagaaaagtatgggtcgtttgcattatttgatttagaacactttttaagaagaatccttaagaactggtactggtttgtattcatgctttttatcggctatgccattgcatggatttacagtaagtactatgcgcagaatatttatgcgtctgacttgtctttaagtacatccagtaaaggttctgagtttttaccaacacagtctaaccaatctatcaactttatttggggggataccggaaaccaggatggtctttatctgaagaaaatgcttttatccagaacgcataatgaatttttggtgaaagaattagacctttttgtaaactattctacaaaaggacttataaaatctacctatctggataaagatgattcacccgtgtttcttcagattgataaaaaacaccttcagcagatcaattatcctattaccctgataccaaaaggtaatgggtcatatcaggtggttttaccggaagaaggggaatctactaatttatataattatgaagttgaaggctttcagaatgtaaatgcttatagcagaccagctgataaaattattaaaatcaatgagtggtacaatgctcctaacctgagattcagactgcttcaaaatcctgttcctgctaaaattaagttggacaatatcattgtaaaattaaactcagtaaatgagagtgtaaatgaaattataggtactacgggagtggattttgataaagaaatcaagtctatcatgattataactaaaagagggtataaccttaacagtacagttaatttccttaataaatctgttgcagagctgcaaaaaaagagattggctgacaaaaatattgttaataagaatactgatctctttttaaaggaaaatcttgctaatattcgtaaaaaacttgattcaagtgcaaatgtgctgaattatttgaaaacttcagaaaagctttataatattaaagacagggatgaaaaatctcttgaaaaaataaaagatctggaagctaaaaaagcagatatcataagcaaaatcaactccctgaacaatatcaaaaacacactgcagtctcagaattttgataaaatgattggaaccaatgctgcaggttttgaagatggagtattctcagcaacagttactgagcttaaagctttatatgctaaaaaagcagaaatggcttctatttataagccttcatcggagcctatgagagaaatcaacagacttattgatgaagcaagaatgggatcatccaatagcctaagagggtattataacagatattacgacgaaattaataaaattgaccgtgagatctcaggtgccaattcagatttagcttcttatcctgaaaaagaaagaagatacctggatgcagagagagggtataatatgattgaagctacttataacagcttactgggaagacagagtgatacccagatgagaatggctaccaatcaatctgatataacggtgattgacccggccaaaaacctggggcagagacctattgcacctaatgtaaagcttactaagacagccattatctccggaatgctgttgcttccgttgctgtttatctttcttggtgaagtgtttgataataagatcagaaatatcaaagaacttctgagtgctaccaagattccactgcttggtgtgataggaaataacagcaatgaaaatatgcttaccgttctggatcagccaaaatcatctgtttcagaggccttcagaggaataagagcaaatatgagattcctgatggataatgaaagtgaaaaaggaaaagtaattttggttacttcatctattggaggcgaagggaaaacatatgtatctatcaatctggcatccgttataggattaagtgataaaaaaacaatcctgttgggaatggaccttagaaaaccaaaaatcttcggagattttaagattgataataaatatggtatctcaaactacctgaccggagaagtaggaatagatcagattatcaataaaacgaggatccctaatcttgatgttgctacgtcagggcctatccctccaaatccatctgaacttttaatgagccagagaaatatcaaatttatagaagaacttaaagaaaaatatgatttcattattatagattcacctccggtaggtttggtggcagattcatatgaactgatgaagtattctgatgcaaatctatacgttgtgcgtcatgaatacacagaaaagtacatgctgaaaatgattacggaaaagtatcacaatgatgaaatcaataatttgggactcgtttataatgactacaatacgaagcaggggtatggctacggttatggctacggctacggctatggttacggctatggttattttgatgaagataaaaattataaagagcctttattgataagaatcagaaacagagtacaggtattatttaataaaaaataaagcattaaaccctcatttaatgggggttttttcatatttacggtattttcattctatgaaaaaaagaatatttttgccactttgccgtttactttataacaaattatgtttttttgtttatttttaactaaacattaagattatcattaatataaaaatgttttatatttgcaaaaattaaattttaaaataaccataaatccatattcttttatgaataaaaaattattgtttagcttccttgccttccttggagtggtaggtgttaaagcacaaagaaacgaattgggagttcgtctaggtatgagtaacctagtgggagatgtaggaaggacaaattatattttacaaaagccgttggatttaagcagaacgtcagattggggggtcccgttttatggtggtttattatatagatttaattttaacccgcatcagactgttagattggatttaggatacaaccagatccagtttagtgataaagcggcaaaagaagattatagaagaaatagaaactcatacggaaaaaataacgtgtatgaggcgagtttaatgtttgaatataacttttttcctgttaataatgagcagatcagcatgttaagcccttacatcttcggaggggtaggagctttgatgtttgatgctcccaaagctactcttgtgaatgatttcagaagagatgcggatggtgtagcgcaggctccgattaatgaattggactttaccactacaaccaattattcagtaggtaaaaaagtaaccatgcatatcccttttggagttggtttgaagtataaattcaaccactcatgggctgtatttgcagaagctacattcagatatacattgacggatcagctggattacagtaaaatcctttccaaagatgtaaaaagttcttttaatgctgatattctggaccctgctaccggaggttcattattacagtcaggaaattactatgcagtttctaaagaaagagaagcagagtttattaaaaagagaaatattggagatagcagatctaatgattggataaatacgttcagtttaggacttacttattcattcggaagacctccatgttattgtgaataatatgtcgttgattaaagataaaataaattctgagaatttaccgaaacacgtagccatcattatggatggtaatggaagatgggcaaaatctcgtggtgaggaaagaactttcggccacaaaaatgccattaatgctgtaagaaatgccattaatgcctgtaatgagatcaatatcccttatttaacattgtataccttctcatcagaaaactggagtcgtccggctgaagaagtgaatacccttatgaacctgttggtagaaaccttactgcttgaagcagaagagattttcagcaaaggcttaaggatgcatgttataggaaatctggacaagctgcctccattggtaagagagcagttggaacgtgtggtagagctcacaaaagaaaacacaaaaggaaaccttgtattggctataagctatggctcacaaaacgaaatactggaagccgtaaaaaatataagctctgatgtaaaagaaggaaaagttgagatagaaaatataaacgaaagtttattcgaaagttatctgtatacaaaagattttcctcctgtagatttactgatcagaaccagcggtgaaataaggataagcaactttctgctttggcagattgcttatgcagaattacagtttttaaatgttctgtggccggacttcaccaaagatattttcttccaatgtattgtagattatcaaaacaaagaaagaagatacgggttaaccggtgagcaagtaaaaggccaataaaattttaagaaaagaaagactcgataaaatgaagtttagactattacccatcattatgtttgctgcttctgcacatttttatggacaagtaactccacaagacagcacaaaagtaaataatgctgtacatgcagaaaatgaggcaggaacttatacacttaaagacatcgttgtagatggggtaaaaaaatatacaccagctcagatcttgagattcacgggccttactaaaggagaaagtgtagacattccgggacagaaaatcagcaacgctgtaaaaaaactttgggatacccaatctttttctgaagtggaggtttatgttcaaagcattgaaggacagactatcgttctgaaattttacctgcaggatctgaaagaacttggagaagttaaattcacgggcaaaggaatcggtaaatctaaaagcgaaaagctggcgaaggataataaccttaaaccgggaacaaaaattactcagaacctggtttcaagccttaaaactaatgtccctaaagactatattaaaaaaggttttgcagatgccaaaatcagtattcaggataaagtaaatgcaggagatcctgctttggtagactggacaattaatgtagataagggtaaaagaattaaaattgaccatattgaatttgaaggaaacgaaaatgtaaccgacaggaagcttagaaacaaagctttcaaagaaaccaaacaaaagcgttttggtatcggtggtattttgaaatcctcaaaattcattgaagataaatatcaggaggataagcagaaccttatcagttattataactctctggggtatagagacgcgaaaatcgtttcagactcagtatggagaaacaagagaaataactacgaaatcaatgtaaaacttaatgagggtaaaaaatattacatcggggatgttacgttcacgggtaatacggtatactctacagagtacttacaaagattgcttggatataagaaaggggatatttacgatgctgtaggattcaacaaaaaagttggagaagacggtggtaaagaagatgattcagatatcaaatctgtttacatgaataacggttaccttttctctaatgtaacacctgttgaaaaatcagtgtcaggagatgcggtaaaccttgaagtaagaattaatgaaggagagcaagctacatggaacaaagtaacatggcagggaaataccacaacccatgaccacgttattcttagagcactgagaacaaaacctggagagctgttcaagaaaacagaaattaaaagaacatacttcgatttggcagggatgtcattctttgaccctcagcagatcggtcaggatattcagccaaaccaggtggataataccgttgatattaactggaagcttgtagaaaaaggatcttctcaggttcagctacaggcaggttatggtggtaacagctttatcggaactttagggttgacatttaataacttctcattaaagaacttccttaaatttaaggatttcaaaccggtgcctcaaggagatggacaaaccttctctattcaggtacaggcaggacaatacttccagaactatggaatatcattcacagagccttggttatttggtacaagagcaacagccctttctgtaagtttgaacaactccagagtgagatatacagatcaatatggaagtgcccaaaaattgaatattttctctgcatcagcagggttgaacagattattgaactggcctgatgattacttctcattgtatacaggattacagttccagaagtatgatttcaacaattatcccttccagtttggtgatactacagaatataatggtactgccaataacttcagtgtcaatttaggattgagcagaaattcagccggtattgacccgattttcccgacaatgggatccaatatagagctttcagcaaaactgactcctccatactcattgtttaagaaaaaagactactcatcaatgtcagccattgataagtacaagtggatggaattctacaaaatcaaatttaaagcagacgtttacaacgaaatcattggaaaacttgtcttaaggtcttctgctgaaatgggattcatggatggatacaacaaccaattgggagcaccaccatttgaaagattctatatgggaggtacaggtcttttcggaggtcgatatgacggtagagaattgattcctttaagaggttatgaaaatgctactacagaaggaggtcaggcagaagatattactcagaaaggaggaggtacaatctacaacagatttaccctggaattaagatacccgatctcaatgagccagactgcaaaaatctacgcattaacatttgctgaaggaggtaacgtatggaattcatggagcacttacagcccgttccagctgaaaagatcagtcgggattggtgtaagagtttatatgggagcatttggattgatcggatttgactttgcattaggtcttgataagacattatcaggtgataagtccggatggagaaaccacttcttgatgaaccaaacactataattaaagatatgaagcactttaaaataatcttcacattcgcattacttttactgttcgggttaaacaatgcccagaaaatcggagtagtggataccaatgaaatactgaataaattacctcagtataaagaagctgaagcaagattaaattctcagattgatacctgggagtctgaacttcagagtcttcagtctgaatatgaaagaaaaaaagctgcttttgaaagtgaaaaagtattattgataggggatcaacttaaacttcgcgaaaaagaagttacagaccttgataaaaatattaaaacgacaacaagcttacgttttggggctaacggtgaaattacaaaactgagaacaaatctggttcagccttttcaggatcagatctgggaagcaatcaaaacaatgtccgaaaaaaatggcttgggcatagttcttgataaaagcaataacattagtgttattttccttcagtcaaagtatgattacactgagaaagtattgtctattctgttgaaaggaacagacaagaaggaaaaaacaaatagcaaaggcaaaaaataataatagaattaacttttgctatattttaaaatctaaaaacaaattaaattatttatttaccagttatgaaaaaattaagtgtattatttgcagcagtaatgatggttgtatctgtaggtatggcaaaagctcaaaaaattgctactttagatgtaatgggagttcttaacgcaatgccggagaaaaagaaagcagatgctgatcttaaaacattcttagatactaaacaagctgagattaagaaaaaagctgacgccgctcagactaaatatcagcaatatcagacagaagctcctaaaaaaacagctgatgaaaacaaagctagagaggaggagatgaaaaaattagctgatgaaatccagcaaatgcaggaaaaagctcaaaaagatctacaggctaagcaagatgtagctttcggacctattgagaaaaaattaaatgatgcagtagaaaaagtagctaaagctaacgggtacgattatattatggatgcaaactcaacagcattcctttataaagcaggaccggatgcaactccagctgtaaaaaaagaattaggaattcaataatttcagcaaattaacaaagatttataaaaccaaccgcctcttttagaggtggtttttttatttttgcggaatggaaaaagaagtatcaacgacggtcaaagttaggtttagtgattgcgatccgataggtcatttgaataatgtaaaatatctggattatatgtttaatgccagagaagatcatgtagaaacattttacggattcacctacgaagaatataccaagaaaaccggctgtacctggattgccattcaaaatgaaatagcttatttaaaagaagtacgatacaatacgcaggtagtaatcagcagcaaaaccatcgatgttcaggatagaacggccaaagtcgaaattctgatgaaaagtctggatgaaaaaacaattcatgccgtactttgggtaactgttatttattttaatgtcaaaacaagaaaatctgaagtccatcctgaagagatcaaaggaatttttgataaattctatgtagatctgatccagaaagacttccagtcaagagtgaagttcttaaggagccagaatgccaaaaactcttaatctcatttcttaaaggttccaatttaaaaattaataataaacaaatgaaaaaaatagcagtaatagggagtaacgggcaattaggcaactgcataaaaaagatagctcctgactttgaacatcagtatgaattcttatttacagactcttctacattagatgttaccagtgaagaacaggtgaacgatttcttttatgaaaacaaacctgattactgcatcaatgcttcagcatatacggcggtggatctggcagagaaggaaaaagaaaaagctttcgctgtgaatgctgatggagtagcccatctggctcaggcctgtgctgaatataaatctactttgattcatgtttctacggactatgtttttgatggtgctaccaatcttccgtattccgaagatgattttaccaatccgataggagtatatggggaatcaaaaagaaaaggagaagagcttgccctggaaatcaatccgaaaacaattattctgagaacctcatggctgtactctgaatttaataagaattttgtgaaaaccatgctgcacctgttctcgcagaaagatgagttgggaattgtagctgatcagttcgggcagccaaccaatgcaaatgatttggcagaagcaattatgcagattatccagactccgcaaaaaacctatggaatcttccatttctcaaactatccggagacaacctggtttgaattcgccaaaaaaattgctgagttttcaaaatcaccggtaaaattgaatgcgataaccactgaccaatatcctactccggctaaaaggcctgtaagaagcactatgtctttggataaaattgaagagacatataaaatagagcccaaacattgggaaaacagtcttgaagaatgtgttgaaatacttgcacaccaataatagataatatgaagaatattgcaatcatcttttccgtgttatgtatccagctgtggagcgctcagaatgtttatatgaccagagttgaaaaaacgaacgataactcagataaattcttttacagaaaagaggacgctgccacagatgctgtttatttaggagaagtagaagtacagggattttcaaaagatgatgcacttgtattttctctcgtatataaaaaagcaaaagagatcggtgccaatacatttcaattaaaacctttcgaaaacgttgacggtacgcctcagccattcaatgctgccaattataaagttgctttatattatacacctaaagaaaaattggcggttaagcatggagagatgtacatatttgcatcctctgaaaaagatcagaaaataaatatcaaccgtaaagactataccatcccgccaagaacatttttaaaattaaaagtagttccgggagaaatctataccatctcaacaaaaaaattgttaggctctacagtgaaagttcagccaaaagccaatgacgacaatctttatttccaggtttcatctttgaaagtaaagtcagataatacaggagtaggaggcctgaatctgaaatcgggagatattattggcctggaaaagtcttatgcagaatttttaagcataatttataaagagaagcatccataaaaaccaattataatagttgttttaggattcaaccttgaaaaagaactcttcaataatttttttgtttaaaatttttctacctgcctaccagtgctttaagagtaaatattacgaaacggtaaaatttatgttaaataaacttgttttgcgttgtgggaagttactatctttgccccactgaaaacgagagtagatcagtaagcgcagaagggcttttagctaagcaggaacattattacttcacaagagacagacgaaaaaaaactttaaaactttttacaaaaagagttgcgggataaaaaagagtttgtatctttgcagtccgaataaatcggagcgcaggagtagagggattgagggtttgagaaggattaaggttacttaaaaaactttaaaattttcttcaaaaacatttggtcat

SEQ ID NO: 12 - DNA, 739755 bp, Chryseobacterium sp.
ctaagctcacctgttcccattccgaacacagaagttaagcccaccagcgccgatggtactgctaacgcgggagagtaggccgccgccagtttttattttatttttaaaaatcctttatcaaatgatagaggattttttttgctttataccgaacttataagcaataagcaataagcaataagtaatgagtaataattgatgaatgataaacgatatttcaatcaattatcaactatcaaccatcacttatcacttaacattcatcattcatcattcatcattcatcattcatcacataccccattgtcactccgtaggagtctaaacaatacattttaaagctctattatcacctctatctaagattatcaaactaaaaaaaacttttgtagttctgtagtattcctacgaatcctttagaccctaataatgtgtctggacatagttgggatattagatcttactatgtaaattgacctcttaatctggatttgacaattcacaatttaacgctgatcacttattaatgatcatttataacatatccccatatcactccatcggagactaaacaaatccattatttttcttcaactcaattcccacaaagtactaaattaggctataacttatctgtctttaaattttacttaattatttaagtatcaaaagctttacactcatatcagtgatttaagatgttgttattaaaaagatttggttgcttttattaatgaatttaacataaataattactgattgtatattaatttaataataattacgttatttgttgaaatatcttgtgatattattaaatatataccaaatctaatttttatgagaaaaaccatttttaaggttgggctgctccaatccttattctttttcggtggattgtatgcacaaagtgattcaactaaagcgtcaaagattgatgaagtagttgttacagcttatggtgtaaaaaaagaaaaaaaagcgcttggatattctttccaggatgtgaaaggacaaactcttgtcgatgccaaagaaaataatgttaccaatgcattagtaggaaaggttgccggattacaagtgattaaaggaggttttggaccaggttcttcctccaaaattaatctgcggggatttaattcttttacaggagataatcaaccacttattgtggtggatggagttccattaagtaatagcttaggttcaaaggttaggcagaatggaaaagattctaataacgatttctggaatccggatcttgatatgggtaatggtttaagtgatatcaatccggacgacattgaaagtctttctgttttgaaaggtggtgctgcttctgctctttatggttccagaggtggaaacggtgttattttgattacaaccaaaaccggtaaaaggaaaggaggattaggaattacatattctacaagcttaggttttgaaaatatttttatgaaacctgatttgcagcatagtttcgcacaaggaagtaatggtttgcccaatccacaaggagttgataacacaacttcctggggacctgcctttgagggatcaaatatgaccgtccatgataacttaaaaaacttttttaagacaggaactaccgcacagcatacattgagctttcaggagaacttaggcgaaggatcaagcctgtacacttcagctaactatttaaacagtaatagccagattccgaactcaaaatatgagaggttcaattttatggcaaaaatgaattctaactttggggctaataaaagatggactactgaggtgaaagcccagtatatgagtgttaaaggtacaaacagaccttctgcagggcaaggtgatggaaattactacccaagaatccttctgatgcctcaaaatgttgatgtaagagattatcgtgagggacagatgcaaaatggagtgacatcgcgctggataacttctaatggaattaatccatattggacagcttataatgcattaaacgcggataaaaaagaccggtttttattaaacggatatcttaaatatcaatttaataactggctgagcgcagatgtaagattaggaacggatttctattccttaaatagtgatgcaagggtttggacgggatctggccgtaataactcttactctacaggtcaggaaaagttttatgagaataattatatcataagtcttaatgctaaaaaagataatattgttggtaaatggggtggctcgctttctgtttatgggcagatgatggaaagcagggataaagcactatatttttccacacaaaatcttattattgccaatgttttcagcacatctaatacgagtgatcttgcttctgttacgacgactgaagttgatctgtggaaaaaaattaattcagtatttgctgctgctgaaattaattatgacggatattggtttctaaatgctacggcaagaaatgattggtcttctactttgaatgttaataacaggtcttatttttattcttctgtgagtacttcattagttttgacagatctgctgaaaaaattaaatggtactactttaaatgccttaacatttgctaagcttcgcgcggcctacgcaattgtgggtaactctttacctcctcaaagcttgtataatacatatatcgcttctactgatccaaacggacatattgtacttgcaagaaacaagatactttttaatccggatttacatgcggaaaagcttaagacttttgaagttggagcagacatgaagttttttgacagagtgtccctggatgtaagttattttaataataatgccaccgatcagcttatagccattccgataaatccactttccggatatgaaagaatgatgattaattcaggagggctgcataataaagggtttgaattcgttatgaatacggatatatttaagaaggaaagttttgtgtggaatgtcaatgccaatttttcaacgttaaaaagcaatatcgataaaattgatggaattgtttcaaaatatcccttatcaggttttgataacgttgctttcttcgcagaagtaggaaaaccttacggagccatttacggaacaaaattcttaagagtagaagataccagcagtccttattacggaaaattgattgtggatcaaaacggcttaccgcaggcaacgcctgatcaatattatttaggagatcaaaccccgagagctttgtttggttttacaaacagctttgtttataaaaatattgggctttcatttttaattgatgggagaatcggaggtaaatttttctctgcaacgcaagctgcactacaagcgaatggacttgctgcagacactgcgcccggaggaaaacgtgataatatgattttggatgctgtagtggagggaaatggcggttatacatcaaatacaaaagagattactcaacaggattattggggagctgtaacatccggaaatttaggaattacagaacagaatatttacgatgctaccaatattcgtttaagaaatattcagctgacctataatttccctaaaagtattttccaaaaactagccttacagagtgctaaagtagcttttacagcaaataacgtatggatgatttacagtaaagccaaaggaatcgatccggaatctgtattcgcaattaattctaatgctacaggatttgaaaaccttgcttttcctacttcaagatcttatttatttacaattactttaggcttttaattaacaactgaaacaatgaaaaaatatatcttatcattttttacgattggcttactatgtacttcatgcaatgattttgaagacatcaataataatccgtttgccgtagacaccaataaggcagaacctgaatatttattaaataactcaattctcggtgctcagcaggatcctaatattgcagaacgtgtttttgttttgtattggaaaacagcagcaagacagcatttgacaaccggaattgcaggtggaacttatgacgattcctggacttccgaatattggaaatacatttcagattggctgaataatgcaaatgcagccattcagttggctaatgaaaaaaaggcggcaggacaaggaaaaccttattatgataatatcattcaggtttccagaatttggagagcttatttaatgagtgaattttcggacaatttcggacctcaacctattcaggcttttcagggaacgaatcctacttttaattctgaaaaagaagtgtattattttattttggaagaattaaaagatgcagccgcaaaaatggacacaacccaaggagtaccatccaatgcaaatgcctatgatatggtgtatggatttaactggactcaatgggtaaaatatgccaactctatgaggatgagaattgccatgagaatcgccgaagtagatccttcaaaagcaaaaacagaatttgaagctgcggctaattcaaatatgtttatcgctacaagtgcagataattttaaagttgctgaaaaaccgggctgggatgcgctaacaggtgtaatgtccagagaatggaactctcaaattttatcagcaacccttaataatttatacattggcttgggaggagtaaattctacagaccaattaccagcagctcaacatacacaggtaaaagcatctgattatattggtataaaatatgatcaacagttcactacaatgaccaacgacccaagtgcaggatactggctggacggattacctaataaaatcgacccaagagcatataaaacattttatattccgggggatcttacaagtccggtttattcattgtatccgacgtataccaatcaggcaactaccaatcacggagatcttacgtttgaagataattctaaaataacaataaataccgtaaatacctggaatgcctataccattggaaactggggtgtaaaagggcagagaaatggcttaagaaatgtagtaggatgtatgccggctttaggtaagcagtatagagaaagtaagaatgcaagaatattctttgcaagctgggaaacctatttccttttggctgaagctgcattgaaaggctggaccgttccaatgagtgatgaagctgcttataataaaggaattcaggaaagttttgtttataatggagtttcacaattctatggtcaatatattgcttcaacggattataaccgtgacggtacttctgtttcttatagtcatattacagaaccgggagtaagccatacgatgaaatataaagatcctgtaaccgggaacttggtttctgttgaaattaaatatcctgtgaataccatttataagaatggatccgtaaagaatgataaactgacaaagattattacccagaaatatattgccaatatgccttggttaccgttagaatcatggaatgatcagagaagacttgggctgccgttttttgaaaaccctgccattgaagctccattgcccaaccttcctaatctgagctcagggaactatatgacgaattctattcagaacttccctcagagattaagatatccaagtactttcagaaatactgatcagtctggatatgataaagctgtgcaattacttggtggtacagatgctgtactgactcctctttggtgggccaaacattaattgaattcaaatactaaaaaacaatccttttctgattttgaaagggattgtttttttagatacaaattgactgaatatctctttattgtattgttcaattaattctgataaaagtagtgtatggatatggattggcctgggagttttaattggctccaatggtaaaaacaacctgtgtactatatgctgtcgcaggaattgttacggaaacaccgcctatttccagctgtacattaatgcctgaataatctacactgttaccaagtcctagaaccccggtaaaggtaattgttgaaagggttgcggcactagcttgtggtatttctatataattagccgtaccgccattaattgtagccgtacacaaaacacaaaggccgttgattgttgctgtaccgccacttctttttgcataaagtttcagagaactgttccaggaagtaggagcaagctgcatgctgattcgggctccggaacttgtaagaagattcagaaaagatccgggtaaatggccagacaatgttagcaggctgggattgtcataagttccggcataattagttccggcttctgtaatagtgggtacagttgctgtccagctggttcccgtaatattaatggtttgtccattaagactgcttcctattattaaaataataacgtatagaaatcttttcagggatgattttatgatgggacttttagtgttcattttcggtttactctgtgatggtgtaggtgatgacaatagctgtattggcctgtgcaactaaattggcataagtatttgtggccagtgaaatggtgagtgcatgtccgttattggcaccattccctgtataagctcctccaataccactaatgatagtgacaggagtagttgtaaggatcacctggccagatgatgttcccaacgctcctccaccggctccggatgctgcggcggcctgaagtcttatattcactcctgctatcactttattcacagaggctgtaattcttctggtaagtccgctgggagaaatggcagaagtatagttgacccattttgacgtattgggagttggtgttccaagcgcatttcctgcctcggtaggggctgtgaagttcaaagcaatactacctgcaggttcaatatccatcaaagttactactggcagcgtaaggctgacagtagtgcttgcggtctgggaataaattgagccagatgcaataaataatataattaatagtatggaacggatcagaatcattttttcttttttatttcattatatcctactttcagggattcctgctgatatttgatttctaactgatgcttgacaacattaatcgttattttctttgtttccgaaggttttaaagtaaacataaatttgtctgtagagattttaaaacgtttatccagcccattacggtaaaccttaacagtccagtctccaggccggagataagtgaagtcaaactcttctcctatatagcataccttgcggaaagtctggtcgttattactggtttctacaataatactttctctttttctctttccttttcctgattgcagctgttcaatgtctaactgatccttttctcccgtttccaggaatctgacatacccctgaacattggctgcagttgttatcccgaaattaaaagtattctctttattgatgagtgatagaggagcgggaaatgtttgagtgggaatgtcattgatttctgtagttgaacggtctatttctaaaaaataatcacccggaataacatttttaaacatataatttccatccttatccgtaaccgacagataacttccaagcattaatctgattccatctgtctttttaactcccagattggcaacattgccagtcagcgaagtatactcagctgttttttgcaccggaatattaggacgccatgtataacgcatcgaaaatataaaatctttatccccgatttctcctctttgtaatgaatatcttcctgacagatcaagttcatttccaggaaatagctgctggtgaaaaagaagctcaaaaagattcctgtctttaaaatattcctccggcatataattgttctgataaaaaacacttaaactggtcttatcagaaaaccggctaaatatccttgctccgtaataaaggtttttttgattctgaagctgataccttgagctgatggcgtaactcccgaagatgttaaaagaggttctgaatttttggaatgagaaattggcagaataaaaagtggaattaccgctgaaacctgtcagataattatccgttttaccaaactgtccatccagattgatctggaaaactccgatctgctgattgatactcactttgaaataacgctcataatagtcaaactgtttgggctccaaacggtctttatacgtctgatgaccattattaagaataataaaaccgttgggcagatatctgtactgtataccatattgaaaatactttctgtaaggtgctgccagcaacagggtatcccgttgaaagtttttcgcatcctgcatatagttggcaaatacactgatttttttggtgatattgtaatacacatttccattaaaggtattcgtattggtaaaatatccggcaaaatccggactggctctcatatatattaaacttccgtttaacttcttgaaagcggcttctgcctgaagcaaataagctgttccatctgttttctgtgtcgtactgtaagctaattctccggacaggttaatgtttttagaaatcttaaattttccttttgcgtaggggagatgagcgtcagaatcaagtcttacctcaccgtaccttatttcttcttttctcggtgttttatagaggtatcctacagaaatttcagactctttcctgatcctgaaggctgaatagatattcaattcatcttttatatccctgaagaatctgggatgattataaaacccgccaaaacttactttattaagatcataccggatttctgccccgcgtccgtatcttgcaaattctgtgagataagatgaagagtaggttttatcaccgagatgaagaaaaaaattatctcgtttataattcacaaaatactcctcatattgggtgaaagtgttaagttctacaggattgtgagtgacagccctgaattcaacctgatttttattgtctttatcaagagttcctttaccataaatttcgccctgaaaaccatcatgataaactcccatattctgcatcccgataaaggataaagaaaaagcaaccagcagcctgtgataaatatctttttcagtgggttttaccgagataacctgggtactcgaatagtaatcctgactttctttggggtttccctttggatgaaccgaaagatttaggttttgaatttcattctgaacaagatccgggcttgtgactttgtgaatactgacggtttttgattcattgggagacagtatgattggcgaatcatggtcaacaactgcattcttgctgtcaagtacaatgctttccgttacattgccattattttttaaaaggaaagaggctttgatggtttctcctgctctaataaactcaggggcatccagaatggtgaccaaaagattcctgtttccggaaactgagatttctgaagtttttataaaagatattccgctgttacgatcagtaatatttaatgttacagaataagaaccttgtcttgtttctgtactgatacgtaatggaaccagataggctgatgtttcataagggctaagctgaaattcacctttagctaaaatagggtgtattgaagagcttgatgtgctgactgaaatatcataagtcctgctctctgccgaattattttctaatgtaaagggaatagaagtggacatccccggcattaaactatcttttttactggtcaatcggttggattgctgttgagaaaaaataaataccgggaataataatatgataataaataatgtccaagttttaatcattttttacttctaattccacattcagcgcaaatgcattttcctcttcatctgtggctattatggcggctctgtacttatctggtggtacggtattgatatcaatataaaatgttttggaagtatccggtagcagtcccatcgttaaacttgtatacgttcccactttttcacctgtcttacgattatagatttcaatggctgccgtaggtttacagtatagattgccattattggcaattgcgatctttacagttttctttccttcttgtttttctacttttacactttcaaacttaaggtccggtttggccttttccgtttcaatgtctgtaatgacctgaatggcatatcgtataactgaggtaatacttacaccaggctttttgtcgctgggttttatctcctctacaggttccaccatgataacactccaataacttcccggatccattgcttcattgggaactgttatttcataaaatacctcagttttttccttaccttttaaagtaaccagattagtattgagtttcagccactccccgttactgcgtctattggtacgtaatgctgtatagttgattgttccgtcagcgtggtaggtgtaatcctgtaaaaataattttacactctgaggattgctgcttgtattttcgatggcaattttccctttgtaaacctttccgttttctattttgtaagaatgcgtaagcccgttgagaatcacaatgccggcatgtaaaaagccgaactgcaaaatcagggtgatcaaaataagaatacgctttatcatatataaagtttggagttaaatcatagtaatacaaaaccaggaagaaattgataacaacttcttcttgttttggatgaaaaaaagaatctttgtttaaattctaattgtctgatattgtataggtaacggtggctactacagtggctgttgcctgcaaatctgcgtaggcagctactcctccggggccgcttcctgcagctagtgcataagtaagattgtgtccgttgttggctccattccctgtataagcacttccaattccggaaatgatagtctggtcagccgcgcttaaggttagcagacctgctgatgttcccaacgttccagcacctgatccggtagctgcagcagcagttacgtggatatcaactcccggaatgatagcattcatttttacacttacattacgggtagggtctgcaacagatttgatggaagagtaattaagccataacgttgtgttggctgcagcaggaatgatagggtttcctgcttctgtaggtgctgtaaagcctagagtaatgtttttagtggcagcaggttcaatatctaccagagccacttcaggaatagacactgtaacggtatgggtatctgtattggtatcctgtgcgctcagattccctgatagagcaagcgcaaataaagacgctgcaatagttaaatttaattttttcatgacactgttaattagttaagtgaagataagaaaattcagtctacggtgaaaaaaatataccacaatttttatataagtatttatttatcatatgtaatgcattatatgtggaaataactcaaaaaaaatcctgtacaattttgtgcaggattttgttggtattataagcattttttaagcccagtgcggatcagaaacggaaacttttccggtttctattcttccggcaaaatgccacagatgatcgtttaatttgattttcaggtcataccagcccttatatttatcaagatctataataattttttcttccgttttttgtaaagcaatggatttcttcgtttttctatacagatcttccagggttatagaaatatttttcttttgatgaattctgatggtcagttcaatctgattttttgaagttgtatttgttaaaatcacctctgtttccggaatattatctcctttaaatttcctgaaaaaaccattgggaccgaaaatttcgtaatcatacgctcctgaatgtacagcatgggatagtgtctgtctggaatataaggcatatgaaaaatgataattgttattgttgaactgagtcctgtcataaataagcaaaggaactccattctcttttaaattggacattttgatcttttccccttccaaattgacatggaaatgatagggtaaaggattggatggtttcaaacctctttcctgaatgtcaagtaaattttcattcagttcattttcagaataccatttcaggttgggaaccggtttatttttggcagcattaatggttttagcataatctttctgattcagataatccatctgcggggcttttacactggaagaattgaaagctgatgtaagatctccacatatcgctcttctccagtcactgatattctcaacatgaacattcttattgaattttttcatgatgaatttctccaggaactgtaatactgaagtgtggtctgatacttcggaattaacaaagcccccttttgtccatggggaagcaatgatcatgggaactctgtagcccaatcctacagttccttcaattttttcataattttttaaagttggatcagacatgtattcctgggatttgtctacatattccacaccttcttttccgttcatatcaacgggctggcttggatttatcggaggggcgaaaggcagtacatgatcaaagtagccgtcgttttcatcataattgatgataaatattgtttttttccaggtttcaggatctttggtcagaatattcaaaacctcggaaatataccatgctccataccacggtgatcccggatggtctgaaaaatgttccggagctaccagccatgaaaccagcggaagctttttctcttccacatctttacggaactggaataatacatcaccttctggaaccacaagtctttctccgttttcatcttttccgatttccagtttccagtaatcaggatcattcacattggtggtgaaagctttttcgtgaaggtttttctcttcttctgaaagttttgaataattatcaggatggtacttcacctgatcttcctgaacttcagccagcatgacctccagtcgttttttctgatcaggatttttttcaatttcctttttcagataggttatgatattgggaatattttcataatatccttttgaaaacttaacattgaattttgaaaaccactcaataggattatcggtaaaattactgagccaggcttcctgttctccggacattccttttggaagactgatttcattctgataaattctccacgaaacattctgttgttccagaatctccgggaaagttttccacttggcctgtctcgctttatcgtaatcaatattttcattgacaacattagctttcacttttccgttttgctgttctctcaatgttccggaccaaaggaatagtctgttcggagttgtcccggtaagggaagaacagaaatactggtcgaatatggtaaatgcatcagccagctgataataaaacggaaggtcctcacggttgtaatagcctaatgtcagcggaatatttttataatctttattgcctgaagctttggcctgaagccactggtcaaattttcctctgttaagcgccttttgctgatctgcccatgaatgaggcaatgagctcatccaggtagattttgtatttcttaaatccagacgggcaggagatgcatattttccattgtcattcttttgaaagaaaacaggatgtccgtcctgctttacaaaagctcttttatctaaaaagcctctcactcctttaagagcaccaaaagcatggtcaaaagaacgattctcctgcatcaggattacgacatgttctgcatcataaaatgtagactgggcagccgggtcaatggctaaagcttttaaaatggaaggatgcagtacgcctgaagttcctaaacctgctaataaaagacttgatttttctaaaaattctcttctgttcatgttcaatcgtaataagaaagaaaccgcaagttaataggattttcctgcggtttctttgtttttatataaaaataatcagatttttattgtaaccaccatggtttggagttgatattatcatttcctccgtactgagaggctaatgcggcttttaaattgctgctgttataattgtattcagattgcggatatctgaatctgaaaggtgcagcaactccggactttaacggataattcggatagcccgttcttaaataatcataataagaagtccactgcgcctgatgaaacataatcatatatttttgagtcatgatcttttccaactttgtctgtaaaggatcggcgtcgttataaactactaaaggtgttgtaaggtactgattcacgtcaaagcctgagaaatattgtcccggattttttacatatgtctgataaaaactgaaactagctttgatcgcattatcgtaatgtgttttcgcagatccggaaatccagcctcgggctgccgcttcagccaggataaactcaagttctgaatagcttaatacagaagcgggctcattggtaggatctttatagaaacgatcgtttactttggaaatatttttagcagtgatcagggctgcattgtcagaataaggcgaagtaggatttccgccgttatatgctgtataatctgtgattgcttttccggcttcttttgctcctgtagtctgtgcagcaaaagtgaacaaacgcgggtcgtgtctgtctttaaacatattaatgaaataatctgccatatacaaacttgaaccgtatccgctgttattaaacatcgtgtatctactgtctgcagcatcagcaaatttaagttcaccgttatccgcaatggaggtcataagagactggcttcctgcaattgaagcaaattctgaagcgatattatagcttcccaccgttgtttttttagataaagtgatcaggattttcaggcggaaggagttgatcagttttttccactttaaggcatctccgttgtatacaatatccccttcaattttgtcgctggtattaataagatcattagcttctttcaattctgataaaattccggccatgatcgcttcctgtgtatcatatttaggctgtgtgatcccggattcacctttggcagcttcagaatagggagcacttccgacttttaggctgatgttgaagaaatgataagctctcaagaattttccgatggccagataatttttatttcctcttttctctgcttcctgcatcattttccctgtattcagaagtcctttggtgtagacttcaaaagaagcatcgttccacttcatgtactggtatgaattttcaccatcagtaccaatcatcattcttgaagcatacatattatccccatttacctggaatgtatatttttcaacaaaggttagaagaaatttaggatcaatgctggcctggtcattaggattttcgttgatggtgtcaaggttggattcacatgaagccaatgtcagaagtcctgcagcaactatagacttcatcagccattttgccgttttacctttttgcccttttatatgatttattgtatttttcattgtcttgatgtactttttagttaaaacttaagattaaaaccgattccgaaccatctgctggatgggtcctgaatatcattagcgatatctccgcttctgcctgacctgatctggaagtccggatcggaataaaggtttttggattttttccacatcgccagattgtaggcagaaatattggcagtaaagccttttaccattccttttggatttagtaatgaagaaaaatcatattccagaactacagatctgagcttaacaaaagtcctgtcgaaaacgttggcaaattcttcactttcatcctgtgttactcttgcctggtatggataattctgtgcccagtcctggaaactgattgcttttgtgtgcggagtataaagacctgtcgcaggattgtaatttaccccatccggtacaaaataatacgttcccggatttgcatattcaagatctctgtatgctacagagttaggatgttttcctccccaccacatcttttcaacaacctgcgatctcattacccctccgatgcttccatcgattccgatatttaaagtaaatttcttgtatttaaaggtgttattaaaaccaaaagtccagtccggattgaaatgtcctaggttcgttggggcattagctcttgttggcattcccgtattggcatcaagaatgacttttccgtccggagacttttgccatgtatagtcataatagctgtccattctttcacccaacttaatgttttggtagttgggcatattatcataaatggaagtcagcttttgttcataagtactccagttaattaaagttttccaactgaaatcagctgtttttaccggaaccataccaagggtaatttcaaaaccttttgtagtgtactcatttccgtttacatattgtgaagtgaagcccgatgattcagctgccgggaactggagaatattgttataatccaatgttctgaaatatgtggcatccaaagtaattctgttattcaggaaacctgcacttaagcctaattcatatgattttgtctgctcaggcttcaaagaattttctacattcagggtggttggataataatatgtaggatttccgttgaatgtgattccctgattattcagataataattcctgatcgcataaggttggaaatcatacgctactttagcccatgaagcggaaagctttaacatattgatggactccggcatttttaccaggtttgaaatcactgcacttacggatgcagaagggtagaagtaagacctgttggctttaggcagtgtggatgaccagtcattacgccctgaaatattaatgaagaaagcgttgtataatccgatatcaatcgtagagtaagcactgtaaatcagcttttccttcaggtaggtgtagtttttcagcgctccgatagagttttcaaacgtatacacttcaggaatcttcaatccgtccgtagacctttcattgttgttgtttttataatagaaagcagaacctccggcattgatggtgaaatcaaagttatcagatatttttttcttgtaagttgccagcacatcgtagttaaggttccatgttttattatctttcagaatatatcctccacttctcggtgcactgtaattgaaataggaataaggactcaatatctccgttttgctgtggttttccacaatggatatttttccttttaccgaaagatcctgtgtagctttatactctaaacctgtctgcgcattgatgatattcgttttgttctgatttttataatactcagctccgaaccatgggttattgtaccatgcatagttccagttggcttgcgcccttccttcttttccgggaatccacatatgatttttaagtgctttgccgtctacatcgcctcccatccagatcaggatcgtgtacatgtgtccgcttggattgtaatcatagttgggaatgttaggagtgaaggcctggttgaagttgaattttgtatcgaaaatcagtttatctccgagatggttttcagaagagaagttgattccgtatttctgaagataagaattcggaaccctgtcatcataattcatgaaattcccggagaatctgtagacgtctttgttatttctatagctgatggcaaagttattattgttgataactgcaggttttaaaaaagtacttaagttatcatgatatttccagtcgatcggaactctttcatatcttgatttatcatcatactgagttcccgtcacagctccgtaccacggaacgatctggcctgttactttatctctgatcgggctgttccactgggcaatctgcaatccgggaacaaactttggcccccagatcatatctccgtcattaactcctccgtcagctccgtcccagaattcatatttcccatgagaaccgttaccatattcagtctgagttttagggagattggtaaagcctcctgtgatcatcgtattttgggagaattcaacggagaatcccttcttcttcgcattttttgtggtgatcaaaatggctccgtagcgacctcttgatccatataaagcagaagctgtagcccctttcagaacgttaatattttcaatattgttgggatctaaattctggaaaacctctttttccacaataacaccgtcaattacaaaaacaagatttgagtttcctctcagcgtaaactgtggagcctgctgcattcctgttggattggaaacattcagacccgcaacctgtccggagaataaattcccgatacttggtgtggtaattgtttcaaactgttttgttcccacttcctgggtcgcataaccaatcttttcttttttcttggcaatacccaaagcggtaataaccactccttcaatctgcttttcgtttgacttttttaaaacaacagaatactgtcttctggaagaaacctcaacggtatacacagaaaagtcaggagcaaaaaattcaagaatatctttgggatttgcagaaatggtgaaattcccgttttcatcagtagttgcggcctttcctgtatttttgtcggtgatattcacaccggaaacactggaaccgttttctgattttacatttccggtaatattaatttcctgggcagaaaaataaagaggaagtaaaaaaacggcaaaagtggctagagttttcttcatttttttgaagacaaatttagcagagcactgttacctgtattttaatgatgtattaaaataaaaatacgatttaatattttttaacaggaagaattaatagaaaggtaaaattgaaaatgccccttgtataagggattttgttttattatatagtattataaggtagaagctggaagagagaagcaggaagttattgtggtgttgttaacttcttgaagccccaagtaataagtttttgaagaaaatctttctatagaaataaaaggatagtaaaactgcgaattcaataacttccagtttccggtttccctcttcctctctatttctaaaacctgctcagaattccccagtggatttttgtatcattaaacttaaaaggatttccaaattcattaccattagacagctggaagctcatgaggccgataggaataaagaaattgaaaccaagcccgacactgtaaagtttgggctttacattcaaagatttattattgagctgtccgtattgcccgaagacatcgaagaaggcctgattaccgatcagataccggtactccagacttccgtagtagtaaaagtcggcggcgagcgagttttcattgaatccacgcatagaattccagccaccaaaacggtataattcgttggtggaaaactctattttagaatccatcatggctccttcccccttaatattcaggaaatgatttccggaaatatgataattgtgttccccaaagaaataaaactggttttgattagctttgatgttatctttagaataggtggttgtcaaaaaatcatatcctgcattaattcttgtcttataaaggaaaagatcaatatcagtaggttccgtcatttcaaaccataccccaatcccttttttattatagtctttcccctgaacatataaggagtcaataatggtagaactttccaaagttcctcttaaccctattttgtttcggttattgatatgataatagaaagcaggaaggaactttacattggcaaatgtagaatcctgcctgtagatattcactttcgcattcattccgacattggatttgaacaggtacggaatatccacctgaagatcaaaagtctgtcccttatccggattcctctgccaatataaattgacggtctcaaaaccattgaacatattcctgaaattcacattcatcgttccgtttaaggtaaacttggaagttttgtcatttccgaaaccgattaccccgtcaaaagtattggtctttttcttttccagaaacaggaaaatgctggtggaatcttttgtgaacagagtttgtggctgccgttcgagcgttaaaaaaggatggctctggaaggttttattaatggctaaaaggtttttgtcatcatagtttttgcctttgaactccttttcaaggttcttgatgaatcttttaggaactttttcgtatccttttactacaaatccgtcgatcgttcttttatcatttttattgatgtcaagttccacgatcggatagccgtttttttgccctttatatttagatttgatcctgctgaaagaatagccttcatcaatatacgtcttgttgatactcttcttggtagagtctaaatttttagtgaaaaaatctttctgaattttcagtttctgaaccagggaatccgtaaggtttacataggtttcattaaagttctttcctttatcatagaaaatttcagtgctgtctccctttacttttacgtctttcagtttggtaaagaaataattattctgagctaatgaatccaggaattttactgcagaagtagaatcttttaccttttttctgactttggtttctgtatcaatcagccaatactgcttcttctgcgcttgtgtaaaaacgcagaatagtacaaaaaatattttcagaaacagtttcaatcccaaatatatctacaccataggtagtgatgaaattaagcgtagttaagataaaacttaaggcgaagcttatcttaatgattctttacaacttaattcttcttaatggtttaaaattttattatcaaataacttactatacaactaaaactaatccagtttattatattttttcatcaaattctcataagttccctgcggaagaatccatttcaacggaactcctattttctgcccgaatttaccaaaataataatgcgctttccatttatcttttgctaaaagtttttcaatatattctgcaacttctaaaggatcagttccgtcatttacgtgggagttcatcaaagcatatactttgtcaaaaacgtttttgtaaggctgggaaacctgtgcaatcactctgttgtctgctatattggttttgatatccccaagatgcaatgaacaaacgtcaatattccacgggtaaacttcatacctcattgcttcggttactttatccagagcagattttgatgctgaataaaatcctcggaaaggcagtcccatttcacttccgatacttgaaacattgataatttttccaaatttatgctcacgcatgttcggaagcacagcactcatcatctgtacaggtccggcaagattcaggctgaaaagtttcagaatatcctctttcgtagaatcttccacagcacctaccattcccattccggcattgttgatcagaacatcaattttgctttctgtttttaaaacctccgaaactgcattctgaacagcagtgttatctgttacatctgtagggatggatttgaaatactgactttctgtatgttttcggcttagcccgtaaactttatgcccttttttaccaaaatattctgccaatgcaaacccgattcctgacgaggttcctgttataatgatggtcattgaattcttatgattttattatttttatttttcttctgatgccagggagacgtttttttaaagcctatgttcaaaagtaaaatctattttcagcaaatgtaaaaaaagaaaaatgaactttgttatggatacagctgtaaagttgaaagtattctttaaccgatttaaaataatccaatcaatgttagaaaagttattatattttagctctggtaaaattagtaattaattatgctataaattaatgatgaaaaaagaactgctaatattattcttactcaattttagcttttattgtacaggacaagaaataaaaattccagagaatttcactgaacattttattccaaaagtagaatctaaagaatggtttgttttggttaatgctaaagactgttatgctgtcaaaaaggataatggtagattgatcgtagaaaagaccagctattataaagagaattccgaattggaaatcgaagatggaaaattgattggagaaaacaaaggggaatttgggggagcattatactttcagcctaaggaagataaagacaaagttgtgaaaataaaatttggaaacattgttgatattttcagattccaaaataaaatttatttcacagaaggctcagggatttggggaaatttgtatgaattaaataaagattcagctttcacttataataaaatcgaatcttttggggatgccttagaagctgtagccgtatttgatgacagtatttatattgcctcttaccatggctttcataaggtagcggatgaaaaagcaactcttattttcagaaaacagttttgggataatctgtatccaaattctgtcgtagtatttgatgaagagaatatttttatgggtataagaagtgggattgttaaattaaatcttgtaaaaaacaccgttaacttttacagggaaaaagaactataattgtactacatatgatggatcaaaaaaaaataattttcacaaaacaataatacataaaccgcagaaaggcggtttttttattaagaaaaagtttttaccgttagccaaatttaagacaaacttaatctcaactatgcatacaatatttgaggaatgattacttttaattgtgtatatcattgaaatacagttttttaattttattttgtggtagaggttgacttaaaaaagccaaaatttcttaataaaaacataagaaaaccttaatgatgggtgagatcaggctgttctaattttgcacctaatcaaaaaggagatcatgaatgtatttaaaatccctgtatccgtaacttacttaacgggaagggtattacttattggtgcaatatcagcttcaccgatgttcctcgcacagaaaaaagacagcttaaaagaaaaatccatcgacgagattgttgtggttggatacggaacgcagaaaaaaagtaaagtttccggggctgtttcggaggcttcactggataagcttacttccaggtctttgtccggagtaggggaagtgcttcaggggaaggctcccggagtaacagtagtgaatgaaggtggagatcctaacggatcacctaaggtcaatatccgtggtttgggaggtatcaacggagaaacacctttgtatgtggtggatggagtggttttcaacggaacaccttcaatcaatccaaatgatattcaggacatctctgtactgaaagatgcttctgcagccatttacggagccagatcttccggaggggttatccttattaccactaaaaaaggaaagaagggaaatcttactgtagactttgatgttaaatatggtgtaaatcaggcatggaggctgaaagaatccctgaatgcagcagaatttcaggatgtcatgtacaaggcatatgaaaatgccggaaaattaggaagcttaccgatggcttttaatcccaatcagtatcctgacggaagaattaccagaacagactggatgaaggaaatcttcagaacaggaaccattcaggaatacaatgtaaatcttagcggcggaagtgagaaatccagatattttgtagggatgaaccacagaagcctggaaggaattttattgaatactcaggcaaaacgatataatttcagagtcaattctgagcataaagtaaaagactggttaacgatcggagaaaatatgtactataattactctgacggaaacacagcagataccaaaagtggatacacaggagccctggttgctgctatgtactatccgcccaatgttccggtatatacacccagcggtgctttctcaggattgcctattgatgtggcaggtggttacggagatatgatcaatcctgttgcttatcttaaaagaatcagcatcagaaatcctacccatgagattttgatcaatccttatgcggaaatcacgctggcgaaagatttaaaattccgttccaacttctcacagacttttaaactgggagatgtaaagaacttcacgtacagagttctggaagtcgggaaaatttttgataccaataatctggaataccaatccaacaattcttctactgcacttgcagagcagttgctgacttataaaatagctttaggacaacataattttgacttccttggcggttttactttccagaaaacgattgatgatggttttgtagcaaaatcctatgatttcagaagtgaagctgaagttttccaacaccttcagaacgcagcagacaccaataaagatgtttccagttaccggttcaaacagtctttggtttcttatctggcaagggtaaactatgactatgcaggaaagtatatcgtgagtttattgggaagacgcgatggttcttcattggtagcaaagcaaaacagatttgctaattattatgctgtttccggggcatgggtggtttcgaaagaaaatttcatgcaggatatttcatggctttcaagccttaagctgagaggaagttatggtattcttgggaatcttggaggaatttcacctcaggctgtcaatcctttgatgacaagagataacaacgttattttcggacaggatccttctcagaatattgcttattatgccaccacacgtcccaacccggatctgaaatggggtaaatctgagcagaccaacttcggggtagatgcttcatttcttcacaacagtctttccttacagtttgactacttcgtgaaaaattccaaagatcagatcttcaacgtaagcttaccaagtacagcaacgtacaataatcagtatgtgaatgccggattattccaggataaagggtatgaactgggaatcaattacaataagataatttccggtgattttactttctcagttggagtgacaatgagccaactaaaaaatacggtgaagcaacttgccaatgtggatgagatctttatcaatgacaacggggtaagaggggtattgaaaccaacccgggtgaaagtaggtgatcctctgtattctttctatggttataagaccggaggaattttccagactcaggaagaaatcaataattataaagatgctaatggaaaccttatccagccgaatgcaaaacccggagatatcaaatttctgaaaaaagaaggaaacacaggagtgcttaataataacgattttgtcaatcttggaagtccataccctaagttctcttacggattttcttacaacatgacatggaaaaactttgacctgaacttattcttccagggcgtttacggaaataaaattttcaacgggatgaagtttatttctttgaatccaggcggtacaggacagaactacaacatggacagagatatcctgaatgcatggacccctcagaacaccaataccgatattccaagactggtacacggggatccaagtggaaattactcaaaagtatcagatttctatgtggaagacggatcatacttaagactgaaaaaccttaccatcgggtattcattaccaaaagaattatatagaaaactggatgtaaacaaagtgagaatttatatgacttcaaacaacctgtttaccataacgaaatatacaggatttgatcctgaagtaggaatgaactcttacggagtagataccggaagatatcctcaggcacgttcattcatctttggagtagagatcggactataatttttaaccaacaaaaagtaagaaaatgaaacttttcaataaaatatttttaatatcaggaatatctgtaatgcttttatcctgtacaggagagctggatgttcagccggaaggaacacctactgaagccagcttctggaaaacggaaaacgatctgattaccggagcaaatgccatgtacaagcctttgtttgacggtgaattctacggaagaggtttgttctggtttatcaatgccagtgatgatatggtaacaggaagggcaaaaagtgaggcagataatgccaaaaacttcagcagtaattacatcgcggcaggagaccttgaaacccagtggaacaaaagatataatgtgatcggagtggccaaccgtgtgatccgtaatgttgataatatccagacttcacaggccattaaaaacaaataccttggagaagctttatttatgagcagcagaatgtattttgagcttgcttattcttatggaaatgaaaaagccggtgttccgattatcgatcgttcaaaagatccggatccaaacccgattccaagggcggccaacgtaatggagaattatacttacattgtaaacgacctgaaaagagcagcagaattattacctactcaggcagagcttcctgcaaaagattacggaagaccgcataaagctgcagcatgggcattgttggcaaaagtatacctgtttatgaaagactggaataatgcagaattttgggccaatgaagtcatgacaaaaggaaacagagccttattgggaaatttcgccgatgtttttaaagctgaaaataactacagttcagaatacatctggtccatcccgggaacacctaagtttactgcatggggaagtattcttccaggggtaatgcttgaaaacaaaggttggggagaatataacggatggggatatttccagccgacaaaagaactgtatgatgagtacgaagccggtgaccttagaagaagtgctaccattctgaaaatcggagataaatttacttttaacggaaaggaaagaatttatgcttccagtaattctcttaccggataccagttcaataaatatatggatgccttcaaatatcagctgaacagcggtcacgtgagtgccaacggagattatccttgtacagaccttgccgttccgattatgcgttatgctgaagtcatcctgattaaggcagaagctttactgatgcagggaaaatctgcagatcaggaaatcaatatgatcagagtacgtgcaggtttatctccgaaaaacggatgtacaatggcagatcttaagcatgaaagacgttgcgaactggctggtgaatgggcagacagacacagagaccttgtgcgttggggagatgcgcaggcagcttatgctaaacctctgcatggtatcaatggacaggtagtttgggccgcaagaaactttaatccggcagtacacaatgtttgggcagttccacaggcagaaatcgtaaacagtcatgggatcattaaacaaaatgagggctggtaaaatttaatctttatatataagacactctatcattgcagaacattctgtgatgatagagttttttcaaaaataggttgttccattcgacctataaaacaaaagatctacgaatgaaattatcaaaaattgtagccgttctggcactggctgttttttccgaaaatcaggcacagaattatttaaattataatgttgggaatgcacattcgcataatgattatatgcaggaaatccctttttggcaggcttattatgccaattttggttctatagaggcagatgtatttctggtaaaggaaaaactttgggttgcccacacggaaaaagagctttctgcagacagaacactagaaagtctttatctcgataatatttcaaaacagattaagctgaacaaaggaaatatctatcctgatgctaataaaaagcttcagttgctgatcgatattaaacaggattataaaacgtcactggcagctttggtcaatacattaaaaaagtaccctgagatcaccggaaattcaggaattaaaattgtgattaccggaggacgtccccagccggaagattttaaaagctatccaagctatctttattttgacggagatcttgataaaaactattctgctgatcagctgaaaagaatcggaatgttcagtgcagaccttcccggattggtaaaatggaacgggaaaggaattccaagggatgaggaaactgcaaaaattaaaattgcggtagacaaagcgcatgcccagcagaaacctgttcgtttttacggggctccggactttccgaatgcttgggtaaatctgatggatttaggagtggattatatcaataccgatcatattccggatcttaaaaagtttatgaacactattccgaaaaacttttataagaatacaaaagagtacagcacttatactcctacctataaaacagacggagtggagaaaaaggtaaagaatgtgatccttcttatacctgacggaacttctttacctcaatattatgctgcctttaccgcgaataaaggaaagctgaatgttttcaacatgaaatccacaggcctttccaaaaccaattcatccaatgcgtatattacagattcagcacctggttctacagcatttgccacaggtgtgaaaaccaaaaacacttttgtgggagtggataatatggggaaagcattggcacaaatccctgatataattgccgaaaaaggattggtttccggattgatttccacaggggatgttacggatgcaactcctgcagatttttatgctcattcagataacagaaacagttcggagcctattctgaaagattttgcagcttcaaaaacgaaaatattgatcggtggtcctacaagtggattgtctcaggaaaatatacagaaattcaaagatgctaaaatcgatctctatcaggatttgaaatcagtcaataaaatcaataaccgcacccttgtgattgatcctttggcttcacagagaattaccaatggaaggggaaactggctggctgatgcatttgatcttgctttaaatgatttaaaaaacaataaggaaggcttctttatgatgattgaagcttcgcaaacagatggcggagggcatagcaacaatatagagcagctggtcacagaattactggacttcgatcatgtggtaggaaaagctatgaagtttgctgacgaaaataaagagacattagtcattgttgtaggagatcacgaaacaggcggtttaacccttttagacggaagtctcaaagatggctgggtattcggaaacttcagtacaaatgaccatacttctattccatcaagtgtttttgcttacggaccgaattcaaaacaattcacaggactgtttgaaaacacagagatcttcaacaaaatactgtcagcctacggaattcagaagtagctttgatggatacttttttactttacaaagagactgtttcggcctgaagcagtcttttttctctcaataaaaaggccgcctcaaaaagagacagcctttgaataaatctaacaaataataatttagaaattggtgttaacgatcaattgagaaagctcagtactcacaaagtcaatcggcatgattccaaatgatccctgagtattggtctggaagaatgttttaagtctaggattaatattattggatactgtaggaatacttggaataccgaaaattccaggcttgtaaccactggtgaaattcacgaaaagtttgccgttcgtatcagttttagcttcattaagaagactggaaattccgttccatttatcatcattgttcgttaccttataataatcctgaaccttaagttgtactccggtattgttgatgtcaaaagttgtattgtctgcccatggtgaagcattgattcctttggttgttcccgaagagaatcttctgaataatttgatctttcctcttacagctcccagtgtaggaatattggctccaagatcccattttgaaggatttttctgaacataagaatcaaatgtttcttcaaaacttcgggtggtgttggacgcatcatattcttcttttacagacataatgatcgtttcagatggattgctctgaaggaatgcataacacgcatttaatacgtcgtcaaaattcatattctggtaaatcgaaccatgatgaatggcgaaagcattgttaatatgtctgcatcggatatccagaaaacgtacaccggcattcagctgttctgcaatgctgagatcctgggttttagctgtaccagatacaacaggagcatctatacgtgctccggaatcatgagtaccgggtatggaaatctttgaaatggaaatattatcctgaagaccggacatccagttattcagggcaacaggcaataatggagctctgctacttgattttgctaaagaaacagctttcatttcattagaatccctttccaacatactgtcgtttgaacaggagaaaaagatagatgcagttaccactccgagagtaatgttggtaaaacgtttcatgctttgtttgaacatagtttttttatttttaatgtagcttaaaaataaggatatatcaaagcacgaggagttaatttaactttaatagataattaagttgatataaagtaagggatcttgaagttgaaggctggaaaaccaattttttattaacgcaaagtttatttttagtttcggaaatattgaggaagcaaagctgaaatcaataaattgatctttctaagcgaatgcataacaattaagcttcatcagcgacattgtcgccttctttgctttctttaaatagaactatagaattgttttctttgcgtttttaaaagatacagcttttccagatagaagtttctcttaaaaaacaaaattctccttcaacccaggaattttgaacttgtggtctccgataaagaaatcattcattttaataagagccgggaatttacggataaattctttgtgtgagtttgccggtgtttttgcattttcgtcgcaggatgaatattccttgtcaacaataactttacctgtagaaaaattgatttcattcgtaaaactgaaatcacaggtatcttcaaaatgatcgtacaaaccgatcagataaaaatctccgttctgaaatctgaaggtatgtttatatttctgagtatgtcttgaattggtaaaaaaagtttgcccgatttgaaggctgttgttttttatactgacttcaagtgtattgtcagaaggataaaatccgaatccgcttgaaaaaatgatatcagaattttctttccatactttcagaccactgttttcatttttcagaatatagaaaacccttttatagtcacttgtaccttccggcttctgctcgtatgatgcttttatattcgtattaaatacaaggaccgtttcatcttttccatctttgtcaagatcgcctttggcttctgcaatctgagtataacccttcggaaccgaaaaatttttcagcttctgagcagataaacctgaaacagctaggacaatcaaaaaggaaaagaaagttttcatcattattatattcaacttgtttaaacttttgtttttgaaacattaagattgtattaaggtgttgagagtattaagatgagcttcgcttttaagcttaaaaatcagaatgattcatcttaactataatttatctctttaatccttcttaatggttttaaaatatacaactttaaacagcttcattgtaaaaatgtggtaatccgaaatataaatcatcttcagattaccacactttataatattaattaatgagtcagtatgctttcaagatcttcccagaacattggataagacttttccactacatcttcatcttcaatagtaagttcttgaatcagacaaaacggagcaaaactcatagccattctgtgatcctgataggttttgacagaaatatgttcttgtggctctttaaaactgattgattgaatagtgagatctgtaatttctgtttcagtacccagcttctgaagttcattatataaggcaagaagtctgtcggtttcctttacccttaatgttcccaatccggaaatctcaaaaggaattttcagggctgcagctgttacacaaagagtctgcgcaatatcaggacaattattcatatccaggacaattttttccggaaaagaaaaatcaggttgaggttccagcgttagctgatgttcatcttcagagaatgtagttttgataccgaagaatttctcgtagatgccggcaattgctgaatctccttgtgttgattctttgtaaaagcttttcagatgaatcgtttttcttcccaacgcacagatagagtagaagtaagaagccgagctccagtcactctctacttcataatgtacaacctcagcattcttgtcaggagtgaaaggttctaccttgatggtattcccttcaaaactgctttggattccgaacttagtcagaatatccagtgtcatttcaatataagatcttgaggtcacttcacctacaagattaatttgcaatccgttttcaagctttccggcaataagaagcagggacgtgataaactggcttgagatattcgcaggaacatttacggaagtctgggtgatctttcttcctctgatttttaaaggaggaaatccttcattttccatatactcaatttccactccaagatccctcaaagcgcttaccagatttttgatgggtctttctttcattcttccggaaccggtaagtattgtagttttaccttcctgaatagaatagtaggaagtaagaaaacgcattgcggttccagcatgatggatgtctacaacatctgtattctcagatagtgcctttttcagtaactgagtatcctgggagttggataaattcccgatttttatattgctaaacagactttccagaatcaataaacgattcgaaatacttttcgaaccgctgatctgtactgttttatctcctgataattttgatttttccagcttcttcattattattttctacattaagaaatgatgagttaaaaatgtaggaataatttaaaactcatcattgatcattattttaatttttcattattctgatgccggtctttatcccggtcagttttgattttcatttttctgtcgaaagcatcctgcagattaactccggtttggttagccaggcaaagtgttacaaaaagtacgtccgccagctcttcgccaagatctttattcttatcgctttccttttcgctttgctcaccataccttcttgcaataattcttgcgacttcacctacttcttccgtcagcatggccatattggtcagctcattaaaatatcttacaccgatggttttgatccactcatcgacttgctgctgtaaactggtaatttccattattggtaagcgcctagcgttgggttagttgttctggatacattcacaatatcaaaaggtaccgttgctgcaacagccgtatttccctttccaagagctggtgaaccaggttttacccttaaattcattttagccataaaataattgacaaactgtggatctgtatttttggtagtttgaatcactcgtggattattgtcaaaagtgaaacccgagcccgttgcactggtatattttattaatgaattttgaagcaggaattcaaattgctgtccgggagtttgttcaaaatgaatcgcatcatccctgtcagaatacacaatactgtttttgatgtcaagcagctgtaaagctccttgctgcgtctgtccggcatcattcttccattcgttggctgcaaaaattccagacctgtcaaaagaactcatagtattagagtaattggcaatggtagcgtgtgtatagctgtgttttccgccaaggaaaattccgatgcatgataagccacagttattcatcacaaggttgttggcgttcaccgtagaacctaccgcataaattccgtattcaaagaaagtatgaataaatgaattggtaatcgtcgcattggtttgtctcatatcaagccctcttgttcctccgaaaagtcttgcatggttcatcttaagggtagaattggcttccattctgatagaattccagtttttaggaatcgtatcataataagtgtcatttctgtctccacgaaggataacctggtcagcctgggttccgttgatattcaaaacagctccggaagaaactttcattccgctgtttttatgaaaatacactttagttccggcattgatatcaagggttacattaggattaatggttaaatttccgtagatgatctttgctttattattgttccatgtagtagaactggcaattacatttggatttccgggtgtctggataaaaaactcggcatcctgaaccacagaaaataaagttacatgctgctgcccggttgggcctgtgaaaagaattttgtcttcagcaatagcttccggtcccgtagcttccggggcaatctcaacaaatatataaaggctgtccttttttcttaaaggaacattgttaaaatcatatcccggttttccatctacattgattctgtataatgaggcagctcccttttcaagatttacccttgggatcatgatatccttatcttcattattatatacttttacaacataggtttctgaacgtacctggtggtataccgtatcacagaataccgtgtcgctggaaaaacgcagttcctgtgtagggctgtcgaacgtaatatcatctttattacatgatatagctgcaagtaacatccagaaggaaaaagccagtaataatttgaatttcattgaaattaaggtttaagtaagctccaaatttaacgaaaatactttaaatttcttatctataaaaaatattgaatcgagtatttggaatttagaaaaaatgttgtatttttgcaacctaaaatttagcagagaaatatccattactatttcgaaagcaaagtttaattttttaaaaatagtattatgaaaaacggaatccacccagaaaattatagacttgttgttttcaaagatatgagtaacgacgaggtgtttctttgcaagtctactgcagaaacaaaagacactattgagtatgaaggacaagagtatcctctaatcaaaatggaaatctcttcaacttctcaccctttctacactggtaaagtaaaactagttgacactgcaggtagagttgataagttcatgaacaaatacaaaaaattcgctaagtaatttttgtacactaaaaaataataaagtcttccagtttttgggagactttttttattgtaaatttgttaaccttgaattttaaaccttaaacttaaaaaactgaatgatgcagttagtattttcagacgcacaatattgggaagatttccttccgcttacttttacccgtccggttgccgctatgcgatgcggaattcttacattcgctgaaagatggcagaaaatcctggaaaacacagaagttacctatttcactgaaacctatcttcaggataaatttaaaagtccggaggaaaaagaaagtctttttctggttccgaattttctgccgacagaaactgtaattcaacagatcaaagatcttaagcaaggagaagcattggtttatgaggatgaattgatcgctgcaaaaatcaatatgaaaggtttttctctgaatcagattgagaaaatgacagatattaaggaagatcttgttttctttaaaagaccaaaagatctgtttacctataaccaccacgccattgattttgactttgatctgctgactaaaggaaggacctcacaggaactgtcttcaaccaatggattcttaggagataaaaaagatctgtttattgaagaaggagcttatgttgaattttctaccatcaataccaaaacaggtaagatttatattggtaaaaatactgagatcatggaaggttgtcatcttcgcgggccaatagcactttgtgatgattccaaatttaatctgggggcaaaaatctacggggcaaccacagtaggaccacattgtaaagtaggaggtgaagtaaacaatatcattatattcggatattccagtaaaggacatgaaggttttgtaggaaactctgtaataggagaatggtgtaatttcggagctgataccaattcttcgaatatgaagaacaattatggaaacgtaaaattctggagctacagaactaaagcttttgaagatacaggattacagtttgcgggtctgatcatgggcgatcattccaaaactgcgatcaatacccagctgaatacaggaacagtaattggcgtagcctccaatatctttaagccgggctttccgccgaaccttgtggaaaacttttcatggggcggactgaaagatgacgaaaggttcaaacttgacaaagtatatgaagtggcagaaagagctatggcaagaagaaaagtagctttatcagaagaggataaagcgattctgaaacatatttttgatacgtattaattcgattatcataaaaacttcaaatttttttgaagtttttttatttttgatgtaatagatatgtaacggcagttgtcttacctataagaaacaaaactcatgacccaagaaactttcaagaatacggtgtttattctcaaagacgagatgtatcgttttgcgaaacggtttgtcatgagcagtgatgaagcagaagatgtcgtacaggatctcatgatgaagttttggcagaagagggatgagcttgagcagttcgggaattttaaatcctatgcgctgaagtcggtccggaacgaatgcctgaacagattgaaacatcacgatgtaaagatcggctttgcggatatgcagcttcaccgctcggagctttacagtatggaagttgataaccttaaggaacatattgtaggatttatcaatcagctccccgaaaaacagaagatggtcatccacttgaaagatgtagaagaatatgatgtttccgaaatttctgaaatgctggaaatggaggaaaatgcagtaagggtaaacctgatgcgtgcgagacaaaaagtaaaagaacaaatctcacaactgatgagctatgaaaaaagatcaattacaagataaatacaacgaaatcttccgggagatcaaggaagaaaaaatggactggagctttgaagattttcttcagactgcagaaggtgcggaacctgaacaggatacgacacccattattccactggacagaaaaaagaagccctcctttcccaaatggttctggatggcggccggagtaatacttgttttcagtatcggttttttcctgaacaactataatacggatgttcaggacagggaaaagctggtaaaagatgaaatcctgaagcagaaatcgggttttattgaagaaaacagtgatcaccaggaacaggttgccgttaactataccgattctatttccggagcaaaaaaagattccgtatttcaggataaccaggtagcggaaaaagatgtaatggatgaaatccttccaaaaagaggaagacttaaaaaggaaacaagaccaagatatgtcagcaatgcctcaaataacaaaaatttaagtgattccgcagcggcgtacaatgactcttatgtgattgtaaacggaaaaagaatcagcagtgaaaaagaagccatagatgttgcaaaatattcctttatgaaattaggaaatgaatttaaaaaaacggtagcatcttctcagaaaaacgaaaatcttgacagcgaatactaaaaatcagatcaatctcatgaaaagaatattttttataatagccataatgctaagcagctttgcaacttcttttgcacagactgataaactgaacaagctttttcaggattttgaaaaaaatgggggagtaacatccatcaatatcaaaaaaccgatgttcaaactattaaacaccatcgatgttgatgatgcttacgtaggaaaaataaagcctattttgaacgatgttgatggtcttaaaattctgatcatccccaaaattacctttccggatcgtctgaaagatgagaatcttgcgaatgtaaaaatgaatgaagagaagacagacagggtgaataaagctttgaaatctctcaatttcaatgagctgatgtcaatgaacagtgacggaacctctatgaagtttcttgcagaagatgaaaaagataactatctggaaaatctagtgttcaatgttgattccaaagaagagaatattatttttattcttaacggaaaaatgaaactttctgatgtaaataagatcatcaactcaggtgaaacagcaacatcttctgttacatcttccgtgagaagcagtcttacttcagataatacatcctcctatctgaacggcgacagcagaaatgtaggtgaattctcaaaaatagatgccagtgtaggtgtaaatgttacttttaaacaggaaactccaagaagtgtaaaagtaattgctgatgcagacaagcttcagtatgttatcactaaggtagaagatggggttttaaagatatatgttgacaataaaggtgtaagaaatcttagatttaaaaatctcaatattaatgtttctgctcctactattaatagtataaaaacgtcatctggaagtgtatttacagcagtaaatcctgttacagaaaacagtctgacaattgaagcggaatccggttctgttattaaaggaaaattcaatgtaaaagaagtggcggcagtggaagtaagttccggttctgtattggacgttgatataaaaacttcaaaactggtattagatgcttcaagcggagccagtataaatttatcaggagaagcggcttctgcagtagtagatatcagtagcggtgcttcctgtaaagcagatgaccttaaaattgctacagcggttgcagaatctacttcaggtgcaagcctctccctgttagttaccgataaattaaaggtgaacgtttcatcaggagcttctgtgaagctgaaaggaaacccggaagtagatgcgaaagtagacaaagtttcgggaggaagcttcagacaaatcaaataaaaaccacactatgaaaactcttaagaacattttcctcactattctgactgtaactatgcttcaatcgtgtatcgtttcagaaaaaccgaacatagatttttttcagaattcaaaatatgattttaaaggagcggagtttgcgagtgttaatgttcctatgtttcttgccaaatcttatattaaaaaggctttaagagaagacggagaaaatgaagagacaatcaacctgataaaaaaggcttcaaaaataaaagtgcttaccgtgaccaacggaagcagagaaatgctttatgactatgcccggtatctgaatgatcatcattatgaagaatgggcaaccataaaacatgacggagataatatcaatgtaagggtaaagcaggatggagatgtgattaaaaatatgctgctcaccgtaggttttgatactaatgaaatggtattcgtagatgtgaaaggtaatttcacaccaaatgatatctcaagaatgattaactctgtttccgctaaataatcctggcaattccaaatcttcaacgcatggaaaaattaataagagaagttcggatccttaaaatctatgcagctgtacttactatattatgtctcatgtttttctttctggcatttaaaaatcaggcatccagcgaacgctttaaagaaatagatgtagaacggatcaatatcattgagaaagatggcactttaaaaatggtgattagtaataaagaacgccagcatcccggattggtaaaccacaaagaaatgaaagcccgtgaaagagaagcgggacttatattctttaattctatgggagatgaatgcggcgggctggtatacgatggaaatgataacggttccggaatggtatattctgtagatcagaggaatacagatcagattatgcagctgcagtattctgaatcagcagggaatgataaaaaaagagcatatggattgaagctttgggacagaccggataattttccattggaagatcttattaaagcaggagattctatcaaaaaactgaacaatccggaagcttcaaaaaaagcatttgcccaactacaggaaagtggcaagctgggaagtgaacgtttctttgcaggtaaaatggctaatggcgatgtgggtgtttttatacgtgatacaaatggtaaagtaagattaaaagtgtatgttgataaaaataatcaaacccatattgaaaatctggacgagaatgggaaattggttaaatagcttttatcaagaattataacacgtaacaagtagtttctacatattcaattattttgtaccgtaaccgttctgttaaaaaagagcggtttttttgatttaagttattgattattaaattttatttaaactattaaaaaggattttcatatctcaccaaaataacctaattttgcaaagaaagtaaagatgtctattcataacaaaattgtagagacagccatcactttcgatgacgttcttctagtcccttcttattcagaagttttacctaaccaggtttcattaaaatcaagacttaccgacaaaattacgctgaatgttccgatagtttccgctgcgatggacactgttactgaagctgatctggctatcgccttggcaagagtcggagggttaggctttattcacaaaaacatgacgatcgctgagcaggctgctcaggtaaaccgtgtgaagcgttccgaaaacggaatgatctcggatccggttacattatctaaagatcatacgctgggagaagctaaagatcttatgtcaagatataagatttcaggtcttccggtggtagatgctgataacgttctgatcggaattattaccaacagagatgtaaaatatcaggaaaatcttgatatgaaagtggaagagatcatgaccaaagaaaatctgatcacttcagataaggataccaatcttgaaaaggcgaaagaaatccttcttaagaacagagttgaaaaacttcctatcgtagataaagataataaacttgtaggactgattaccatcaaggatattgataatcaattggagtatcctaatgctaataaggaccagaacggtcgtcttattgtaggtgcaggagtaggagtaggtgaagatacgctggcaagaattgaggctttggttcaggccggtgttgatatcgtagctattgattctgcacacggtcattctaaaggagttttagacaaaatttcggaaatcagaagagcatatccggatcttgatgttgtaggtggaaatattgtaacggcagaagctgctaaagatcttattgaagctggagctaacgtgcttaaagttggggtaggaccgggttctatctgtacaacaagagtagttgcaggagtgggagtccctcagctgtctgcaatctataacgtttacgaatatgcgaagtcaaaaaatgtaacggtaatagctgacggtggaatcaaactttcaggagatattgttaaagctatcgcgagtggtgcaggagcagtaatgcttggttctctcttggcaggtacagatgaagctccgggagaagaaattatcttccagggaagaaaattcaaatcatatcagggaatgggaagtctttctgcaatgaagagaggaggtaaagagagatatttccagagtgaagctaaaaaattcgttccggaaggaatcgaaggaagagtgccacataaaggaaaactggaagatgtgattttccagttgacaggaggtcttagagcaggtatggggtattgtggtgcaaaagatattgaagcacttcagaaagattctaaactggtaatgatcacaggaagcggattgaaagaatctcacccgcatgatgtaattattacacaagaagctccgaattattctttataaaacgataattcaaatttaaaaaaccgcataatattatgcggtttttttatttgtgattgtttttaacatcttgatttacagtattttatttttaattgattattttgttgtattgttgaattatttatgtttttaattgttttttaattataatttaaataaaataactaccatttatgatcgtgttaatttaattttttgtttaaaatgtaacaatgtttaacttttttctactaactataataaaattttaaattatcagccttttttcagtgagtaatattgctgatttatatttaatattaataaatttacaacttgtttaatttttttaaaatattgaaatgaagaaaactatcctttgtggggcattgttactatccctttcactatctgcgcagcaaaaaaaagagtggtgtgattttgataatgaacagagagtacaccaaaaacagaatggggaaattgatgaaatgattcgcaatatccgtaacaaaattattagcagtaatcagaataccgcttctaaaaatgggagtgcctataaaattgtaaatggagtttatgaaattcctgtagtagtacacgtgattgtgcctacaggttctgctctcggaacagcttacaataaaacggatgcacaaattcaggcatggctggatcgttgtaatcaaatgtatgcaggtacttatcaatgggcgcagggaattcctgctgattttggtactgctgctacaatgccgattaaattggtattggctaaaagagacccaaactgtaatgccactacagggatcatcagatataatggcggaactcttacgggatatgatacatatggagtaaagcgtagtggtaccaatggtgttactacagatgaggtaaaaacaattgcacctcactggcctgaggcttcttacttcaatatctatattatgaataaagtagatggtggtggacaatatggaattatgggttgggctggattacctcaaaatgctgatgctaactacgaatcctttatgaaatcttttgtggttacattacaagacgatattacgcttgctcacgaatttggacatagtatgggactgcttcatacttttggtaatgctaatgctcagccgccacaaggaacaacttctacaacttactgtccggcaactaccaataattgtgctacagctgacgatcaggtttgtgatacggaaagatcaagaagtttattgaatgactttccggcacctaccaacaatgatatgaattattgtaccggtgcaaactatcagggggtacagtataatatgatgaattatacgaacccgatagcatttaaatttaccaatggacaacatgacagagccgccctgtatttctttttaatgaaaggatccctgagcacttcgttaggagcaacagctccttctgctgctgcttcgattggaacacctatcgctgcaacatgtaatccaagtggaataaccactcctgatgattatttcgtagggccaactcttgtaaaactgggaaatattaacaatgcatctacaggatattggactaataatgctaatttttatgaagactatacaggagcaagttgtctgagagctacatcaactgaacttgccgcaacaggtactcataatcttcaggtaaatgtatcaggatcaaataatgatataagagtctggattgattataataataacggaacgtttgaagcttctgaaatggtagcttcagctaatgatattatagcagatccgactacggaaataggtacttacagtactaacattacggctcctgcttcagtagtacttaatactccgctaagaatgagagttcttgtagatgatgagaaccctaatatgacgccttgtggacaattaatgtatgggcaggttgaagactatacagtaaaattcgttaccaacttaggtactagtgaagtaaaagcagataacggagatttaactatttatcctaaccctgttgcaaccggagacaaaatcttcattaaagctaaaaatggtaagaatctaaaagtttctatttctgatatgtcaggaagactgatatcagctccatctgttactgaagaaggaaatggtgttttcaaagttgaccagcagttagaaaaaggagtttatatgattcaggtttctaatggaaaagattctaagtcatctaaattgatcattaaataagctaaataccgcttattataataaatataaatgtctccattcttatggggacattttttattcaatcttaatatatttaaatctgggcttgataaccttgttcaggaattgccctttagatcttgcctttccaaacttttcaacaatatctgcagggactttcagatagtcataaaccgcacctgactgatatataattctcaatatttcagtttcagggaaataaatgaaatgatttacaacacttgatggcataatacgattcatgcaaaaaatattccttatcctgaaaataaaaagcctccggaattaccggaagctttaagtatgtattaaaaacagcttattttttcacaaatttaaattgatgagtctgaaaatttcgggtacttatttttaatatatagccaccaggaacaagttgcgaaacatcaattctgtaatcaaacatgtctgattttacaagacgtccatccatattataaatctggatagacaaaccgttatcaataccggaaatactgataaaatctgttaccggattagggaagatctgaattttatttttagcaagctctgaggttcccaatgttgtggtctgtacatcacccgtcatagtggaatttcctgtagtaagatttcctccacattgtccgttggtcattgctgtattttcaacccatgttccgacattattacctggaggtattgataatgaattatttcctgttgaattataatagatcagataaggagtggtaaaagttccattgccctcatcgcctagaaattcccatcttgtaagagtattattccattgaatcttaaattcacaggtgcctaatccactgcaatcctgtccgccgtcaatgggagttgtcatataaatgttcttgttaaaagcatctacaccggttttattaaaaataaatgtgttgggagggctgctgaacagattaggacatccactaaatgttatggtctgtgccaaagctgtgcttccggctatcagacataataagtaaagaattttcataagtattaattttgtgatgggtaaacccctgccaatgcaatgatgcatttcagggtaataaaaggaggcctgttttcatgaggctggtttcctcctgtatttcctatcatcgtgtttttcatacttgtatttgctgctgtatcagaatattctttatcaagaacttttgtgtctgccggaagattattggttggtgaattttggtttccttctgctgttacagcacttacagtatgattatgggctggcatttctgttatagttaatgttacgctttcagctcctccaatttgccccatggtgtaagtagtaccccctcccggagcctgtccattatgtacaagtacccttcctctcatatcaggtaaggcaaatgtggtagttccatttcctccataagtggttcctaacaatgaaaaaagggcttggttttgagcgataggcaggagctgcccattacattctgcccaatattttggagcaaaattataaggtacaaaggctatttgccctaaaaatggttctgatgcctgagcttttagagcaggagcaaatgcactgcataccagcagtgtacatgcaaaaaataagtttttcatgataataaggattttaagtcatataaaattagaaaatatttcgcataaaatacctcattaaaagaaaaacctttcactataaagtaaaaggttagattttatttatcaaaattgatattattatagattttttctctaatatatatgtcctgatttattctcttagtttttcaagttatccttaaaatcatcaattctgaaatctgtcagagcatttcctttttcaattttttctttggaatacaatctgaaatcattttctgttttttctaaaagataatcataaggtcctatgtgagaaattagctttaccagaaccggagaaatctcgagacatatgaataatcccatgataaaagctgctgcaagtcctataatagcggaatttttaccaagctcatccagtgcctgaagtctggcagcaaatccattgaatttatcttcaaaagtctctgtagatttcctttctgtttccagattggtatatacttttgaaatttccttgtctaaatattccagtcgtggagctgattgtttttgaaagttctcaagatcctgtctgcgttgctctttcaattcctgtttacgttttgcattgggtccataaccttcttttccgctggttaaaccggattgttttcccagaatttctttttcaagttcaacggaagccgaatcataagctttctgatactgtgctatttttcctgagatctgttgcttttctgtctcaaaaggaccgctttgctgaagaattcttccgttcatttctccctgaagctgttttttatttctttgaataatggtattcagctgtttgtttacttctttttcaaaaattttaagctccagtggtttggaaatgataattcccagaaatgtagcaagtataagacgcggaatggccatcagaatctgattccaccacgttccggttttcttgatggaagaaacaatataacggtcaagattaaagatcattaatccccaaagaattccaaatcctacagcagcccaaatattatcaaatactgtatacatagcataacctgcagataatgtggcgaacactgcagtaaaaagtacaatccctcctattccggaaaatttattccattcacttggagtctttcttaagatatggatgttcccgcctgaacataccatcagaaatttttggaaccagtttattttatgagtcccttgatttatagtttgttggtttgttttcatacctgaaaatttatacaaaggtagtactaaaaatcataccaatgtaaaagatagtattatgttttaccaagtaattgtatgtatttgtgtaatgtgttgttttttaggaggttaaatttactttatgaagatttgctaaaaaaatagtaaaaattacttcaatctgtccggattctgctttaaaaaactttcccatccggaatacgatttggtatccgtaatggttccggaattgaaatgatgacatactgcaactgcaagtccgtcagaagcatctaaatatttggtaggaaattcttttaactttagaagattctgtagcattcctgctacctgttccttgctcgcatttccgtttccggtaatggccattttgattttttttggggaatattctgtaatagggatatttctgtaaagactggccgccatggcaactccctgggcgcgtcccagcttcagcatactctgtacgttttttccgtaaaaaggagcctcaagggctacttcatcaggatgaaattcatcaataagagagagggtcctttcgaaaatgtatttaagtttagtttcgtgattgggatatttttttaagatcagttcatgaatagaaaccagctccatttttcctttttttacggagatgatgccaaatcccattacagttgttcccgggtcaatccctaaaattattttctctgaaatcattgctccaaagatagggactttctctgtttttaatgaaaaaagtattaataatggttttatattatgtttaaaattttaatacctttaaataaaaatgattatgaaaaatgtatttaatgtttttattgttcctgtttttctgttgtttggtcttcaggatggaaataatttagttcagaataagcattcggacactatgaaaacaaataatgaccggattatttatttgtttttcaaggcagacaaagatcagtcaggaaatgcaaaaattacgctgcaaagcacaagaattactgagggaaaattaaaatatatgccttcttttgaaagggataatgtccgtaaaggtgatcttatcataacacttacaggttctgctgataaagaagagggaaagctgcttgtaaaggatccatttaacccggaaatggaagtctatgaaaaagaaggaatttccagacataagccttctcttcagaatgcagaattcagtacccgcttttcatattctgaaaatgttcagtctgtgaaaattgaaaaggcaactgatgacggtgtacaactcatattcacgcaaaaactataattatgaaagaagttttattatcccttttgataggcagcagctgttttgcccagacattcgagaccgttccccttttgcagaacggagataacagtaaaagaattgttattgcagttttaggagacgggtttacctcggcacagcagtctgcttttacgacatctgctcaaaataccgtcaattatctttttacaaaaagtccctatacagaatataagaattactttaatgcctatgcagtaaaggtaatttccgcagaatccggggtaaaacatccgggaacagcaacagatgttgcagagcctgtgattcctgtaaccaatcctaataactatcttggatccactttcgatgtaggagtccacaggtgtatatacagcaatactaccaataaagtaggacaggttctggccgcaaatatcccggactatgatatcacttatgtgctgggtaattctacagagtatggaggttgtggtggtacgtatgcgtttgcttcattaaatggatcatccaatgaaattgttgtacatgagctggggcactcttttggaaagcttgctgatgaatattggttttcaggttcacttgaatctgcaaataaaacacagaattctaatcctgcaaccataaaatggaaaaattgggtgggattgaatggagtaggagtatatgctcatgcagaaagcccaagttggttcagaccacatcagagttgcgagatgaggtatcttaatcagcagttctgttccgtatgtaaggaagcaattatagaaagaattcatactttggtttctcctgtggattcttatactcctgcaaataatacgactgttaatgctacttccaatgttacttttacggtcaacgaaatccttcctattccgaatactctggttaacacctggaggttaaacggaacagtattgggagcaacaggaaatactgttacgattaccccgggacagctgaatagcggaagcaataccctgactgtttcggttgttgataataatccgcttctgaaagtagataatcacagtacacttcatattacaaatgtttcctggacattaagtaaatcaactctaaaactttcagaagttaaagcagaagagagacgattcagtatttatccgaatccgacagacggagagtttttcattaaaagcaaacaggagttttcaaaaaatataagtcttgaagtatatgatgcttcaggaaaactgattccatccgggtttgaactgaaagattcttcaatacgggtcgatcttaaaaactatcctgcgggaacttatctgctgaatgtaaaagaaaataatatcctgatcatttcccagaaaattataaaagaataaactaaaagaaaccggctcttgggccggttttattttttcagtttcttttctgcaataggaatccatcttccatcatgacgtaaaagtagtattttgtcaactaagaatttcgttttgtattcctttgttttatatttttcccacgctttgagataattctcccaggttaaatttctgtatccgacagtcatatgtggattaaaagaatagtggccgaaattaaaatgttcttttaccttatgataaagttctgctaagtgtacattttcttttggatgaatataaagtacagggtttttaggattgggaaagctcccgaatccatccagttcaatttcaaaaggatccatttctgtattgattttctggaaagctgtgtgaatatcaccttccagttcaggttctcttgaaaaaggagggagaagagtaatatgggcctcattctgcagtgctttggaattgtcataatgaatagccagatctcttttaaagttttttacttcttcaataatctcttgcggaggataaactgctatgaagtacatttttttcatggaacaagtttgatgtgctttataatgtaatgtcagattattgttttgatctcagttgcgaaagcgtattttcaagatggtcagtaattttttttacttcaatatgaggtctgaagatcactccttttcctttttcttcatctgcaatattagataaaataatgacagaggtttttgtgtccgggtaatagatgttcagagaaggggaaccttttacatagccactgtggaaataagaattgggttggccgatattcagcataattccataggcataacccatttttccaaagatggcatggcgcctttccgcactttttgccataaaaagtttcagtgtttccggttttaatatttttccgccatacagagcgttattccatgcatgaagatcctgaatggtagacaatattccgccagccggagttccgatttcctttcctcctaatcttttcggcatgttgggaacttcctggaatttagcaggcgtgccaatataggcactcgcaaaattatttcctttaaaaatatctcccgtagaagaatgtttcattcctgcctttttgaaaagttccagaacattctcatcatatgatttcccggaaaccttttccacaatttttccaagtgtattaaagccgtcgttagagtagaagaaatctgccccgctcttaaacatcagctttccacccatgatatttaaccctgaggtatggtttaacaattgatgtatcgttatattctcatattctttggtctgaaattccttcagatattttgaagctttatcggttacgttcagttttccctgttccatctgcagtaaaattaaaacggcagtgaattgcttgcttacagagcctatggcaaaaatagtattgctgtcaatttttgtttttcttttaaaatctgaataaccgttttctcttctgtaaagaggtaaagagtctttgaaaacggcaatgcttccattgaagtgatactttttaaaagcagaatcaatctgttgttccaaaagtgttttctgaaaagctgatatggtagagtctataattgcttttttatcaacggcattgacttttggagcttcagtggtacaggaaaacaaaaaacagaaaagggacaggaatattaaatttttgatcacaggtgttgtatttttaaatgatgattgtattcttaaagatactaaaatatccaaaagagcattatgggatgcaaattgcgtgctagaaaggggtttttataccggctctttgtcattttatggttcccttttaatatttttgaataatatttgtcacaaaattatgaatgaacagttgaaaaacgattcagcaaacgtacgccatctgctggatattgtcaaagaacagggaatagaatacctgaactctattgaagaaagatctacatcggtagtcaaccatacattagaaaaacatgcactgcctgattcaggatatggaacggaagagactctgcggatttttaaccagaaatttgaaccggtaatggtagcttcttccggaccaagatactggggatttgtaaccggtggcgctactccggcatctgttgcgggagattggcttacaactatttatgatcagaatacccagactatgaaagggcagggagatatttcaggagttatagaagtggaagcaatacggcttttgcaggagcttcttcagcttccggaaagctttttgggaggttttgtaacgggtgctaccatgtccaattttacctgtcttgctgttgcccgtcaatggcttggaaaagcgcttggaaaagatattgccagagaagggatttctgagaaaataaaagtgctgggtgccactcctcattcttcgtctattaaatcactttcgttattggggttggggagcaataacattattcagattaaaattcaggaaggaaacagtgaagctatttgcatagaggatcttgaagaaaatatcctgaaacttaacggtgcgccatttattttaatttccagcggcggaacggtgaatacagtagattttgatgactttaaggcaatcagcaggctaaaagaaaaatataacttctggtggcatattgatgcggcttttggtggttttgcagcctgttcaaccacacacaggcatctagtagagaactgggaacttgcggacagtattacagtagactgccacaaatggatgaatgtaccttatgagagtgctgtatttctgattaaagaacaatataaaatcctgcagattgaaacttttcagaactccaatgctccttaccttggagatcctttggataatttcaattatttaaatttccttcctgagaattcaagaaggctgaaggcgctaccggcctggttttctcttatggcttatggtagaaagggatatcaggagattgtggatgataatatatcctgggcggaaaaatttggagacctgattgaaaacagtaatgattttaaactgctcgctcccgtaagattgaataccgtttgctttacattaaaagatgatacaaggcagaatgaggttgatttatttctggaaaaggtcaatgatacagggaaagtcttcatgactccaactttttacaataatcataaagggattagagcagcttttgttaactggatgaccggtgaaaaagatgttcatgccgtatttgaaattatgaacgaagtttttacttcattaaaataacatcttgaaaagcctgtggactattatccacaggcttattttactaacagatcacagaaccagaaggtatattctccgtcttcctcttcaggagttgttttgggtttgggataggttttcttgaccgtttctccgatgtcaaaccggattggatttttgaaaattggaccgtcaaaagtaaaggtgtgaaattctccgttttctccgcatggatctacattttcaggaagatcatcaatgaacttctgatcaataatccggcctgcaaaacttttatcaaggtaagatccgttcacacatgttacaatcgttttaaagccaagggctaaaaattcatggatgaggttggatgtatcttttttccaaagcggaaatacggctttcataccgactgcatgtaattggtcttccctatattttctcagatcctccaaaaaaatatccccgaaaacggaatgcgtaataccctgagcctgaattccagccatcgttgtactcatgatttgctgatattcttccatggacggttctttaggaagttccattttaattaatgggattcccaaactttcagcttgcttttccaacagagaaacatgaaccccatgcatagaaatccgttgaaattcctgattgatactggtaaacagagtgctgatctcgtattgatcttcctgtagtattttgtaaagggcaagcgcagaatcttttccgctgctccagttgaataaagcttttggtttcattgtaaaaataaaaatagataaataaatcaataaaatctgattgattggctctggacaatctggaaaactatctctttattaaatagaaacctcatagcacataatgctgtgaggtttatcggttgatgattttatttcaggttaatgtctctttcctctgccttagcttgatctaaagtggatcttaccccttgtattgaagattcgtagttgttatctttccattttttcaatgtaacatttttcatattcaggctagacatgaccaggctttgatcagacagatcaattaaacttgtattcaaaaaggtatgagccatctttcctgtttcaatcattccgtaataggagatcataaagccatgatttacatctgcaaataataattcatcaatattatacttagcttttaaatcactaaaatcgtatcgtgaatatttttttccttctgcttttgtaccattaaacttttttgccgttttggaatcaaatttttcatcaataatgacaacttctttcccttttgattttagaatctcagagtacattgcaatcaattcttcttttgggtggattttttcaccaatgagattcaatgcttcctgatatttatctccagaggtaactgccatatctaaaagcccttgtgaaccctctttgtattttgccggtggagttgcattcactaaaattcctacttttgaagacttgtcccagtatgtaggagttagagcaactttaggtaagcagcttgtaagtactgttaatgctgcaaaaaaaagaaataattttttcataatttaaattaaaatgtgcgcaaaattattaaaataccttgaaggctgaaagtgttgaaatataaaaacctcaaagaatttctttgaggtttgatttataaaaaatgtatgtccattaaggcttacatatttcttctgtatttaccacctacttcaaataaagcattggtaatttgtcctaaagaacagtatttcacagcatccatcatcacttcaaacaagttctgctggttgatggctgcgtgctgaagttttcttaaggcttcctcagacttgttttcattggctttctggaagttatgaagagattcaatctgtgcctgtttttcctcttctgtagaacggataacttctcctggtaaaaccgttggtgaaccatcttttcctaagaaggtatttactccgatgatcggatattcgccggtatgcttcagccattcgtaatgcatagattcttcctgaatttttgaacgctgatacatcgtttccatcgctccaagaacacctcctctttccgtaattctgtcgaattctgcatatactgcttcttctacaagatccgttaattcttcaataatgaatgatccctgaagcgggttttcatttttagctaaacctaactctttattgatgatcagctggattgccatggctcttcttactgactgctcagtaggagtggtaatcgcttcgtcataagcattggtgtgaagagagttacagttatcatagatcgcataaagcgcctgaagagtagttctgatatcattgaagtcaatttcctgagcgtgcagagaacgtcctgatgtctggatgtggtatttcaacatctggcttctttcatcagctccgtattttaacttcattgcttttgcccagattcttcttgcaacacggccgattactgaatactcaggatcgataccgttggagaagaagaaagataagtttggtgcaaaatcattgatgtccattccacggcttaagtaatactctacataggtgaaaccgttagccagggtaaatgccaactgggaaaccggattagctcccgcttcggcaatatgatatcctgaaatggaaacagagtagaagtttcttactttttccctgatgaaatattcctgaacgtcacccattaatctcagagcgaattctgtagagaagatacacgtattctgagcctggtcttcttttaagatgtcagcctgaacagtaccacgaacggtagcaatcgttttagctttaatttctgcatatacttcagcagggatcacttcatcacctgttaatcctaaaagctgcagtcctaaaccattattggatggaggaagctcaccgttgtatttcggcctttctaatcctttatcatcaaatttttctttaagtttagcctctactttagcttctaaaccattttctttgatatatttttcaacattctgatcgatggcagcattcatgaagaaagccagcagcattggtgcaggaccattgattgtcattgaaactgaagtcagggcattcacaagatcaaatcctgaatacagttttttagcgtcatccaatgtagcaatagaaacccctgcatttccgatcttaccataaatatccggtggtaaagcaggatcctggccatacaatgttacagagtcaaaagctgttgataaacgttttgcaggcatttctgcagaaacatagtggaatcttctgttggttctctcaggacctccttctcctgcaaacatccttgtcggatcttcaccggttcttttgaacggataaatacctgcagtataagggaaacttcccggaaggttttcctgtcctttccatttgatcagatcgccccagtcattgtattttggtaatgctatttttggaattcttaaatgagataaagattcagttgatgtttcaactttaatttcttttcctcttacaaaataagaatagaactcagcatggaatgcttttttcgtatcatcccatgttttaaggaaatcgatgttctcctgctgaagctctttttctgctttttggtactcagcatccaaagcttcattggaaatcatatttttaactccttcaatatgatacatctttctggcaagctcagcctgtttttctacattggcatcatattgtttgttgttttcgacaatttcagaaaggtaacgaactcttttcggagggataatggttacttcatctgtgatttcctgctcaacaaaagtatttaagtgtaaatcagcaaacttttcatttacttttgaaaccaatctgttgtataattcagtagtgccatgatcgctgaactgagacgccttcgttgcataaaccggcatatcttccagctgactttcccacaaaaggtggtttctctggaattgttttcttactgcctgaagagcatccaatgcaccacgtttgtcagatttatttaaagcgacaagatctgcataatctaacatatcgattttctccagctgtgtggaagctccgtattcaggagtcattacatacatagaaacatctgcaaaatccgaaacttctgaaccagactgcccgatccctgaagtttcaaggataataacgtccggatgagccagtttcaatacattcagtgcagaatgaataaacggagaaacggaaacgttattttctctggtagccatggaacgcatataaactcttggatcattgatcgcattcatacggattctgtctcccaaaagagcacctcctgttttctttttcgaagggtcaatagagataatggctatttttttatcagtattcgaacgtaaaaaacgtcttaccaattcgtcggttaaagaagatttacctgctcctccggtacctgtgataccgatgatcgggatggttaaatctttggacttctcatcgattgcttttaccagctcaggcttctcatctgaaaagttttcaaccgcagaaatgatttgcgcaatgctggaagggttttcaaaactgatatcatcaagatcttttgctgtaacatcttttcctgtagcaaaatctgatctttgtaccaggtcatcaatcattccctgaagaccaagttcacggccgtcatccggagaataaattctgtcgattccataagacataaggtctttgatctcttccggcaggattacaccgccgccgccgccaaaaattttgatctgaggcgagtttttctctctcagaaggtcgtaaatatatttgaaatattcattgtgacctccctgatatgaagttaatgcaatggcattggcatcttcctggatcgctgtatttacaacttcctctgctgatttatcgtgtcccaggtggatcacttcgcatcctgttccctgaataacacgacgcataatattgatcgcagcatcatgcccatcaaataatgaagcagctgttacgattcttaccttgttggttggagtatatttttgggtttccataaaaattctagacagtttctaagttctcaaatatagtaataaaatgaaaacctcgtattgtgaggtaaggttctgatttttaaacttttatggtaattgttttttaagctcgaaatactttgttagaggttaggtctgtattttacagattactacactattctgtaaaaatataaatgtcagcagataataaccgctgacattttttcttttgtgtcatgaagtttggtctttatttcataaaaaatgatctgtattattatttttctgaaaaaagtgtttttcttttgctgtccaatccccagtttaatcctaaaaatgtaatgagattatttttgtcgccataattttttccaaatgcagcattgatgtacacactgtcagacactttatagttgataattccgttggaacggtaagtgtcatccaaatcactgcttctgtagatgaactcatatccgatagaaaatctgttgtatacaagctctatttttccaccgaaatcataattatcagtcctgctgaatccgctggctgcatcataaatcgttctatcctgcaggtatcttgcaacagcatagaagtttaatcttttctcaatttttgaggcgtctgtggtgaaggcttctttgatgattactcttgatttttcatcattttgatcttcttttttctttggagattttgttctttccagattgatcccggaactcatggtgatccagaatcccagtttcccaaactgattattcttgaactgattatctaaaaagaaagtactgtaggccgaagcaatatctaattgaaaagcaggtttttcatcaagatactttttataattttcggtttcggtcttgtaataatctgggacaaacttttctaatgcttttgccttcatctcatttttttcatccgggctggcattggatgcttctatatcattatactcctttgatttttcaaacactgcctggatatcttttaattgctttgaaatgttatcatttgaagtggtaatagcttctatgttttttttattccttacttttaagatagtggttcgtaaagaaaaagataccgaagggttttccgtgtcaaggtcttcaattttataattcctcagaaaggcaaatgagacagaaacgtttttggcttcactgaaaatgttatttttatactcataactgttatctggttttttaatgcttttaatgcctgcatattttaaagcatccatctctgttaaagtaaataaatgggtaggagtaagttctaccgcataggcattgggaaggccgtcattttcgctgaatgaattgacaatactgctcataaaagccttttttgatttcggggtctccagatcagaacttgctaagccgaggagcattacacttggagcattggaaagttccaatttgtttaattctgcactgatttctttgctttgagcaaacaataatgccatattagacaccagcgctgctagtagtactatctttttcatagctcaacttttatgtatttataaacaccatagataaacttaccggctagatcatcggttgttttaccttcaaaaggattgaagtgaaaatttttggaaggaatctgagggaattcaaactttatcctgcatgtattgattaagatctgcagatggttcacctgcatattaatattgaaagaagtagcgaaaagtaaattgtctgatgctaaatctgcttttggaatggtaaaagaaaatttatcatcatttaaattattgtcatctattctctttccgttaatgataaaatgcgggtcgccaaattgtgtattggcactgattattacattcacttcaacattattttctttaaagtgcgtaatttttactgttttttgagggatttttttcatgtctgttaatgttgtattgtgtattctctcctaaaatgaggaagaaattttagttttgattacttcaaatttatggtttatagtattggttgtcaattacctctttgggtactattatttaatataatgaagttaaccgattttgtttaatcagtttatgaaacctgcttttaattcatttattaaaatatttacaacgattccatagcccgtttaaattctctacttttgcagaatatttctacagacatgcaaaaagctttgatgtatttcgccttgggaaccgttgtaagtttccttatcaattatttctttttaagttctgaaaacatcggactggatatttactatgcctttgcctttggctcagcctggggaattgcttattatctggatactcctgattttacgctgccaaagaaattaggcctttcatttgtggcaatggggcttctggttcttttaggaacattgatttttacgcttgaactggcaatcccttctattctgaaattttcaacagttttcgttgcctattatttatttgcaagtttcagaggcaataaatcccttagaaactagtgcagcataataaagctcagatacatcagcaccaggaacatcagaagcaatccgatataattaacaataaataataaggagcctttcagtatacttattctttttttggtttcatataccctgtggtgcgctacaaagaaatagatcgtcatataagtagccagcgccagacatgccagaacatatagtaaggtaagtatactattgtccggtaggaaacttgtgattttttctcctacgataaacatcagcactcctaataagagaaaggagaaataatggagggtgaaaatcccatgatcaaaataccaccattttttcttattatgaaacagccataaaaagaatgcaaatatcgggaggtacacaaaaagtgctttgggaatagtatggatgaagttttccttatatttttcccagatctgatgtttactgtatccttcttcttttagatcaaatactttatttgcaatgggacgcatcaatgtgtagatgccagtattatctttagcacgaatagaatcatattgcttcatcgtgtaggctttcataatggatgcttctttagtatcaaatgtactgtcaaaaagctcatctttttcctgttcgtcttttatctttaaagtatccagcgttttttgtgctgcagcagctgtttcatgagataagagacctcctttctgcaaatcttttacaacgtctttagagattttcttttgcttttctgcttttacttctgttttaatagggctgggtttctctgcctcctctttggcatgaggtataagattgggaagaaagaacgtaataaaacttatgaaaatatatagttttacaggtgctacatacaattgtctttttcccgccagatattccttcgtaagtttgccgggacgggtaaaaagatactgtatggttttccagaactgtccgtcataatgagtaaaatcctctatgaaatgagtaaaaagaaaatgaaacggctgtctgctttcaatgttttcctgcccgcagtgggggcaaaacctttcttcaacctgatgtccgcagttaagacaggttttatcatctcgtagttttccgtggctcatgaattatggaatatgattaccacaaatataattatttaagtgaaaatataatgatatgggaggattttaaagagaacgttaaagtaaatttaataaaagaaagagttgagggaataaactctttgctgtttcattgtgctttcagaatcttcgaaagtgttttttcatcgcccatcagttcgcaagatttatgccaaagctgtaaataatgttaaaatctattgatactggggtatatagctaataatatatagattaaataaaatatgtttttgggttacaaaaataatttgtacctttgcacacccttttaggggtaaattatgtttaatctttaactaaaacgtgtgaatacattaagttacaaaactgtttcagcgaacaaagctactgctaataaagaatgggttgtggtagacgctgaaggacagccgttaggtagattagcttctacggttgcaaagattttgagaggtaagcacaaaacgaactacacacctcacgtagattgtggtgataacgtaatcgttttgaatgctgggaaaattacactttccggaaacaagtgggctgataagacttatatctggcatacaggatatcctggtggacagaagtctatgactgcggctgaacttcaaaagaaagattctttaaaggtattagagaagtctgtaaaagggatgttacctaaaaacagattaggagctgctatccttaagaacctttatttatatgaaggaactgagcacaaacatgaagctcaacagcctaaaacaattaatgttaacgaatttaaataattaattatgtctatagttcacaaaatcggaagaagaaaaacttctgtagctagagtttatgtaaaaccaggttctggtgttattacagtaaacggtaaagacgctaaagaatatttctctacagatgtaatggtttacaaattaaaccaaccgttcatcctttctgagactgttggtcagtatgacgttaccgtaaacgtattcggtggtggaaatacaggtcaggcagaagctatcagattaggtatttcaagagctttatgcgaaatcaacgctgagttcagattagcattgaagccagctggtttacttacaagagacgcaagaatggtggaaagaaagaagccaggtcagaaaaaagcaagaaagagattccaattctcaaaacgttaagatttctcgttggcagatggcttatggctattggctacaggaatgtattaaattttttttaaacttaatctcggcgaaaagcccattgccaaaagcaaaaagcagaccgccaattgcccgttacgtttagcatccaaacgcttctcccatctaaagaagttgttgattgtttaaaagacggaaagtaaactaacaaaaacagaaaacatggcaaaagcaaatgtaaaagaccttttagaggctggcgtacacttcggtcacatgaccagaaagtggaacccaaatatggctccatacatttttatggagaaaaacggtattcacattgtagacttacataaaacagcagttaaattggatgaagcttgcaacgctttagaaaaattaacttctgcaggtaaaaaagttcttttcgtagctactaagaagcaggcgaaagaagttgttgcaaaacacgcttctgaacttaatatgccttatattacagaaagatggccaggtggtatgttaacgaacttcgttactatcagaaaggctgtaaagaagatgaatgctatcgacaaaatgaaaaaagacggtacattcgaaactttatctaaaaaagaaagattacaggttgacagacaaagagctaacctagagaagaacttaggttctatcgctgacatggttagacttccatctgctgtatttgtagttgatatcttaagagagcacatcgcggtaactgaagctaagaaattaggtattccagttttcggtatcgttgatacaaactctgacccaagaaaagttgacttcgttatcccaggaaacgatgatgcttctaagtctattgatatgatccttagcgtagtttctgaatctatcaaagaaggtcagtctcaaagaaaagctgataaagaaaaatctaaagaagaaggagaaaaagtatctgctgatacagatgctgatttcgatgcagaataattgaagattttctttaatataggaaaaacgctggatttcgatccagcgtttttttattgtttatatcggattacaggccgtcttatagtacattagatgtattggtttatatttccattaaaaataaaaacctgcagaatcctgcaggttgtatttagtttgaaagctttatagaataagaagtggttatgaattttgtagattgatacgttgagttacataaaactccggataatctgtagttttgatttttaggaaccatcgtgtatccaatctttcctgcaccgatagggattttcttgaaaaaattacccccgcttattgtaagtaccatattacatggcgatttgttttcaaccgaaatagaagttctgggattctgtggatcatcattgttaagaagatcgttaagaacttcagctgtttccggtttgtaggtctttatgagttcattatattctcgttccgtattggctctgttacctgttgaattaccggcaggataagggtaggatgttcttccgggataaccgccgtaatttacattacagccggcaagaatcactgaaaatccggcaaaaactaatagctttttcatactactattttattttttgatttttcttttgtttgatggcttcttgttctgagcttcatccttttcggttgtactgttttctatttctgccgttttcggactaccaaccgttacaaatatactttttttaatatctttctgggagaaatattttatatcacagatattactgctcagggtatatgaacctttattgattacaataaaattttctccgtgtgcaggaacagcgaggttataatagtcttttccctcaacccgtaatacaatattacaatccgaattatttttaaataagagtatagcctccttgcgtgtaatatcttcattgaacattgcgttcagaagcttcactgtcttttccttatgttcagaagaagtttctgcgataagttttttaaactcttcagcatcatctgaattaggatttctcatgatgtttttaggaatatcggagataacaggccttgcttccataggcttggctgtacaggcaccttttgtccactctgcattttttaaggcaataagcttgggctttagtacgcttttcttcggatcatcagggtgagtattcttaatatactcttcaatttctttgatatcaatgcttttcagaatatctttatttctttttttctgtgcagatatcacgttggggaacagaaatgtgaagattaaaaataatacgattaaaggttttcttttcatcaattgttattttatatcatgagcttatccggaatttgatataagtaatggtttttcctttggctgagaaaagttcttcataatatgttttgatatctctcagatgttcggtgttcgggtcatactccggagctccatagatgtcgtgatgagcactgatgatttcatagccggctccctgtaaataacctaatgtatagccatgtaaaaactctgaatccgttttcagatggatgataccaccaggcttcagaaattttttatatcggttcaaaaagtcaggatgagttaatctgtgttttgttcttttgaatttgatctgtggatcaggaaacgtaatccagatttcatccacttcattttcagcaaagaaatagtcaacaagttcaatctgtgttctcaggaaagcaacgttattcatattgttttctacagcttctttagcgccgaaccagaatcttgcccctttgatatcaattccgataaagtttttctcaggaaatgcttttgcgagtcctacagaatattcgccctttccacatcctaattccaaaacgattggattgtcgttcttaaaaaagttttctctccattttcccctgagttcgaatccttttaaggcatcttctcttgtgggttggattacatttggtaatattttgttttctgcaaatcttgctaatttattcttgcccattgagttataaaatgagtgcaaaaatactaaaaatttatggagaatctctttcttttaaaggtaaaagacaggaagatacttcagttaaaattaagattaatggcttcccaacgctaccataattggtctttcaatggttttttgtgaagcatattgggctccgcaaaccagactggagaaaagatactggcctttttcaataacaatagaaccttcaccctgagccggaactgccagcctgtacttggtggttcccacgccttcaattcttacaataatattgcagtctgacttattctgaatcatgacaatacattccttagcattaagatcattatcgaataaagaattcaggatttttacagttctgtttttgtgctctaccggggacactgccatcagcatattgaattcttcagcttcagcattaggaatcgctgtattagctgttgcatttacaacaaatgtattctgggcattacttggagtataaacagtagtgggttgttttgccgccagttcagccttatattttgcaatctgtttttgtttgatgatggcgttcatttcatcaaaggtaatctttgtagaaggccttcttttcagcatagcaagcatttcctgcatatcttttaccttctgatcagcaggatgtgcgtttttgatgtattctctcatcatttccataacccttggtttcagaacggatcttcggggatcatcaggatgagcgtctcttagaaaggcattgatctcatagatatttttacttttcagaatatcactgtagtctttcccttttttttgagcagacacagtaaataaaaacatacagctaagaagtaaaagtacttttttcattaattaatatttaattaggaattcggtgctcctcctttaatttgtgttttggttgtttagttttattggataacgaaatatcctgtgtttttatttttaaacacatgtttgtgagataaaattaaacatatttttgaataatgaagaattatatggggtaaaagttgaataattcatattgtgaacgttgcgaacggttattggaaggcattttccggctattcgaaaaaaaataatccatgtgttgacatggattatttaatattatttgatctgaattcttagttgctgcttacaacctcttgaagatgagaacttctaagtcttttctgatagatcggaagatatttttcaataggaattttaatcgcttcaaaattgcctgccaatacataagcttgaatattttcagatgtataaacaaactgaaggaagttatcaatcagattttcaggaattttaaatttcgcaaaataatcttttccaaggtaatttttaatctgtgcaacagagctattcattctttcgtaagcctgataacgttgttttttctttctttctccggaaaggatgtcatagatactttcaagactgaaggtaagacctccgtctctcagcccggctacaggaagttcaggaggtgttccgtcacctttcggctcgggaagaccaattactttcttaagcgcatatgctttgtcttcttttcttaaagcgtttacatcatagcgaagattccctgtaggcttgaacctgctgagaacgatttcctgaatttcataatacgcgattttaagctcaacaaggtttttttgttgcattaactgaggagtcagcttaatatcttttctttcggtaacaatagaggtaaaccggatcacatctcctgcgttggcaggaatattaaaattaccgttgtagtccgtaagaacggttttctgtgtgttcaggtttgtgacatagacctgattgagatataaaatagagttgtctctcaaaaatacctcaccggaatatatttgtgcattaatttttgcaagaaaaaccaatagcagtagagtaaacagtttcttcatataatgcgcaaaattacatagaaataaagcaattttacattattagatgaagaatagtggttaaagttatattaaactttgggatttaattgttaaggagtgttagaaatttgccattcatttaaaaaatgagagatttatataaaaatcaggaagaaaaagagtgatatatttaagttgcttttttctcggttttgctatctgtgttttacaagcagccagcttgtgtattttaccattaatgtagaaccatattcagtccaggtgataaagtaccagtaagttgcagtaggaacatatctaccaccgactcttccatcccaggtatatctgttttcaggagtccctctaaagacttctgcaccatatctgtcaaagatgcggaatacaagattatcattagccattagggcagaataatcgattccttcgttataaccatctccattcggagtaatggtattaatcaggttgatgatagcaaatggttttttgacttcttcacacattctagaatcccttacgaatacattgtgtccccctcttggtacattgtagaaaatattggaactttgccatattaccccgtctaaagaatactcataaggaggagtgccaccacttactccgacttttattgttgttccatcaatctcaatagaggtaatcatgggaagaggaaattcagtaacattcacatactgtttgtaaacacagccattggaggtaagctgtacccaataacttcccggagcgacattggtgatggaaggagtggtagctcctgtgctccataagtatttttcaaaaccaggccccgcatcaagtgtggtagtggttttcggacatatagctttatcttttaatacatctgattttttaggaactttaatgttgattttgagagtacctacttccggacagacatcatttttttcgaaacggatataataagtctgagaatttgcaatattaacaggtgatgaaattatatttacattgttccgggcatcagataatgtagcatgaaaagtgaatgaaacattcggatccagtgtaaactgaggaataaactgagccagattgacactttttactccatccaaatcatcatcacaaatactttctgtaacagtgtcagtaataagtgttaatttggctccaatactgaattgtaatggcttgatgacagaagcacatccatccggagaatctactctgatgtaaatcgtagtagtagctgtataactccaattgttaggaagtgtattattgtttccggcgttggcatctgccagactcgcataatatcttacattagtaaaataatttggattgttaagtacaataggggtgatattggaaagtatgactgtaactgtcccatccagattatcatcacagaaaattccattgtaattatccagaataatagctttattgaaaagagataatgttatttgcgcaatacttttacacccaatattgtttttgacaacggcatatatgatagtagtattcggtgctgtatatgatgttgcattggttatcattgctgctgcattttcattctgtgcatctacgagagtaggatagtaagtgatagtaacagaggagttgttggtgatgttagctgtagtcagattgaatgttccttgtccatttatatcacaggcagataatgttgcattcattactgtaagagcctgaatattgatagtaactgttatcgtttcacaatccggaaagtcaggatcatttccacaaaatgtatatatgaatgtgtcagttcctgccgtgccaggagtatttacagtgtaagtaataacgccggttgtagagtttataactgctgtacctaatgttggtgcagctgtaatagctaccgtggcgggaacaggagtttgtgatgagctgctgaaggcaggtggtatagtctgcgaagtacaaacgttgtaggaagtattggtaagttttgtacaattcagaaccttaaatttttcagtaactaaaggtgcacagcttcccattgttacagagcacgtataatatccgggtagtgtaggagtaattgtagatgctgtagcccccggaacaagtgtaccgtttctataccactgataggtatcgtagataagtggatccacagtaagaactaccccaggaatacagccaccgccagattgtaaaatgacaggctgcgtaggaaaacctgcaaaaaaacctccgtaccctacagcatcactgccggcagtgatgcctgccataatagccttgtctgaaactacagtaatagtacctgttatattaggaattccatatgtaacccagttgttggttcctgtcatattgtagggacctgttatcgcaggaggattggtgccatttactgtaatattagctcctctttctgtaataagattcagttttgttggaatgttcagaatacccccgggattaccattagaatggacaaaattttcattaataagtcccagctcattaatctgcttcggaaggtaacagttcaaagcaggaataaagttaaatcctccggtagccgtttcattccccgaatttgaatctcctgctaaaatctgatagacataagcattttttgatgttttgacatataaattataatgtccgtttccctgaagaatatatttggaatcaggaataacaaaatatttccctgcatttatggtagcgacaggagggatctcattattgacaaaaatctgagtgttgtcttctgtggcaataacaacggcaccttccatattggcaccaattggcccattcccttttacaagagcaaattcatttccaagcctgttgacaggtactgcctggtccattaaaatatctgagctggacggaaagtttcctgcatattgcccgttaaaatttccattagtaacattaatgggcttgtttgaaatgatttttgagccaataaaaccgtcagagttcccggctatattgccgatcccgtcaataatgtatgattgtcctttattcaaagtaaaagttattgtcggattcgtagctccggtcattccgtttgaaaactgaacagtaggactatatccggaaatggtaaccgttgtattatcttcagttgcgagtacactggtcataaagtttagaatattattgcttacacttataggagcagaagctgcataaaacgtttttccggtagaaggaattcctttggaagtaataatttctgcatgattgaatactgaaaaccttaaattggcataaaaagggaagtctgctttaagatataatcctttggttgttggagtaaataaatcagtctgttgtgtggtaataatataatttcttaacacatcgaatttttgcggattatttttactgatatttactgttccgatcagaacattattattataaatgtttactggaaagggagttgttctgctagtggatagatatagtttttgataaggattgggggcgccggttctgtctatcattggagcaaaccaatgctctcggtccaattgggcaaaagcagaggtgaaaatataaaatataaataaaaaagatagaattttcttcattcagtaggagtatttgtcacaaatttaacaataaaaaacattgaattattgtaaatgtaataaaaaaagccacgattatacaatcgcagcttattaaatatagttttaaactaattattactctctgttcttaacaagaatccaacccgtatattttattggagtcttctccttattggattcattccatgtaatatgataccagtatgttcctgttcccaatttcttatcaaaatgttttccgtcccatctgtagttattgaatctgtttccggtgaataccatatttccgtatctgtcatacactacaaagcttaggttttctttataagcaagctcactgtaatcaatgtaatcatttacgttatccccattaggagtaatagcatttaacagattaggaatggtaagttctacagcaataggggtacagttataaaaatcttttacataaaaagtatgctgtcctcttgtcaaacccgtaaaagtatttgaatcctgccagttagcagttccgtcaactgcatatttgtaaggagctttaccgccgttgacaattacagttgctgtattgttgttgatctcaacggtttggattaccggatcttcaacttttttaacttttactgtctgtgtaaggaaacatccgcttttaccaagaattactgtatattctccaacacctacatctctgatgcctgaagtggtagcaccagtgctccattggtacgaatcgtatcctggaccagcatccagattagtttttgcgtccatacagatatactgatctacaagtaccggtgactttttgataggaagtacaatcagttcaattttcgcatttgcggtacatccttcggcagtggttacttttacatatacaaatcctcctgttgatgggaagttttccggagttgtgatttcattgatccctgcagtaagatcattcagggtacgataatatttttttacaacagcgttatagtctgttaccttagctttcgtaagatcgaaataagcataaggtgccacatcataccagcaagctttaatggatgtatccgtaacaatgaatggtactacagtaaggtttagcgtcacttgttcacaatctgtaaattcaactgagtttccgcagaatttataaactattttatctggtcctaaatatcctggattaggtgtataagtgattgttccgtttggatttactacagctgttcctttcgtaggaggggttaaaattactactgtacttggaaccaccgtttgtgtggaagaagtaaatgtaggagttataatttttgtagaacaagcatttaatgcctgagttgtttcttttaaacaggtttgtactttatagattggagttgtcacaggcggacatgtacccattgttacttttacggtataatttcctgactgtgtaggtgtgtaagtataagtagttgctccaggaatagctactccgtcacggtaccattggtatgtttcgtatccgtcatctacttccagaataattcccggaacacattctcctgctttcttggcgataacaggaatggatgagaatccggcaaaataccctccgtaccctgctgtactataccccccattgatccctgctgttacagcttttgtggaattaattttaatatttcctgttactcctgttattccataagtaacccaattactgtttcctgttaatggaaatggtccgtctgtagcaaggggaggaacatcgtttactaatacagtggcgcccgcttcagttagaatatttaattttacgattaagtctccttgtgtagtacttgctccgcctggaccaagtggcatctcattaattttaccgatttcatcaatttttctcggcaagaaacagtttaatggcggaatatagttgaatccgttggttgcagcatttgatccgattcctataaactggtaaagatatacattcttggtagttgaaataaacatattggaatgtccagtaccttggcttacatagcttgtttcattgattctataccattgtcccgatgcaagtgttgcaacaggagtggttccaccgtttaaataaacttccgtgttatcttcagtagcaataataagtcctccttccatgttcaggttaggagctgtagatctggtttttaccattgcgaatgtattgccaagcctatcaaccggaactgattgatccagaataggatctgtaccggatgttggggttgagaagttaccgttgcaacttccattggtaagagttacaggcttatctgcaaccactttggctcccatgaatcctgttttgttagcagattgcgttccagagcctgcaaaaatgaaagattgtcctttctgtaatgtaaaggtatgagaattgctggttggagttccgttgataaaaactactccggcagtagggttccatgttacagtgacattagtattatcttcagtagccaggatgccggcagtaaaattgtaaaaactgctggtatcagtattaggactttgagcaacaaaaaaagttttcccaattcctgcctttcctttgctggtaataacctccccgtgtatatcctgagcaagtcttaaactgcagtagaatggttttgctcctttcagatagagtcccttattgataacagtaaaagcatcagttgttgaacctgtagaaataaggccgttggcaaccttataggtttgtgggttacctttgctgatcgtaactgtagtaataggagcgttattgttgtagattatcacatcaaaaggtgtaggcgagtcagtagaaagatatatcatattggtatagcttccgtaactgtcataataaggagcaatccaatgctcggtatccctttgtgcaaagagtgtattaattgtcaaaaaaattaataccagactgagtagaaatcttttcatgtgtatggaattaggatttctacaaaaataaaataaaaaatgaattacttttaataaaatttaaataaatgttaaaaaacaccctcaatttttaactaaaagctatattgggtatgaaactggtaatttggagtttgcttggtaataatatataagctgaattgttgtaattataaagatgtttaagaataaaaaatcccggtgaatttcaccgggattcaatattttttttggaaagattgattaagctaagcttactcttacaaatcctgtcacttttaagtctgcgtttacagattttacataatcagcaactgagatacttccgtctttaatgaaatcctggtgtaccaaagtgttatctttgtagaatctctgcattttacctttaaggatgttatcgataatgtttgcaggcttaccttcttcagtaagtttgtgtctttcgatctctaattctctgtcaatagtttcctgagaaacagcattttcgtcaagagcaattgggttcattgcagcaacctgcatagaaacagctttagcagcttcttcagctccgtctactttagcagaaagagaagtaatagcagcaattttatttcctgcgtggatataagctcctaagaaaggtccttggattctttcgaaagaaccgatttcaattttctcaccgataactcctgtttgctcaactaatttctcagcaacagtaattccgtggaagtcagtagataaaagttcttctttagtagcagcgaatattgccatttcagctagttcgtaagctagctcaatgaacgcttcatttttagcaacgaagtcagtttcacagtttaaagaaattacagcacctaaagtgttgtcttcgtttactcttgcgattactgcaccttcagtagactctctgtcagctctgttagcagcaactttttgtcctttttttctaaggatatctaccgctttttcgaagtctccttcagcttcaactagagctttcttgcagtccatcatacctgcacctgtttggtttcttaatttagctacgtctgcagcaactggtgtataagacataatatctattattttttatttaaagattagtattaatttttagcttaattttagagcagtgcaaagataatgattttaatgataaactaaaaaatgacttttcacgttattaatatatttaatactattttaaaggtttgattaatgaaaaaaatcttcttccttctatttatatgcatttttgctctaggtttttcccaaaaaaagaaaaaaacaaaatctaaagctgttgttgagaaagaaaccgtaattatctatacagaacaggaagctgagacttcaaaagaggcgagagtaattgccggctttttaaaacagaatcccggacatgccaaaacagactacttcaaaaggaaactgattgatattattatggcggataattcccctgaagcaaaaccaaccattaagcctatcagtaaggaaaaaattgaaaatattgttaagaataatgaattgaacagcggaaagacgatagccgctaataaaacatatactgccaatgggaaacctgtttctaataatacagcagctgctatagaagctttaaaagaggaaagaagaacaactaactttgcatctgtaggttctgcaaaaagtgccggtacttctaaagccggacccagtgaagaaaataaaagaacagcagcaatgcttacacacctttttaataatgatattaataaaaacgaagcatatatcaatattaaaaacagatccacctgcaatcttattgtaaagataagtggtaaaaaatattataatctcagtgtacctgccaaaggagaaaattttattctcgtagataaaggtgaatatgtgctgaccacaatggtttgtgatgcaaagtattcatccttgaagaaaatcacccaggatattgaaattgcactgaatattgaataggatttttaattaatagaatagaagaaaactaaagcaaaaaggttaagaaattttttcttaaccttttatttttatcctttaaactgacccatcgcaatgaacttgtcctgtctctgggtttcaagctcctgtcctgtgaatttggagaaagctttgatgttttgtaaaatcgaatttttcaggttcaaataggttgtctcctgatcataatgagcgccaccaagtggttcttcaatgattccgtcaatgaatttttctcttaatgcgtcctgaggagtaaggtttaatgcattggctgcatcttccttatgatcccagtttctccataagatagaagaacagctttccggtgcaattactgtataccatgtattttcaagcatatatactttatttccgacacctattcccagtgctccgccgctggctccttctccgatgatgtaagtgaagatcggagttttcagctgcaccatttcaaaaatatttcttgcaatagcttctccttgtcctctttcttctgcttccaatccaggataagctcccggtgtatctactaaggttaccacagggatattgaatttttcagcaagcttcattagtcttaaagcttttctgtatccttccggattgggcattccaaatcttctgtgttgtctttcttttgtcgttcttcctttttgagtccctatgatcattactctctgaccatccagggtaatcaatcctccaatcattgccggatcatcagcgaaatttctgtctccatgaagttctaagaaactgcctttatctgccattccgtggatgtagtctaatgtataaggacgatccgggtgacgggacagttgtactctttgccaaggtgtaagatttccatagatttcttttttcttttctaaaatcttatcctcaatctggctgcatgctaattttacatcaacaccactttcttctcctactaaagaacacgtctggtattggtccatcaattctttgataggaagttcgaaacttaaatattccatttcttgaagtaaattaaatctttcaaatgtatgaaaaattatggttattctatttaaaattatttatagcattgtttattctggagatactttcctctttaccaaggatttccagaatatccggtacatccggccctttcaattctcctaccaaggaaagacgtaaaggcatcatcactttacccatgcctaaccccttattttcggcgaaatcatgcatggtttgcttcaggatttcagcagtaaagtcggcagattcaaatgttgaagccaattcacctaaaatggacgatgtttcatcattccatgcttttttcgaagctttttcatcataggaagttggtgcttcaaagaagaattttccgttttcatagatatctttagggaaagtcgctctttctttcatcagatgaataacctttagtaacttttcatcagatacaccggaaagatcaaggtctgtatttttcaggatctgaagaagttcttcgtcagacttcatctgaatatactgatgattgaaccattccgctttttctttactgaatcgtgcgcctgctttatgtactttatgaagatcgaattccttaatcatttcctccaaaggaagaatttccttatcatctgccggagaccatcccaatagcgctaccatattgatgaaagcatcaggaagataaccgttttctctgtatcctttagagattataccggtagcaggatctttgaaatcaagagggaataccgggaatccgaacttatctccgtctcttttgcttaatttcccttttccttcaggttttaaaattaaagaaaggtgtgcaaattgtggcgcttcccattgcatggcttcatataataaggtatgaagtcctaaagacggaagccattcttctccacggattacatgagagatttccatttcatggtcatcgataatgttggcaaaatggtacgttggcattccatcattctttaccagaactttatcatctaaagtatttgtatttacagagaatttcccacggataatatcctcaagattcaatactctgtccacaggcattttaaatcgtactacataaggagttttttcatccagcaatctctgaacttcgtcttctgaaagggcgagactgtttctcaaacggtttcttgttttattatcataggaaaagacatcacctctggcttcgtattctgcacggatggcatccagttcttctgcagtatcaaaagcgatataagcataatctgttttcaggatctgctcagtatatctgtcgtagatatctcttctttcagattgtctgtaaggagcaaactttcctccttttttaggactttcatcagggatgattccgcaccattctaatgcttcctcaatatattcctcagctccttctacatatctggcggtatcagtatcttcaattctcaatacaaactcaccaccctggtttttagcaaaaaggtaatcatataatgcggttcttacgcctcccaaatgtaacggtcctgtaggacttggagcaaaacgtactcttactttctccatttcaatttaaatttttgcaaatttacttaaaattatgcgtttaagagatgatttatgatctcgtattggtttttttggatgtaacttttttatttatttctacagattttcgataaatactgttttaaagctcttatcttatatttctgataataattttgattatggattgtaatctgtgaatggttgtattatggatattaaagtcataaataataaatattgaatttgatgtaaatggtcttttagaaagaacgttaaaatttatttcataatttatttttttttatttaaatcactaactggagattgtttaattctttattcattagtatttcatgtactatataaaatcactaataaatgacatatatcattttagtttttgcttttcaccgaatcttgaattttatatttgcagagaattttaaaataatactatgaaaaaacaaattttatttagcctcggtacatcgctgatgcttttcatgggatcatgctcttatgaagatctgaatactggaacttctgctcctgacaatccggcaaaaaccaatcgtttgtctgctgcaaaatttgcaggtgatggggtttatgatgttttagggcatggttttaatgctactggtgagtatgccaatgcaaactctgccggttttaaagtaattgatatcgacagatttaagacagaacaggcagctaggcttatttctgaaaatgccaatactcaacaatatattgaagaatacggagagaatgctgagacttattctaaaatggtttctacgaaagtagatgctacagcgggaattcctttgttcaaaaaaacattatctgtgggattcaactctgcggtgactaccaatcataaattcgatgcaaaatatatttatggaagttataatcttctaattaaacagaaaagactgaggtttaatgcaacaacagatatgcttgctgattacgtaactcctgaatttacacaggatttacagactaaatcaccacaacaaattgtacaggattatggtactcacgtgatggttgatatttatacaggggcaaaaatggatattatgttccagtctgaaacgagcaacgaaagtcgtgaacgtgctgcaagaataggcgtgaaaattggaatgcttaaagcttttgatgtagatgttcagaatgatgtgaatacatcagaatcttctatgaattattctaaaaagctatcatacaggacaagaggtggagatccgtcaaaaggtttggtaggagaattaaatcttgatcagtcaaccccaaaaataaatattgcgaattggcaaaacagctcaacagctaataattctgtgttagttgaatttggaaataacgggttggttcttatttacaatctggtaaaagatccagctaaaaaggctcagcttaaggcttacgtagatcagtatttattggataaccagatttcactggaatataatacgacaatgttatatggttatcaaaatcaggcagacagtaatcattattttacttttaataccaatcttcagccctcttcttactggactaacgaaggacctacgtttaaagtattccagtataaagcgcctaatacagttccgatttactgtttcaagagtacttcaggtgctcatcattattacacgcagtcaagcacattacagccatcatcctattgggatgtttatatgggaatagcattttatgcttataaagaccccgcagctgacagaattccggtttataattataaagcaaaaaatcaatcagatcattatctgacagtgaatcctaacctcggaccaacaagttattgggtaagagaaggaatagctttctatattcctgctaattaaatttcagaaatttaatataaattaatttgataatattattaagtgcagtcagtggttttggcttcactttttattaatagagttttaatggaatgattaaatttacttaataatgacatttatcattgcttagttcttttttcactcagtattgaatattatatttgtgaaaacttttaaataacctatgaaaaaacaaattttattttgcttcagtagtctactgatgctttttatgagttcatgttcttcagaagatctgaatcctgaagtaactccggaaaattctgctaaaaccaatcgtttgtcagccgctaaattcgcaggagatggaatttacgatgtattgggacatggttataatgttgccggtgagtatgccaatgctactgctgctggttttaaagtgatcgacattgaccgtttcaaattggagcaggcaagcagattgatcagcgaaaatacattctcacaggaatacaccgaagaatatggagaaaatgcagaatcatattctaaaatggtttccactaaagtcaacgctactgccggtattccattattcaagaaaacactttcagtaggattcaattctgcagtaactaccaacaataagtttgagggaaaatacatctacggaagctataaccttacgattaaacaaaaaagagtaagattcaatgctactacagatatgctgggagattacctgaccccggaatttgctcaggatttgcagacaaaaaccccacagcagattgtacaggattatggaacacacgtagcagttgatatctatactggagcgaaactggatgttttattccaggcggaaacaagaagtcagagccgtgaccgtgctgcaagaattggtgtaaaggtaggaatgaaggatatctttgatgtagatgttaccaatgatgtaaatacttcagaatcatccatgaactattctaaaaaattggcttataaaacaagagggggagatccttcaaaagggcttgtgggagatctgaatcttgatcagacaaatcctaagattaacatttccaattggcaaagcagttctaatgcgagcaattcagtccttgtagatttcggaaataacggattggttattatttatgacctagtaaaggatgctgctaaaaaagctcagcttaaggcttatgtagatcagtatctgattgacaataaagtgtacatggaatttaatacaattccaatttacagatattacaatggagtagatcattattatacaaaaactccgggaagctacagcggatattcttttgaaggaacagaatttaatgcattcttatataaagctccgaacactattcctatctacagatactggaatggtaaagatcactactatacaagaactccgggatattaccagggatatgtggatgaaggaatcgagtttaacgcttttgctactcaggagcctaatacagttcctatctacagatattggaatggtaaagatcactattattcaagatcaagtgtaagaccttcgggatatgtttatgaaggaattgaattttacgcatactaaaaatattgatattttacagcaaagaagccgtttcaaatctgagacggcttctttcattaaggagttttatttataattaattatgtataaaagataagtacatatgaacatttcatatatccttatctttttaaaatgtatttttgtaccagataattattgaaaattataaatgaaaaaagcaatctgcctttttatcgttggagaaaagtacctgaagctattcaataaatgcaaagctcaatttgaaaattatgctaagaaatgcgatgcagaactcttaattattgataagcccttagatgagacctttgtacgacctcttctatctcaaaaattactgattccttccaaaacagaggagtatgatatggtgctttttttagatctggatattgtcatatctgaaaatgctccgtctatttttgattttctgcctgaagataaatacttcggtgctgttttggatcccagaggtactgaggaatttaataagacatggggacatattcccagaatactggaagagaccactgaaatctattttacagaccgtcactttgatgctagcccgttgctacaaggaagtataaatggaggagtatttgttttccgtcctaaaaaagtaagtgaaatttttagcagctattatttttcagaccataatcaaggagcactcaacagtttcgaagaaacaccttttgcatattattcccaaattaataattggtttgaggcattgcctgctaaatttaatactcaggttttatataaaataaaaggtacatctattggtcatcagattgaaaatgatgaaaagaaagttcctaagtttttaaggaaatattattataaaaaaaatgatgcctttttttatcctacccggaaatataaaaactttgtaagaaatatcattaaagataactattttactcatttttctggtaattaccctataatatacatttaaattatgcacatactttcacgtttatttagttcttttattactgtatcttacgcaattacagtaaataatgaagttaaagaattaaaaaaattactggatatccttttaccactgattgataaaaatgatgaagtgattgttcttcaggatataaccaatgaaactgtagaggttacaaaacttttggagaaatatagtaatattacaaaggtgcaggccaggcttgacggtgatttcgccgggtttaaaaacaatcttttcaaatatgctaaatgtcagtatctttttcaaattgatgctgatgaatatccaacaaaagatcttatcaaatcacttaaaccgtatctgcgtaaagaaagacgtggagattgtttttttgttccaagaatcaatactgtagagggtattacagctgattatattaaaaaaatgaactggactataaatgataagggatatatcaatttcccggattatcagcccagaattattaaaaataataaaaaaatattctggaagaatagagtgcatgaaaccttccacggctttaaacgaattaaagaaatgcctaagaattataacctttgtctaatccatgaaaaagattttgaacggcagaaaaggcaaaatgaattttatgaaacgcttgcagattaatcttcccaaaaatactttctgtttttcccggtaagtttattcttcatattttttatttttacttttaattttacaaaagttagcttacgaaggccatttaccttatcttgtaagaccctattttgttcctctaatgtctgatgttttagcttcatcagcatgatttcgttttctgtattgttcttttctaaggacaaaatattgtgttggatataatccagcctctttttcattttggcacctatagcttttgcattgaagaggtacatatcttcacgggcttttgctccaattttttgtgcctcttcattattgctgaatacaaaattcattagctgtgcggcatgaatgacatccggctcagcccaggaagaaccttgttgtaactgaccaacactttttgttaattctaccattttatattttacagcatatgaattattaacattcataaactctaaattacctgaataacctgttgcaatcactggttttcctagagccattgcttcagcgatcgtcaatccaaaaccttcggatctatgcagtgatatataacaatcacattgatttattaaagccagaagattttctcttcttagcatttcttcaacaatgataatattttcccgattctgaatccttttcagaatagtttctttatcttgagggaaataggtaggaattgaggtctttattaccagttgcacattctcatcgtttggaaaggctttttcaaaagcatcaataacagcaattgtattttttctttccaaatgactgttataatcaaacataaaaaggaatgtaaatttatctttactaaaactgaattctttttccttatcaatatctttatcttttatatcaataatgtgcggtatattaataaccggaataggcgattttgctgcaactattttttgacaaaaggaagatggcacccaaatttcatcaaaaagactgaaatagtcattataactatcgggaaactctgacagttcccatgcccagaagccaatattgtatctttttttaaaaaaatccgcgcctttttcctcgtagaaggaaggtattgtgtctggattgagatgtatgatatttatattgtaaataggatcttcagaaagttgtttctctactgaactgtcgtttaatctgttttttaaatcaagattaaaattgatgggaacatgggggatagatgctgcttcaagagcttttatgtttcctctgactgcttcaccaaaaccgatttctgctttgaaaaaaccggagatatttactccgaaattaccttctgtcattgtggccttatttattgaaatataaaatttaatcttctgtttattttttagcggaaagcataatttttttccagagagctatagtatcctgctcttcgttttgcaaattatagtttcccaaaataaagctggaagcattttttcctttctgtagaatttcatcaggattttcttcgtaaacttttattgcgtcttctatttttgtaacaaactcaataatatttccatcctcaacctgagacgaaatttcacgcttaaaatattcttttccaccctgtcctctatatcctatcacataacagccacacgccattgcttccacaggaggaagcccgaaaccttccttgtgattgaaacataaaaagaatgtactttttttcatgatgtcagcaacttcctgttcagttttattatcgattggaacaagattccatccattgagagagcctctttgttttaaaatagaaataacctgtgttacatcatcactcagctttcttggcataaaacaaatttgcttttctttattttctgaatagttaaatacatgatgatttactcctaatctcatttttaaaatatcagattgtgggaaagcaagtctcatataagtaagtgcatcttcagatgcgactatagttgccagcgtattgggatgattgtatggggttattttataattctcataaattgaaaagtaattaaatgtatagtagcaattttgattgaaaatgacttttgcaacatccggttctatgtgatgtattttggggccataaatctccgggaacaccaatatggcctctttttcaatttttttacttctttgctgaaggaaaaacaaagcagtttttttaaaaaaattaagctttttgtttttataagaatattttaactttttaaaaagataggggctgtatacaattggaacatcaatattaaaccagctgtcttttttgccaattttcttatgaagtatataagcatcaaacccattcttattcaggatctccacctgtctgtagatttgttttactcctccactggcaaaggtattatttggacagacaaaatatattttagttttcattgttaatagaaagtatagtttttacccaatttttaatgtaatatttttcctttatcaattctgaaggttcttcatatgcattgctaataaatgattcaggaatattgatattctgaatatcctctataatgaaaatatttgcgggattataaaaatcataatgagcaatctccttattggttgtaataagctttttatgcagacctatcgcctcgtagggtctgaaggaaagtcctttttgatgaggatgtgcaagatccagtatgattttactatctaaataatatcgataagactctgagaaaggtataatatcatgtataatttctatttctttgggtatcttttctgtaatagaggttggcttataagtgaaaatcctaccctttgcagaaatactgtttttattaaaatattcaaaaagtgaaatagtttcctgaattctcttgtcgtatgttgctaaatagctgatatcgtaagttgttgcggaatcgttattttcaataaaataaaaattggtgatataatgaagattatattctttacagtcatcagaatcgaaactgcagcatacgttaaatttattgatatactctttctgagtaggtattttctgaatactatcccaaaatagaacaatggaatgcttggatttttttatcgcaagatcaagatcgtttagagacagaacatctggtctgttgaccaaaagtacatcataatccagactgctaattgttttctgaatatgctcatctctttttatattttttaaatttttaccaagaaaagttttcagcagaaaattgtaaatcttttcaaaaatatttttgtactgatatggcaatgttgaattaatatgagtgacatcaaagccactatattttttaagaccctcaaaaacaacttcattaaacccatagtaacctggagcaataaataacagtttttttttcataatttattaccattattatctatttcaaaaaccttgttcacccaactatccaaagtatatctgtaatagatttcttccggaattttctcgtaaggcttttcaaagaaagatttgtcaagattactaatatttttgtttaaaatcaaaatattattgggattgtaaaagtcataggttttaatggcttcgttatcagtaatgattttcttatccagagccatggcttcaaaaaccctgaagctgagtccgtattgcccttcacgcataaggtccagtaacactttagagtttttataatacttgggaagatcattatgcggaatttttttgatactgaaaatcagaaaaagatttttcggtaccgtcatgaaaatattggtcagctgatgcttccatgatttctttccgataatcatgatctgaaatttaagtcccagttcaatcagctttctagccagtaatttgatgagtgagacccttctgttatcataagaagtaatgtagaaaaggtccatttcgggttgttgggtttcttctgagcagtgcggaaggtaaatataattcgttaatttttcgaatccgtgttttttaacatcaatatgatcgaaggaaaatactttgtcaaaaagatacagtttatcttctacaggaactctttcaagattatcataaaggtaggtaaccaggcggtctgtatatttacggatttttttaagcgtagaaagatcaaacgtatcaggattcatcaccagtatctgatcctgatgtcctaatttttcaagcgaatccagaacgtatttctgtcttttttcggtcttgagatttttatttaaaaaagttttgctgagagcatttacggccctttcattaaagttggaatgagtaacagtactgatctttatatgatgagcatcaatacctcgtttgcataatgtttcaacaatatacttatcataatcccaaaaatcataactaatgatacaaatcttcattcaactaattttgctctttttttaatgattcataggtttcataaacacttaaagattgcaggtatgatagctgatacccttcttttccgtctaaaattccaagtctcattatataggctttaaagaatttaaaagctgttttaagatattgaactaaaacactgtacttttttccttttgcagccagttctttcccctttaaaactccgtaatgaatcattttttctttgtaggattcataatctgaaacggagtagtggagtaatttattttttaaaactccgatggttcccttcacctccagagtttcgtgtacctttttacctgccatatatctggccttcgattttctgaacagcctgaagtttttatcagactgagttcctgaaaaatgaataggtttctgggcaaaaaagaatttcctgtaaaaatagtaggcatccttttgcccggtttttttcagctcatcaatgatttcctgcttcagggccggcgtaattctttcatcaccgtccaaaaataaaacccagtcgttggttgcagcatccagagccagatttctttgctttgtaaagtcttcaaatttattctgaattacttttacgtgcgggaatttctttgcaatttctacagttttatccgtactaaaagagtcaacgactattatttcatcacaaaaatcaaaggactcaaggacagcctgtatatttttttcttcattatatgttatgattaaaccacttatattcatcacaacgctttgtttgatagagaagtacataaacacctcccttaatattgttttttaaaatagttttaatctgccaaagataagttttaatttgaattttatgatcgaatctttgccttttatatcaattctacacagctcgtaaggatgccgggtaggataataattcactttatttcctattcttactgcaaaatcaattcctaatttttttaaaattgaaaaaaaagcgaatttatcttcttttttttgaggatatttaccataaggatatgccaaaatcttggaatagctgatgttttgggcatccagcacctccatattcttttttagatctttttctataaaatcagcagaagcatctttcagattttcatgcgcatggctgtggagtgcaatctcaaagtattttttatccagacttctgatttcatcaaaggtcatcatcggataatttttatatccattttcaataaatccggttgggatgaaaatagttgctttcagattatatttttccagtaaagacggcaggtattcaaggttatttttgtatccgtcatcgaaggtgataataatattcttttttgatgaaagagtaagctcagaaaaaaaatgcggtgtatattttttacggctcagataagaaaactgctgctcaagattttttaaggagactgtaaggtcttcatagctttctttttcaatctggtgatacatgaggataaccagtctgttataaggaagtgcaaaaagatacagacggaaatacacgacgataaatatcgccaacacaacaggaatcagataaaggatcatactatctactgtgttttttcaattccgacaatcttattttttcacgaagcttaatatattttaaaaaggtatagtaagacattgttttagcgatataaaagcctggaaatccatccaggaaaccaagtctgaaaataaagaccttgataaactcgaataccgggcttacaatgatcttaaatcttttgactttcattcctctttcaaacattttctcagccatcatatcggaatatttattgatttttgagacatgatgatggatgcttttgtaggtataatgattcagccttccctccataatacaggctttctgatcagtaatcagaaactcatgaactttatcatcagaataccttgcatatttttttctgaacagcctttcacggtatacatttccccaacctccgaatctgatcagatgaattcccagatgattattgaacttcgctttatacacattgcacgctgtgctttctgaagaaacaatcttttgtatggattttttcagcactgcatcaggaacttcatctgcatccagaaacagaacccattcgtgggaacataaatcaagggcatggtttttttgttcaccatacccgttaaatgttttctcaaagaattttacctgaggatatttttgagtgcaaatctcttttgtcttatctgttgaaaagctgtcgacaatgatgatttcatcaacgatgtctgttaatgaatctaaaagtcttacgatgttctcttcttcattataagtaatgattgcaagggaaagagccatttctatttaaactctagaatagtcttttcaataattttcacacaatccagtaattgttcttcggtaattaccaatggtggtgccaaccttatgatattgccgtgggtaggtttggccagcaatccgttttctttcagttgtaaacaaagattccaggcagtggaactttcaggagtatcattgataaggatagcatttaaaaggccttttcctcttactttggtgataaggtctgtcttttcgatcagtttctctatttcagctctgaaaagtttccctaattcttcagctctttcagatagattttcttcagctactacatccagtgcagcaacggctacagcgcaggcaatagggtttcctccgaatgtagaaccgtgttgtcccggtttgataacattcatgatgttgtcatttgctaatacagcagatacaggatacattcctccggaaagggctttccccaagatcaagatatccggctgtacatcttcatggtggcatgcaataagttttcctgttcttgcaataccggtctgaacttcgtcagcaataaaaagaacattgtgctttttacacagctcagaagcatttttcagaaaattttcatccggaacatatactccggcttcgccctgaataggctctacaaggaatgccgcaatattttctgcctctctgtttagaacttcttccaaagcagcaatgtcattgtaaggaattttaataaatcctggggtaaaaggtccgtagttctggttggcatccggatcattggagaaagaaacaatagtggttgttcttccgtggaaattgttttcacaaacgataatttttgcagcgttttctgcaattcctttcacctcatagctccattttctggctaattttacagctgtttccacagcttcagccccagagttcataggtaaaactttatcaaatccaaaaagattagtaattttttgttcgtattctcctaatttggagttgtagaacgctcttgaagttaaagccagcttttgtgcctgctctaccagagctcctacaattttaggatgagaatgtccctggttcacagcagaatatgctgaaagaaaatcatagtaccttttcccctctacatcccaaacgaaaacaccttctccgcggtccagaactactggaagtgggtgatagttgtgcgctccatgtttgtcttcaaggtcaataaaatactgtgagttttttgtttgttctgctgttgacataaattttggttttcaacaaatttacacaatattaatgatacccataaacaaaaatagagtagagtataatgctgtaattagagtatattttgaggtaaaataaatccttgaatggaaaatatttttttaacggataacagttgcaggtattctatctttaagaataagaaatttatactgagaagataattctacattttaatcattccgatattgattgctgttccatcaggactataatttttaaatacttttccctaattagcttttgattggggttgtcttataaattgttctagtacgaaatatcaaaaactttttccatttgtttttcgttaacagagccaggtgttgcctttagtaaagtattgcggagccaaactgccagactgttttcataatgggatattttaccgatggctgagcttgtgttgacaatgtaatgtgcttttttcatacgcagtttttcgtattgagtgaagacttcatctacgtttttcccttcaccaaaaagttttccgaggatatatgcatcttcaatggcctggcaggcaccttgtcccatattaggagttgttgcatgggctgcatctccaatcaggcaaacacggtctttttgccattgataaatcggttccaaatcgataatgtcgctgacaaatattttttctttcggtgttacggaaatcatttttggaatttcgggattaaattcagcaaaaagctcagcaagattatcgggatttttaaccaggtgctcgttaaccacagcgtaccagtaaactttgtgatcactaattttcacgaagccgaagcgtctgccttttccccaggcttcataagcatggtgattatatttttctgtccaatcagattcgatgacagcacgccagcatttttgcttggaagatctgagttttccaatatttaaaatttgatggcgtactactgatttaatgccatctgccccaataacagcatctgcattaacgatagtttcgtcttcaaaagtgagttgataaccgttttcctgttcgattttggataaacgtttagaaagtttaatgttttcaaaaccaatttcttcagccagaatcatttgcaaatcggcacgatgaatggcaatattgcttactccatatttactttcgaatgtattcagttgtacatccgataaggttttgagctgtggatcagtaatgttaatagttgaaattttatgacctgctttttcgattttgtggcgaatgctaagtttgtcaaagacctgcatggcattattagccataatgattccggcgcccacaggttttatttcaggtgcactttcataaacgataatgtccagattatttttttgtaaggctaaagctgttgtcaaaccaccaattccgccaccgataattgctattttcattttgattgcatttatattatgaggcaaaattaaaggctggaaaaaccaaaaacgttcacttaagttaattttctgaaattagtaaattcttttccggattctgcttagcgattgtggtgtaattcctaaataggacgaaatatatttctgtggaattttgttcagaatttcgggtgactttttcaggagattgagataacgttcttccggtgtataaaaaaacagctcgtcaagcctttgttttgcatccagaaaagctaaatcggatatgcgttttgcaagcccaagccagaaaatatctttctgaattaaaatctcaacatcttttttattaaaatacaaaacttcagtttttagaagagcctgtataacagccattgatttttttccggtaatatagcttgcgtaatcaccaattacatcattattcacctgtaaaaggtagctgatatcttcgcctttctcgttgatataataaatccggacggcgccattcaaaatgagtcctaaacgattaaatactccatttttaggttctatcattttgtttttatcataagttactatatagcaaatatccaaaaattccttcgcacgctccatagaaatctgaagtgtctctgctaatttctcctgtatttctgatgtcatcgctcttatgtctgttttaattgatactacaaaaataacttttcctgctttatttagaacgaaatagagtatacaactaaagaaggcgccttttcggacgccttctttttatatgaatgataattctttttagtgattatcatattttctatccattacaaaatcttccatgaattttgtagtatagtttcctgaaagataatcttcattatccatcagctgtctgtggaaaggaatagttgtttttactccttcaatatagaattcttcaagagcacgtctcatttttgcaatagcttcttcacgggtctgagccgtcgtgataagtttagcaatcattgagtcatagttggaaggaattgtatatccggaatacacgtgagtatctactctgattccgtgtccgccagggatatttaatcctgtgattttccccggagacggtctgaagtctgcgtaaggatcttctgcgttaattctacattcgattgaatgtaatttaggataatagttgattcctgaaataggagttcctgcagcaagaagaatttgttctctgatcaggtcataatcaattacctgttcagtaataggatgctctacctgaattcttgtgttcatttccatgaaatagaaatttctgtgcttgtctacaaggaattcaatagttcctaccccttcgtatccaataaattcagcagcttttacagcagcagcacccattttttcacgaagttcatccgtcatgaaaggagaaggagtttcttcagttaatttctgatttcttctctgtacggaacagtctctttcggaaaggtggcaagctttaccgaattggtcaccggcaacctgaatttcaatgtgtcttggctcttcaatcagtttttccatatacatacctccgtttccaaaggcagctacagcttcctgaatagcagattcccagtgatctttaaggtcttcagctttccaaacagctctcatccctttaccaccaccaccggcagttgctttaatcattacaggatatcctgtttcttcagcaatctttacagcgtgttcataagattcaattaacccatcagaacctggcacacatggtacaccggcagctttcatggtagccttggcatttgccttgtctcccattttttcaatctgttcaggagatgcaccaatgaacttgatgccgttcttctggcagattcttgagaaattagcattttcagataagaatccgtaacctgggtgaatggcgtcagcattggtaatttccgcagcagcaataatgttagggattttaagatatgagtctttactcattgcaggaccaatacataccgcttcatcagcaaatcttacgtgaagactgtctttatcagcagtagagtataccgcaacggttttgattcccatttctttacaagtacgtaaaatacgcattgcaatttcgccacgattggctattaatatttttttgaacatcttaatacgatttgaaatttgaaaatttgaaatttgaaattgactttatcatcaattatcaatcatcattaatcaatatttaattaagatggatctactaagaataatggttggtcgtattctaccggagtagcgtcgtcaactaaaattttaacaatttttccgctgatttcagattcaatctggttgaatagcttcattgcttcaataacgcaaactactttaccagcagaaacttcatcacctacatttacaaatacatctttatcaggagatggttttctatagaaagtaccgatcattggagatttgatcgttacatatttgctgtcatcagatgtagcttcagccttttcagcagttgctgcagccggagttgcaacaggtgccggagcagctactgcttgaggagcagtgtgatatactgcaggttgtgcataaacagcatcgcttccagctaatggagttttaatagtgatttcgaaatctttagttttgtacttcacttctgaaacttcagccttagatacaaacttgataagattttgtatgtctttaatgtccataaatttgatatttgatttgatgccaaagataccaaaaaaacgtaaaaaacaacaaaaaaccgccaaattttatcaaaattgggcggtttttgtattaaaatgaggctttttcagtgaaaagcgactcttagttttcttcagtagctgctacttctttttccaatactactttacctctgtagtataattttccttcatgccagtgagctctgtggtataggtgaagctctcctgttgttgcatctttagctaattgaggaactacagctttgtagtgagttcttctcttatctcttcttgtagacgactgtcttctctttggatgtgccattttctaataacttttttaattgatgagcgatgagattcatcatctcatcatatttaaattattctatttaattattgtctcttaatttttttaaagcatcccatcttggatcgctttcatgttcttcctcttctgctacctcaatatctttaggactgaactggtcaagaattttaagatcttcatcacttacattcggtgaaatctttttcatcgggatagaaagcattacattttcgtagatcaaatgcgctacgttgaaggcgtgctctccggtaggaatggtaatcacatcttcattgctgtcatcatattcttccccgaaattcaccagaatcttgatctcattctctataggatagtcgaaattttcatttgtgatgtcacaaactaattcaaccagtcctttaattttaatctcaaactccaggaaagtagtgtgtttatcaagtgatacattcacttctattctgggatttgtaaattcctgctcagtgtcaaataattgaaagaacgttttatctatctcaaatttgaactcgtgtcttccgtttttaagtccggaaaagcttacgtcatagtttcttaacttgtccataaaatgagtgtgcaaaaatatgcattttttttataataacaaataaaatctgaaacaaattaatttaaaatttgttttaaagatttatgcttcagtttcctccggtagatcttcatctattccgttgtctacagccatttttctaggctgcaggcggtcgctcatcagttcgctgtattcacttctgtttttgaaaaccttaatagcagtgaagatggcttctataaaactttgttcgtcagcgatattttttcctgcaatatcataagcaactccatgatccggagatgttctgataaaaggaagtcctgcagtataatttaccccttcttcatacgctaatgttttgaacggagccagcccctgatcatgatacattgcgagcactgcgtcaaaatttttgtatttgttgggctggaaaaagctgtctgccggaaaaggtccgaatgccagtattccattgtcagaaagttctttaatagccgggctgatgatttcaatttcttcacttccgataacacctccgtcaccagcgtgcggatttaatcctaatacagcaattttaggtttttgaatgcagaaatcttctacaagcgtttggttcaatactttgatctgcttctttattttttctttggaaatattttcagctacctgtgcaataggaatatgatgcgtagaaacagccactttaagatcttcagtcacgaggaacatgagtccttttttgttgaatttttcctcaaaatatcctgtatgtcctgcatgtttaaagcccatctttaccatttcatccttattgataggtgcggttaccagtacatcaatatcacctcttatcaaggcttcagtagctgcttccagagaatcaatcgccattttggtagactcttcagtgggaactcccaattcaacattcacgttttctttcgtgagattcaccatattaagcttacctgcctgggcctgtgaagcttcattgatataattgaaattgagattcagcttaaaaatatttttctgataagtgaataatttccccgaaccaaaaattacaggagtgaaaaaatctgtaatggttttgtctttcagagacttcataatgatctccggaccgatgccgttgaaatcaccgattgaaattcctactcgtactttatggttttttgggctcattttgattatctttgaagattataatttacaaatttagcaaaaaataatatgttcacaggaattattgaagcagttggtgttattgagaagattgaagaaaaaggaagcaatatagattttacccttacatgtccttttacaaacgagctgaaaatagaccagagcctggcacacaacggctgttgccttacggttgtagagattaaagacaatcattatgtggttacagcaatcaacgaaacattggaaaaaaccaaccttggaaaatgggaactgggaactgttgtgaatcttgaacgctgcatgaagatggatggaagactggatggtcatatcgttcagggacatgttgataaaaccggtgaagtggtaagtattgaaaataaagacggaagttatttcattaccatgaaatatgagaatgacggaagttttgtaacggtgcctcagggttccattacagtaaacgggatcagtcttactgttgctaaaagcgaagatgctcagttttccgtagctattattccttatacctgggaatttacaaatatgaaacatttgaaaattggtgataaagtaaacctggaatttgatatcattggtaagtatattgctaggttaattaaaaagtagaatgtcaattaataagtataaaggatatagcttaaggaaccgggtgtttttcggatttctgctggtatgcttcttaagtgttgttgccacctcgcttgttccttattttgtattaaggaataactccatgcagcaaagtaatattgacatgcaggagaagaccaatgctgtgatgcggtatctggactatgcggtaagccgtacattggtggagactgaaaatcttcctacggttttagggaacaaaatttttgaaattgcagatattaaccagcatgatattgttatttatgatctgaaagggaattacctgctttccaacaaagatgaaagcctgatagaccagaagacgatttccattgatatcattaataaaattctttctactgatgcaagggttgatctgactaggtatgatgctgctaaagatgctaagctgacctcttcctatcttctgctgaaaaataatgagcttgaacccatcggcattgtttatattcctttatatcataatgagtctgcttaccttgatgttcttcatcaatatgtaaaatatattcttctggtcgatatattccttatcctctttagtatctggatcagctgggttacttctaacagccttgcaaaaaccattacgaagttctctgatatgattacgcgtatcacattgtttgaaaacgaaatgcgccctatcagatattataagaatgatgagcttaatgcgctggcgagagcttataacagaatgattctgcagattcaggaccagaaagagaggcttagatttaaagcttctgaagaagcctggagagagatggccaagcaggtagctcatgaggtgaaaaacccattaactccgatgaagctgaccatccagaattttgaaagaaaatttgatccggaagatccgaatatcagagaaagagtaaaacagatgagtaaaaccattgtggatcagattgatctgattgctacggtagcctcggctttctcggaatttgcaaaacttcctgaaaaaaataatgaagtcatcaatctgaatacagaagttgaagatattctccgggtattcaatgatgacagtattttcatgcatgccaataagagcaatattatgatcaatatggacaggatttatctttccagaatcataacaaatcttgttactaatgcaaaacaggcagaaagcgaccagagaaaactgattattaatgtagatgtggaacagcatcagagaagagtaatgatctctgttcaggataacggaataggaattcccgaaaacatgtacgaaagaatctttgaaccgaatttcacgtctaaaaacagtggaatggggcttgggctttctatggtgagaaaaatgattgaagattataaaggtgagatctctgttaaatctgaagtagggaagggatctacattcattattacactgcctaccaatttatagtgaaaccttttacttttaagcaatttgaaatccagcagtctaaagacgtcttccgtgtgggaacagatggtgttctgcttggagccttggctgatgttgaattggcttcccgtgttttggaagtaggcaccggtacaggattaatctctctgatgctggcgcaaagaaattcgcatgctgaatttttaggattggatattaatgaagatgcagcacagcttaccagtcttaattttgaaaattctccttttcgtctaaggctgaaaaatagtcaccaggattttaaaacttttgaaacgagtgaccggtttgatcttatcgtatccaatcctccgtattttgaagaatcaggatctgaaaaagataagatagcccgtcagaccgtagaactgaacttcagccagttgataaccagggcggcagaattgttgtccggcagcggaattttttccgtaatcatacctgttgaggcaagagagatttttgtttcaattggtaaagagaataatctgtatctgaaaagaaaaattaatattaaaggaattgaaggttctaagaccaaaagacttattctggagttttcttcggaagcgaaagaggttgatgagtctgatttcattatagaaaaaagtccgagacaatactcggacccatatcttgaactcaccaaagagtttcatgtttttaagtaaagaagttagaaattagattttagaagttagttatttctgactttcttaatcttttagttcttattcgaataattctgaagtatccaatacagaaacttttccgtcctcgcatctgatcgcttcaccagggaagttctggatcatatggtaatcgtgtgttgccattactacagcggcaccattttcaagagcaacctgcttcaataatgtcataatttcgttggaagtttcagggtcaaggtttcctgtaggctcatctgccaggataagatcaggatggttaaggagagctcttgcaatagcaatacgctgttgttcccctccggaaagttcatgaggcattttatgctttttgcttttcatgttcacgcttcccaaaacctcattgatacggtcttccatttttactttgtcattccagcctgtggcttcaagaacaaattttaagttcttttcaaccgttctgtccgaaagtaactggaagtcctggaatacaattcctaattttcttctcaggttaggaatgtcagaaggctttagctttgccagatcaaaccctacaaccgctccgtgccctgatgccaatggaatatgtccgtaaagcgttttcagaagagagctttttccggaacctgtttttccgataagatagcagaatctgccttttttaatgttaagatttacatcagaaagtacagtaaagtttttttgcgcaatcttggcgtgttgtaaacttatgatgttatctccggagatatgtgtatgtggcataattaaattttaaaggctgttttctaacaaaaaaatttcaatctttaaaaatagaaaaaagaagtctatctgactctaattttagtaaattttaacaacaaaaaatgcctgaaaagtaacttctcaagcatgttttgtatatgataatgtagaaattatctcttagcgcgtgcagcacttacagttaatctctttctgcctttagctcttctcgcagccaaaactcttcttccatttggcgtagacattctttctctgaaaccgtgtttgtttcttctctttctttctgatggctggaatgttcttttactcattactatatgtttaaatcgtaattaatctattaattttcaggttgcaaagatatataaatttttataagttacaaactttaattatctttttttaaaattaaatttaatgtttttcggtcgggcttttacaaaccctcatggcaaaaccattttccggtacaaaaataatatttaaatgatttatataaaagctctatctttgaaaactttaattttaacgaaaaataaacaccggatgtttacaccagcagaacttttagatatcaatacattacttacccaagacagcaaaatagtgatccttacccattataatccggatggagatgctattggttcaagtttgggattgaaacattatctgaaagcaaaaggaattcatgcagaggttattgtacctaatgattttccaaagtttctgaaatggatgccggaatctaaaaaagttattattgctgagtataaaagaaagctggcttctgatatgattgcaggagcagacgttattttctgtctggattttaattctccatcaaggatcggattactgggagactggctgataaaagctccggggaagaaaatccttattgaccaccaccagcagccggaaaaatttgattttgtgtattcggatacggtaattcctgccacttcacagatgatctatcatttcatagaagcaatggatgatgaaaaactggtgaaccaggatatggcagaatgtctttatacaggaattatgacagataccggtggtttccgttttcgttctaccagtgccactacacacaggattattgctcatctgattgaaaatggggcagatcctgcgatgatcacctccaatacatgggataccaatacggtttcgcgcctgcatttacttgccctggttcttgggagaatagaagtagtgaatgatggtacagtagcggttttgagccttacaagaaacgagctgaaagaatatggtttccagaaaggagatacagaaggttttgtaaactatggcttaagtattgccggcgttaaaatgtcagcattctttatggaagatttatatgaagacttcgttaaaatttctttcaggagcaaagatgatgtggatgtaaaccaattctcaagaaaatatttcaatggtggcgggcatattaatgcagcgggcggaaaatctttagattctctggcaggaaccatagaaacctttaaagataaagtcaaagaggaaggctggtaggaacacataaaaggcaagctataaaagtctgtatattctttatccaaaatcctggatacttttacgatatcccttttcttcaagctcctgacaggtatattcgtacacctgctgaaacatttcatccatatatcttttgttgaaaagactgtattttgtcattttgggcggatccagaaatatattgcagtatttggctttagaatacacggattttgcaatcgccaagtgaaggattctgtcaaactccttcatcaggctcattttttttaattcatcataactgatggagttgacatgggaagcaatcaggaaattacatttatcaatgataggctcaatgggaagattgtccagaacacctccgtccacataaattttctctcccatccttaccggaggaagaataaaaggaacacttgatgaggccagcagcggtccgaaaagttctccctcagaaaagaaatctacgataccttgcgtcatttcagtagctgcaacatacacaggaatttttaaaatactaaagttatcttcaggaaaataatctttgaataattttacaataaagttggagctgaaaattccgttttttgataattttaatgcagatctggagaaaaaagaagtttgtcttacaatttccatcatttcgtccggtgtttttccaaaagaataaaaagcaccaataatagagcctgcgctggttccggagataatgtgcggtttcaggttatattcttccaaagctttcagtacggcaatatgagcaattccacgcattcctccgcctgaaagtgtaagcccgataaccggtggtgccggtggtttcttttttttgaatgaaaataaagccattaccaaaattatcctctactaatatacaggattttttgttaaataagactttaatctatcaggaagaatgttataaaaccagttttttaggaagattgtgaagaagttccgtattgatgatttctgcacagatacctggcttttcccagtgaccgttatgtccgcagtccaggatataagatttgatattcgtcctgtccggaagatgtttgatcatcatatcggtttttacggcgttatcatgtttaccggctaatactaagattttagcttccagcttttcaaggacatgttttttgtctgttctttctaccatacctttcacacaggctagagcccctaaattattggtggaaagagctgtttcgagtgctgtttcaatttttccttccagaatatccctttcatttggattgaataaattgggtactccggctcttgcataatgggcaaatgcatctttaatgattctgtagctcttgatgcgctgctgttttttctcttcatcatccggaaaataagtagagaaaaataaagttaagctttttaaaagatcagggtatttttcagcaaaggcaagtgcagtatatcctcccatggaatgtcccaaaaggtgaactttctctaaatgctgatcatccagtactttttttacctcctctgccatcagttccatggtatgaatctctgcgagaatttcagactgtccgtggcccggaaggtcaattttaaggaatgaaaaatctttggaaagatgatgttccatgtcgctccagatggatagattttccataaaaccgtgaagaagcaccaaagtttcttttccgtttccttttctttcaaagttcagcataattccaaaaatttagaaggttaataatacagcaggttatctgcagactcgtttctcctttcaaaattaatcaaaaaaagggcatccaaaaaatgcccttgtcttttattgagttaattccttataaacctttgtttcccagggtttgatatccgttacaccatatctttcctttttagaaatcgcaagattgtccagcatgtctacaaaattcttgtaattggcttcatccgttggttttacaataactgtaaaattgttggatgccggagcatttttatacgcatcggcaatgatctttgaaatcttgattccactgaaatcagtttctttaagattagtagtgtttaaatcttttgcattactttgatgataaaatacccggttgtcctttcccaggataaatgtgatctggtttttgtctccaattacattttcaacaggtttgtgatcaggatcttttgccggtagtcccagatccattacgttaggttttgtaaagttagtggtgaacataaagaatgtgatcaataagaatcccagatcaaccataggagtcatgtctactctgatcatttttttcttttgtttgctgccttgtttctcttgtgcaattacttctgccatgatttaaagtttttaaatgttaaacggtatttgttgagtaattcaaacaaaacacatgccttgtttgttgaataatcaatagattcatgaatttattgatggtttttatattgaattttaaaattccgtttcttcttttaaaactgattaatcaatgatgtttctggctttctgataattgtattttcagtctcatatttttcaaaattgattctaaaatttttcatcaactgctgcaaaaaaaactcacacggcaaagtgtgagttttcaaatgatatgtaaataattttatttattctttttatagtaattaaccccgcattctaggaattttttaaaatcctcttttggcatgtatcctgaaaccggcgtgttgattacttttccgtccggagtgatcaaaacatagtgaggctgtgagttattattaaagttaacctgctggaataaactccatctgtcaccaattgtttttacttttttaatctgcccgtcgccaaggtcaatttttgttttctgatcttcaggaagctcttccttatcatctacatataaagaagctagtactacatcattctgaaggataggcaagatatctgcttcactccagacaaactcttccatttttctacagttttcacaaccgtatccggtaaagtcaataagaatgggtttatcttcttttttagccaactctaccgctttgaagaaatcatgttcggggtgcattcccagaattccgtctttttcatcatggaaataacttacattcagtggaggtaaaattccacttaatagctgaagtttcggacgatcagatggaattaatccctggatcaggtaaatcacaaaaccgattcccaatgctcccaatacctttcttgtaacggagatcttaggctttttatcatcatgcgggaatctgataaatcctaataaatataaagccaatcctaatgcaacaatgatccagatagcgataaaaagctctctttttaaaaggaaagttttggatacaaggtctgccttagataagaatttcaatgctaatgccagctctacgaaacctaaaactacttttacggtattcatccatcctcctgatttcggaagactttgcagcgcttgcgggaataaagccagtagtccgaaaacaatagcccaggcaagaccaaatcccgccaatgcaaatgtcagcaacatcgggacatttgtagaacctgttaccgcacttcctaataaacttcctaagataggtcctgtacaagagaaagaaacaattaccaaagttaatgccatgaagaaaattccgataattcctcctgcttcttcagctttggaagatttgttggctactgaacttggcaacgtgatatcataatacccgaagaaacttccggcaaagaagatgaatataataaagaaggcaatattaagccatacacttgtggaaatttcattgaagatatttcctgcaataccgtcgataacgtggaatggaatacttaataaaacgaagataagaagaatgaaaaacccataaataagagcatctctttttcctttggctttgtttttagttccttttgtaaagaatgaaactgtcaacggaatcatcgggaaaacacatggtgtaagcaatgcgattaatcctccgataaatcctaagaacaaataagtccagtaattttcatccacttttgcggaagctgtaccgcaatctgttaatggttttttgaaatctattgtttcaattttcagctgcttaggatccagttttgacgtttctgtaatcgtagcttcgttttttgcaggattttcagtaaccgtctcagttacttttactgagtcttttacaggagaagctgtttcttcagttaccgtctcttccgttgcaccttttggtgtgactttctggttgaattctaacgtattaggagcaaggcaaactctgtcatcacaagtctgatacgtaatttcagaagtgacatctgcaggttttgccggatcttttagcttaaacttctgcttaaaaccggctgaattagaatagtaaacaattgttcccccgaatgcttcagaaaattcttcgtgttttttacccacttcggtaaactttccaatcagttcgatattctttcctgtaactttatattcagtaggaattccggtatcttccggcaaatctttggagtaaatgtgccacccgctttccattgtcgcattcagcactgcttcgtactggttgttaccaaggtcattgatggtgaatttaaactttacaggattttttatctgtgcattaattcccgtcgctaaaaataatagaattaataaaaaccaatttctaaatttcattgttcatttcattaaaaattttgagactccatttcgtcttctcattcattgcatatcgtctgtcctgtctgattgggataaccccaagtacagaatcattgctgtcagcaagtatccagattttttgcctcgctaaaatagataatttttcgtccctaaaaaatttagaaactttctttttcccagaaaaacctgtgggataaaattcatcaccttctttttgctttcttaaacgcagtgggaaatgaagtttttcagcatcaaaatcccactcaaagcctttattgattccatcaatgctttcaatatgatctacgagattgatggtaatctggttttcggaaaaatcaaaatgatcgatcaggacaatttcttctttagattctttttcttgacttctatcaataaaaatcagttcatcacggttaacaattaactgatattcttttgaaaaaaaagaactgttgttttccgctttaaaaattttggggatttcttcctcctggttgaaaccgtatttttttaaaatttcgaattttacgaaatcgctttcctgatccagcttttcctttgataagattttatagtcttggttaaatactgtaagtttattttctatttcctgaatctgtttctgaacaaaatccttggtttgattcagcagagaagaactttttctgaagttgtccagaaaatgttcgttggtttccatcagcatcggaacaatctgatttctaatcttattcctcagataatcattttttttattggagagatcttcccggaattcaatatggttcaattctgcaaactgataaatttctttttttgaaaaatttaaaagcggtctgagaatattattgtcatgggaaggaattccgcttaatccgttgatgccggcagccttggaaagattgatgataaaagtttccagctgatcattcagatgatgggctgttaccagaaattccagtttttccttttcctggatttctttgaaaaacttatatctgagttcccgtgcccaaagctgaatagagttttccggtttctgatctttttctgaaacttcatacagatgaaattttatatgatttttctcacaaaaatcctgtactgttttctgatccagatccgaatcattaccacgaagtttataattgatatgagcaacctgaaaccggaactttgaatcctgaatttcctgcccgaaatccctgaacaaagaggctagaaccatagagtcagcacctccgcttactgccagaagataggtgtgcttttccggctcgtgaacgagattttttaattgattgataaaggttaattttttcaacatatatgttgagaatttcttttatgcaaagataaccgatataattcaattgaatttccctaactttgagtagtctaaaaatgattatttatgaagattttaaaaattttagcagtttctgcaatggcgctgggaatgacatcttgtgtcagcaagaagcagtatgacgctttgagcacaaactataagcagtgtattgaaaacatcggagaaagacaaagagaaattcaggatttgaaatctcagaactctgcattgacaggtgaaaacaatttgctgaaaagtcagcatgatgctttaaaatcatcattggatgcatgtttgtccaataccggaaaaagttctgctaacattgataaactggtaggagaaatcaatgcttccaattcttatatcaagcaactgatctccagcaatgcgaagaatgacagcctgaaccttgcattgtctaacaaactgaagagatctttggataatgtatcagatgaagatgttcaggtaaaagtattgaaaggagtagtaatgatctctctttctgataaaatgttatacaaaacgggagattacaatattttacctgcagctcaggaagtgttaggtaaagtagcgaaagtaatcaatgattatgataaatattcagtgctgatcgaaggtaacacggataatgctccattaaactcaccgaatcttccgagagacaactgggatctttctgcattaagaggtacttctgttgctaaagttcttcagactcagtttggtgtggatcctgcaagaattacagccggtggacgttctgagtacaacccgaaagctacaaacatgagtgtttcaggaagagcagaaaacagaagaacagaaatcatcattatgcctaaacttgacgagtttatgaaactgatggatatcgctcctaaaaaataatcactcaatcatacataaaaaaaatcccgaagcaattcgggattttttatgttaattgtcaaccttaagcctattaattcttaagtttcaagtactgtgtcagacaaaaataaaccccgaaggtgggcggggcttatttttaatcaaattaattcttcctttttcaggagcgaaataattcgttgcaaaaatgaagtggatatttctgtcttactttttgctgcagaagaatcagttctacctctcggtaaaacttttttgtgattctcatggttagtttgtgtctctcctgcaatcatcttgtttctcttagtgtttttaccccttattcttatggcaaacttagcactaataccacaaaaataccatccgtgttttcccggtattttatatggggtttttactgatatttaaatttttatacatttaatagttgatttttaagtatataattagttgattaataaaagaatgtgtatatttatatctctattaaaggaaatattatagagatgtccgaaaatctaaagagtaggaaattaatactaaactaaaattattatgaaaaattcgaaaaaactttcaagaggagaaatgaaaactgtacaaggtgctattaacgggtgtaatccacagatattttgtactagcctacaaacaaagtgttgcccaggatgggtttgtgctggtataagagaatattgtattgcgatataaaattttaaaagctaagtacatgaataaagagggattaatttctctctttttttgtatcttactttgcagtgtagaaagaaactttaaaatccttaaatttgtttaaattaaaattatatgagtttttttgaagaaaagaatcctgaaatggatagatatttggaagcacatgcttcttcggaatctgaaattctgaaaaagctgagaagggagacttatcagaagacgacacagcctcatatgatttcaggatatcagcagggaagattgttgacgattatttcccaaatgttgaaaccgaaaaatattcttgaaataggaacttttacaggatatgctactttgtgtcttgcatcaggattggcaaaagacggaaaaattacaacattggatgtgaatgaggatcttgcctatcttccaaaaaaatattttgaatccagcgaatatgccagccagattgattttaaacttcaggatgccaaggaatatttaaaagaaacaaatgaattttttgatttgattttcgtagatgctgataaagaaaactatgccgaatatttcagattgataaaaccacatacaaagtccggaactgtaattctgtttgataatgttctgtggtacggaaaagtattggaagaaaatccgaagttgaagtctacccagtctattcaggagttaaatgatttagcggcaaaagacgaagattttgaaaatcttattttacctttgcgtgatggagtcaactttcttcgcagaaagtaactgaaatattcaaggattaaacatttaaagagatacagcattgtattttaatctttaaattattcaatctttaaattgagaattaatgaataaaggaatttgtattgttacagtagcgccggtccgtgcagagaattctgacagggctgaaattgttacggaaatattgttcggggaaagtgccgatattttggaagtagataaaaactggaccaaaataaagatgcactatgacggctatgaaggatggatggataccaaacagctaaaaccggtaacagatgaggagctcgctaatagaaaagtgactgtcgttactgaagatttttcttctgtactgatgaatgacgggaagactttactgtcgatgggttcggaagtggaatttccagtagtagcttcaagaagaagccatgatgtacgtgaaagtattgcgctgacggcaaaagaattccttaatgtaccctatctgtggggaggcaaaagcttttttgcagtagactgctccggctttacccaattggtctataaaattcacaatattaaaattccaagagatgcttcacagcaggctgaagtgggagaaccgcttacctttgtagaagaaacacagcccggagatcttgctttctttgaaaatgctgaagggaaaattatccatgtaggaattatgctggataatcagaaaattattcatgcttccggaaaagtaagaattgacactttggattccaccgggattttcaataaagaaatgaataaacatactcacaagcttagagtgctgaaaagtataatctagcctaggttaaatctcatttgaaatggaaaatattctttttataatttttgatatttttaattttggatgggtagcttttttatggtggtttaccttgaaaaattatagtgctttgccagatcgtattcctgtgcattttgatctggaaggaaaaccagatggctttggagggaaaatctatgcctttctgatgccagtactggcgctggggctttatgcagtgttcacctatggaaccagacatcctgaagatactaatttcccggtagagattacagatcagaatatgaatgcccagtttttaattatgaaaatcggattgagaaccctctttcttatattgggcatggtttttttgaatattcaggactatatgttcagatatgctgctgatgataaggctaaacctagaatctcaatcgccaccatctttttatcagttgtattgtttgttcctttattacttttcattactcacttgtttaaatgatacattctaaagaaaattcagaacactatatctggggaaaccaatgtgacagctgggtccttaaaaacacgcgaaacttatctgtgaagcaggaaaagatgcctgccggaacttcagaaaaactgcactaccatgagatagcggaacagtttttctacatcctcaaaggagaagcagtattctttatcaatgaagaaaagttttgggttaaacaaaatgaatctatttctattgcaccgggaacaaggcattttatctccaatgaatctgaaacggaaattgagtttttagtcatatcaaatcctcctacggatcatgatagaattgaaattaaagaataattaaaatggcttttctatacaatctatttatcagtctgctgacttttggaatgaaggttttcgccttgtttaatgataaaactaaaaaaggcgttgaagggaggagcgagtctttgaccaaagtaaaatcttcattttcacagacagataaggtaatctggatgcatgctgccagtttaggagaatatgagcagggattgccggttctggaaaagcttaaggaaagttttcccggccataaagtcctggtgactttcttttccccgtcaggatatgagaatgtggtgaaaaagaaacatatggcagatgtaatctgttacttacctttcgataaaaaacatactgttaaagagtttatatcacaatttaatactgaactattttttacggttaaatatgactactggtataacctgcttgctgaacttaagaatcaggggacgaaagtttatgtaatttctgcactgttctatgaaaggcaatctttttttacctcatatggcaagtggtttgtaaagcagcttcagaacaatgtagattggtttttccatcagactcagttttcattggcccttgcgaaaagtgtagggttgataaagtcttccgtaactggagatacaaggtttgacagggtaaaacaacttcgtgaacgtaacaatcatgtagactttattactgattttaaaggagaaagtaaagccattgttttcggaagttcctggcaggctgaagagaaaatagcagaagcggtctcccgtaaaaataatacggtgaagctcatcatagcacctcatgatctgaaaagagtagagcatcttaaaaatatattcccagatgccttattgtacagtgaaatacataattttcagtcttcaattcccaattcccagattctgattatagacagtataggcttgttatcaaaactatattcatatgccgaggtggctgttgtgggaggaggatttcacgatgcaggccttcataatatcctggaggcggcaacttttggcgttcctgtggtctttggaaatcattacaaaaagaatcccgaagctgatgatctgatcactgctggtggcggaaaatcttttccagacgaatatacggctgcagaatttgttttatttcttaccaataaggataataaagaagaacttgcggagatgtcccggaatgcaggaaagtttatagataataagcctgattctaccagaatgattcttcagaaaatcttatcttaaaaatccctggcttttaatttctttcatgatctgatcaatattcccgggaattttatcacattcaaaccaattaagatcaagcccattattaatacacagcttttgcaggtagtgattttctaagattttatctgaagtttcacgaagatattcatcaatttccagccagtaatcttcatccagttttttaattaaaagcaaagacttaaatactttgttgatcatataaatataaagtttataaacattatcaaacctctgtctgctgagatcactgttgttttccaatactttgttgatcagaagaagattcagtgaaacttccccgaacttgtcagtggtgattttgacgtgttcagtaatttcagcgcttatttttcggatgatggtcagaaaatatttggcgtttccgatatattttgcagccagatggacctgctcttccacatgttcttccatggcatttcttttatcatccgtagtttccgggtcaatcagttcgaaatatagctttttggataacaatttgtccttcctcaggagtctgaaaatgagtttgtctttctcggcacctgaaaaagcactcagagcggctttgaactcttttgaatactccattaattaaaaattttagaatatttgaggaatccgtttagcgcccagttagccgtataatataatgactttaatgttgaaaatcccatgaaatctttatagacaaggtattgatctttgatgatgttttttttatttctggaaacactgttttcccgcattctgtactttgccagcgttttttttactggcatcccttccggaatgacctttaaaagattaagccacatcacatggtcctcgcgtttgctttttacagggaacagaaatttaccaactctttgggtatcatacatggtagagaccggagcaagacggcatgtcttcaatagattagagaaagtaactgttttgtcagccagaaagtctttcagtataggctgcagctgctcattacatctggaataattacagtagacaagttctacatggtgttcctgcatataaccggtcatggtttcaagatattcgggataccagtaatcatcagaatccagaaaggcgatatatcttccctgggctctttccaggctgttgttccttgcatttcctgcgcctccgtttttctccagtacctgcagctttattctgggatcattatatttcctgatgatctcaacagtattatctttagaaaggtcatcagtgatcagccattcccagttttcataggtttggttaagaacagactgtatggtttcctcgataaattctgcagaattataacagggagtaataatggagacaagatctttcatttatgctttttgaattgtaaaattataaaaatcttttttcataaagatgccaggaagcaattcctaccccgattactaccaacatgcataccaatcccatgaaataaggattgtagctggcgaaaagccccaatgttgcaaataccctgataatagggaagtggaatatataaatgccgtaagtgaaatctccgtactttccaaaattgttcaggaacttaaatgaataagcaatgtacagaacaataatactgatcatcattggagaaaatagttttattttaaaaataagatctatccagacagtaattatcgcaatgatgaataaagcatttttatgtttgataaacttatcaaagttaaagtagatcagcattccgccaatgaaataacataatgatcccggtaattgtctggaaagggcagcttttccggccatttcaaaatagttgagataaatcagtgaaagaaaatacaatacaatcagactggtattccggtatttattattttttccaaacaataaaaacatcagtggaacagcaatataaaagcacatttctattttaagggtccacaatgctccgtttactgcctggtttccgaatacaccgggaagccatggcgctttaaaattcatgaaaattgaattccagaataggtatttatacacctgtgtattgccaaaatactcagaaaaaggtaaagtgctgaccaggcttaataatgttgcacatagaaatacaaccaataaataggcaggaacaattctgttgaatcgctttttggcgtagctttttaagcttgatgacctttcataacttctcgcaataagaaatccactaacgataaaaaatgagaaaacagccacttccacagggctgtgcgttaaaattgtaagctggtcagcgccgcttaatgcccccaaatgtcccacaaagacaatgaaagcaaggagaacacgtataaaatcaaaattgtttctcgttatatcctgcatttgtattttgtttcatgcaaaaataacttttttaatacaatgaatgatgctcatgtattcattatttgttaaataaagggaaaagtacatcagagtgttttaaaatatatataaataaagcccgatgaaataatttttcataaaaaatagtaatataaatcaaaaaaattataattttagcgcttgaaaaaattgatctatgaagaaattagcattactatttgcaggtttgtctttgtttgcagctacaggatgtagtgataataacgatactgttctggaagctcctctggttgggacctggcaaccgttaaaagaagtagttactactgtggagaccggcgaggatccggtgtctaacacaattacttatactgactgtcagaaacagaccagatggtggttcagcgctgactccaagggagggaaaacaaactggggagatactgctacacctggtcagtgtgctattctttcagaaataaaattcaactatacctataataaagaaggaaaagatgttcagatgaaaattcagggagtcgtagagccgcagaatgcaaagattattactttgaatgaaacaacgcttaatcttgcagtaagagaggagactcaggatcctaagatattccagacaagaacatataccttcaagagagttcctcaataatagtatatacttcaggatataaaacagatctcatctccggatgggatttttttgttgaagccggaattgcaattcatcataaattaaatttctatttcctttaaaatcattatttttgtgattcttgtaaaaagggaaaaataattcaatacttaaagtctaacatataacatctatataaagtgttttacgatcatcagcagatagaaaaaaagtggcagaaatactgggaggataatcaaacctataaaacctctaataacacagataaacctaagttttatgtactcgatatgtttccgtacccatcaggagcaggacttcacgtaggtcacccgctgggatatattgcatcggatatctatgcgagatataaaagacatcaggggtttaatgttcttcacccggtaggatatgacagctttggtcttcctgctgaacagtatgctattcagactgggcagcatccggcaattactacagaacagaatatcaacagatatgaggagcagttaagaaaaataggtttttcatttgactggagcagagaagtaagaacttcagatgcatcttattataaatggacacaatggatttttatccagctgtaccactcctggtataataaaaatacagacaaggcagaagctattgattctttgattcagcattttgaagaaaaaggaacggaaggcttaaatgcaaatcagaacgatgaattaaatttcacagcagaagaatggaggaatgcttccgatcttgataaagaagatatcttattaaactatcgtcttgcttacagggcagagactactgtaaactggtgcccggcgttaggaacagtactggccaatgatgaggtgaaagatggaaaatccgaaagaggaggattcccggttttccaaaagaaaatgatgcagtggagtatgagaatctccgcatactctgaaagactgttacagggattaaatactttagactggccacagccgttgaaagattcccaggaatattggattggaaaatctcagggagcgcaggttcagtttcaggtagaaggtcatgacgagattgttgaggtatttacaacaagacctgataccatctttggagcgacgtttatggtactggctccggaaaaccctttagtggaaacgattacgactgacgctcaaaaagcagaagtagacacttatattgaagaaacttctaaaaagaccgaaagagacagaatgtctgacgtgaaaaacgtgagcggagctttcaccggaagttatgcgatcaatccgttcagcaatgaaaaaatgccgatctatatttcagactatgtactgatgggatatgggacaggtgcggtaatggccgttcctgcacatgatgagcgtgatcacagatttgccaggaagtttaatcttgaaattaaaaaagttgtagagactgaagaagacgttcaggagaaatcttttgattctaaagattccgtttgtgtaaactctgatttcttaaacggattacattataatgaagcgaaagcaaaaataatttccgagatcgaaaccaaaggaatcggccacggaactaccaactacagacaacgtgatgctattttctcaagacagcgctattggggagaacctgttcctatatattataaggatggaatgccatacacgttgccaacttccgctttacctctggaacttcctgaagttgaaaaatacttacctacagaagatggagatccaccactaggaaacgcaaaagaatttgcatgggatgaggttaatcagaaagtagttgctacagacttaattgatgataaaactattttcccgttagaattatctactatgccgggatgggcaggaagctcatggtacttccttagatatatggatcctaatgatcaggaagcttttgttaaaaaagaactggcagactattggggacaggtagacctatatataggaggaagcgagcatgcaaccggccacttattatattcccgtttctggaacatgttcttaaaagacagaggatatatcagccatgatgagccattccagaaattgatcaaccaggggatgatcttagggatgagtgcatttgtgtacagaattgatggtacaaatcaatatgtatccaaaaatctggctaaagattataaaactcaacagattcacgtagatgtatccttattaaaagggacctctgatgaattggatacagaagctttcaaggcatggagaccggattatgctgatgcagaatttattctggaagatggaaaatacatcaccgaccgtgaagtagaaaaaatgtccaagtctaaatataatgtagtaaaccctgatgacatctgtgaagaatatggtgcggatggtttaagattatatgaaatgttcttaggaccattggagcaatccaaaccttggaatacacaagggcttagcggagtatatggcttccttaaaaaattctggaatctttattttaacggagatgtatttgaagtttcagacgaagaacctacaaaagctgaatataaagttttacataccttaataaagaaggtcgtatatgatattgaaaacttctctttcaatacatccgtatcatcatttatgattgctgtaaacgaacttcagaaaataaaatgtaacaaacgcaatattttagaaccgttagccgttatcatttctccttatgctcctcatatctgtgaagaattgtggaatttattaggacatgatacttcgatagaatttgaaaaattcccggtattgaatgaggattatcttgttgaagacgaaattgagtatccggtaagcgtaaatggcaaaatgaagttcaaaatttcactttcagctcaattatctgccaaggaagtggaagatttggtgatttcgaacgagaaaatgcaacagattttggagggtaaaacccctaaaaaaatcattgtagtccctcaccgtattgtgaatatcgtaatttaaaaaaaaattaacattgggaaattaaaaaaaatgagagtctaatttttttgattttttaattcaaacgttaaatttggaaaaaataagtaaaataatttaaaataattattatttcgaaatcgtattaaaatttctttatcaaaaaaaagcaaaatgtttaattaagactcttgcattttaattaattttgcctttaatttacaccctgtaaaattttaaaacaatataatttagttaaatatggaaatgaatgtttcaaaaaatgatgagcaagtagttgctagaaaggcaggaggtttaaatccagctgttattattcctattctatttgctataggagtatgtatttatttattcgttcttggtagcccaggaaactttaaagatgcagacaaactaggaagtggatctgtagctttttcaagtgttgaaggaaaagacattcacccagaatcgtttttaggtattatctacaaaggaggggttatcgtaccaatcttgattactttcatgattactgtaatcgttttctcttttgaaagatatttcgttcttggtaaagcagctggaaaaggaaacttagacaacttcgttgttcaggtaagaagcttactaaaccaaaacaaaatcgacgaagctatcgaagagtgtgacagacaacaaggttctgttggtaacgtagtaaaagaaggtcttactacttataaagcacttgctcacgatactacattaaataaggagcagaaaatggtagcacttaacaaagctatcgaagaagctactactcttgagatgccaatgcttgagaaaaacatgatgatcctttctactctaggtacggttgcaacgttagtagcactactaggaacggtaatcgggatgatcaaggcgttcttcgcattaggttcaggaggtggtactccggatgctgctgctctatctacaggtatctctgaagccttgatcaacacggcattaggtattggtacttcagcaatcgctattatcctttacaacttctttacatctaaaattgacggattaacttacaagatcgatgagatctctatgagtatccaacaatctttcgctgaattcaactaagaattagcaagatatttgcattagcaattaaaagaagtttaattaaaaatattttataataatggcgagagtcaaaccaaaaagacatggagtaattacggacatgactgcaatgtgtgacgttgcgttcctactccttacgttctttatcttgaccactcagtttaaaaaacctgacgtggagcagatcaaaccgccatcttcaatttcggaaaaattgcttcctgatgctagtttaatgactatcaatgctactccggacgggaaattctatttccagccagtagaaaatgcatcagaaagagttgctcttttggataaaatgggacaaaagtatggaattacttttaacaacaatcaaaaggctgctttccagaaagttcaggcaatcggtgttccaatgaaccagcttaaaggctacttggatatgtctgaagatgagcagaaaaattataagagtcctacaggaattcctatggacagtacaaataagcaattaattgattgggtaaaagaaagtttgagcgttaatcctgactacaagttagcaattaaaggtgacgttactactcaataccctaaagtgaaaagcctatttgaaggtttaagagatattgattttcttaaattttggttgattacatcacaagaaggtaaacctaacgaataatatcgatagaaatggcagaagtacaagtacaagaaaaaggcggcaagggcggcaaggtccgttccaagaagcagagtaccagagtcgatatgactccgatggtggacttgggttttctattgattaccttctttatgttcacaactacgttcagtaaaccgaatgttatggatttgggtcttccggcgaaaccgaaaaaagatcagccgaaaccacctccaacagaaattaaactttcgaactctatctctatattattaggtaagaacaacagagtattttggcaccagcaggatgctacatccctgaatgaccagactcttatggaaactacccttgacagagaaggaatcagaaaagtaattcagcaggcaaaatctagagctgcagatccggctaaatttaccgtgatcattaagccgactgacgatgctgtatataagaactttgttgatattcttgacgaaatggcaattaccaagagtgagcagtacggtgttactgatattaagccttgggagaaagctgtgtacgagaaaaaagtaggaggtgctgctgcaccggctgctgctacaaagtaatttaaccataaaattgttatatctaatctatggcagatgaaaatgtatacggtcagaatcttactttagacgagatcgtatttgaaaatagaaacaaggaatatggtgcctatgatcttagacatcagtatccgagacttttaacaaagtcttttatcatcggaacagctttattccttttggcagctttgtctccgttcatctatcttacgattaaaaatcttacagctccgcctaaacaggaagtaaaggcagatcttgtagatattatcgaagaagatccgattatcgagcagcctaaagaagaagaaccacctccaccacctccaccaccaaaagaggaggagaaaattgaggttattcagaacgtggttcctgagcctgtaaaagctccgaaaattgaaactccaccaccaccgatctctaaacagttggaaactacaaccggtttacagaatcaggagggggtaaaagctccggcttatacaccaccaccgccaccaccatctacaggtactaaagcaagtacagtagaagtaaaagcgaacaaccctaacgagatctataaagatgttgaccagtctgcagaatatcctggaggtatgggagcattaagaaagttcctgggtgataactttgatacttctttgatggaaggaggtgaaggaacacttaaagctaagcttaagttcgttgtagaaaaagacggaactgtatcaaacgttactattgaagaaaaatctccaaatggcgactttaacagtgaagctgtacgtgtagttaagaaacttaaaaaatggactcctgcaaagagaaacggggagagcgttagatcttactatagtgtaccatttactatgaactttgaataagacttatttattcaaaatataaataaaaagagaggcatatgcttctctttttattttttttggtatttttgttacatgatgttcaattggttatccctggttacgggattgttttatatcgttttaggaattgtagtgattgtctacaaattcttctttactattttagaacctgctgttgcctacgcattaggagtagtactggttatttatggtattttcagaatttacagggcgatctcaagaattaaacaatcgagaaatgaagaatagtttcaagcttgcagtaatttttgctttgagcataatgctggcaggctgcaaaaaggagaagaattctccttcctatcacaaaggtgacctcacaatttttactgacgaatcctttcaaagcgttacagaagcattagctgaaggctatatgatcaactaccctgaaacccacatcaaagtagaaaccaagaaggaagatttaggacttcttgatcttttaaaaggaagtgctaaagtggtggtaatgtccagaaatcttactcccgaagaaataaaaacatacgaggaaagaacagatttaaagtttcttcctgccagattcgctgcagatgcagtcgtttttgttgtgcctaaagattctccgaaagaaagtatttctatggatgaaatcaataacgggctgacgtctgataaaaaagaatttatcttcgacggaaccaattcaagtaatctgaattttgttgctgaaaaatttaaaaaacagccaaaagatttgaaattttccattattcccggaaatcaaaagattattgaggagttagggaaatatccggataaaataggcgttattggccttaatacttttagccgtccttatgataaaacttcggaaagattaagagagatggtaaaggttcttcctgtggtagataaaggaaaatcatataacgcagattttgatgggctccgtactatggaatatccgtttacaagagtgctttactttctgattaacgaaggtaattttaatatcgccaatggatttataagattttcatgtacccatttggggcagaaaattgtacagaaggaaggtttgcagccctataatctgtataagagagaggtgcagatgcgttaaaaaaaattaaattcacaatttattcccattaaaaataaagatttggtctgaaaattgtgtagaatataactcaattatttagaaaatataaaatgaaagatataatgaatatgaatgtaaagaagattgcttttggagcagccgtggtattttttaccggttttgcctctgcacagacattgcaggatggtatcaacagtatagacagtgataaatttgcacaggcaaaaacaaacttcactgaaatgatcgctaaagagcctacagctgaaaactacttctatttaggaaatactttcttaagacaaggagagccggattatgctaaagcaactgagaacttcaacaagggattagctgctgacggtaaaagctatcttaacaaaatcggtttagctgctgttaaattaggtaaaggggataaaaatgccgttgctgaaattcagaaagtagttactgattcaaaagaaaaagatgctgaagtattattcagagcagcagaagctttaactttatttgaaaagaacagttctcctgatcttgctattcagtaccttaataaggctattgaaaaagctgagaaaaaaggagttcctgcacattattattatacattaggagacgcttacagattgaaaagatctccgggggaagcaatgtcggcttacgacaaggcgttacctgtagctaaaaataaagcttccgtttacacgagaatggctacattatggatggctgcacaggtatggcaaaaagctaaagaaagcgttgataaagcaattgcagtagaccctacttatgctccggcttacaaagcattagctggttatgatatcagataccaacaaaatgcaaaagccacacaagaccttatcaactatacaaaatatgctgatgaagatccatatactcaattagaaattgctaaattatacttcaccaatgaagattatgcaaactctaaaatggtattggacaagatttttgataaaattgacgatcctattaagttcaaattaagagcttacaacgcatatgcagacagaaactatgcagatgcaaagcaaaatatggatactttcgtttctcaggctgagaaaacaagaatattgcctgctgaccaaggtttacagggacttattgctgctggtttagcaaaagacgaaaaagatgctgctaaaaaatctgctttaatggctgaagctcagcaaaaggtgggtattgcaaaagctgctaaagatgaaacaatgaagtgggatcttgaattggctaacatcgcaggtggtggaggtgcttctcaggcagaagctgacaaaggacctactaaccctaccattgaagcgttgaaaaagcaagttgctgcaaacagccaggattctgatgctttatttaagctggcaaccgcttaccaggatgctaaaaactggaacggggctatccttacatggcagaaaatgtcagctcttcttccagactgggcaccggcatactatagccagggatattcttaccaacaggcaggaaataatgaggctgcaaaattggcttatgaaaaattcatcagcacagtaaagccggctgatcaggaagcaaacaagcagactctagcttatgcttacttcgcggtagcatatatgagcaaagattctgatcctgcaaaagcaaaagattatgtagcgaagtctttacagctagatcctacataccaggatgctgtaaaattaaatgcagaaatcaacaagtaatttaaaatttaaattatagatattaaaacttcccattcgtaatgtttgggaagtttttattttaaatcctatctttgaatctatgaaaactgatatacttgcttttggtgcacatcctgatgatgtggaactgggatgtggaggaactattgctaaaatggtttctgaaggaaaaaaatgtgtggttgtagatcttacaagaggtgagctcggaacaagaggaacagatgaaaccagaaaaacggaagcggctgatgctgccaaaatcttgggtctttcctcaagagagaacctggggatgaaagatggatttttggtaaattcagaagaatatcagatgaggatcgtaaaaatgatccgcaaatacaggccagaaatcgtcttagcgaatgcaattgatgatagacatccggatcatgcaaaaggagcgaaattagtgtcggatgcgtgctttttgtccggactgagaaaaattgaaacggtattggaaggggagagccaagaagtatggagaccgaagcatgtttttcattatatccaatggaaaaatattcaaccggaatttgtgattgacatttctgaatttcttgacaaaaagattgatgcatgtatggcctataaaacccagttttatgatccaacttctaaagaacctgaaactccaattaccacaaaagacttttatgagagcttaacttaccgtgcacaggatttaggtcggttatcgggagttacttacgctgaggggtttacgtctgagaagttaatttctttgaaaaattttgacggaattgtttggtagttgaggaaattgtcctatatttgcactcagaaaacggtgattgtagctcagttggttagagcgtcggattgtggttccgaaggtcgtgggttcgagacccatcattcacccaaagaaagtacactttttgaaagtgtacttttttatttcctatccattttcaatcatttgcaactcagttttcatctactttttattgaatacttttttcagtttgtacttataaatcttgtgtaaatatgcaaaaatggtttttactaaaatctttaagtactcttgaagcagttgaaattatattcatattttaaataggaatgatgacttcagagcataaaaaaagcatctttttcagatgcttgtgtttttagatattcttttttaaacttcgtcgtcagaatctattgtataagatctgcttttgaagtccttgtcatgtttttctgaaattacatcctcacccttttcattaatgatgaaatctgtggactcattaaacatctcctggaaacttttaaaatcttccttgtaaaggtaaattttatgcttctcgaatgtagcttccccattctctccgaaattcttcttactctcagtgattgtaagataataatctcctgctttcgtctcgcgcacatcaaagaaataagttcttcttcctgcttttaacaccttcgtgaaaatctcattttcatggcgttccttgtattcactcattgttagatattttttaatcttgttaagaacaaatataaaagaattcttttaatcacaaaattttttttatgatttatttaacaattgagaacgaaatggctatgcggttacagaattggcaatttcagtcaggttgataatctggtgggctttttgagcgctagactctctgtgtgtgataattatggaagtggcgttactgatttttttatcaatattttccagaatattgtgttcggtttcggtatctaaagcggatagagaatcgtcaaaaataatgatattagggtctttaattaacgctctggcgatacaaattctctgcttttgaccccctgaaagcatgacgccacgttcacctacaagtgttttatattggtctttgaactcaacaatatttttgtgaacatctgcaattttggcatactctactactttttcgtgagaaggatgatcgatggcaaatccaatattattttcgatagtatctgagaataaatagctttcctgaggaatgtatccgataaagtttctgtagttatccagattatggtctttaagatttttaccatcaatcaaaatttcaccctcagttggatctatcagccggcataaaagcagggcaattgttgattttccgcttccggttttacccataatagctaaagactctccggcttttactttgaagcttaaattatccagtgccttgattcccgtattaggatatacgtaagaaacatttctgaattctatatctcctttaatagggtagttttcaaaattagtattaatgatctcggatttcttatccataaattcattgattctttgcatagatgcttcagccctctggttcacggaagttacccatccaaccatagagaaggggaaaatcagggtgttgatatacatgaagaaatcagcaattttaccaatgcttaactctccggcaatatactttgtaccgcctatcaatatgatggcaacgttcaataatccaataacaaaaagaataatggtgaagaaataagcttctgtcttcgcaagatctaaagccttattctggtaatcagtaactttaactccgtagtttttttcaatgtatttttctctcgcgaaaaattttacgacacggattccggaaaaactatcctgaacaaaagtggaaattgcagactggcttttctgcatgatcttcgattttttgttaataatcgaacttactttataaattgcatatgataaaataggaagcggaagtaaagtccacatcgtcatggaagcatccgtttttaccatataaatagcagtgatcagcacaagaacaatcaggttggccacatacattactccgggcccgagatacattcttacagctactacatcttcactcagcctgttcatcaagtctccaatagtagtctgcttataatccgttaaagataaatcctgataatgtctgtatattttatttttaagctcatattctatccttctggaagcaacaataatggtctgtctcatcataaaggtgaagaatccggttagaagagagcatcctacaataattccaacataaattaaaacctgctggttaaagccaagattcccgcttttagtaagttcatctacagatttccctacaaactgaaccttatatatgttaaagaaattactggcaataataaatagtactccccaaaacaataatattctgtgtttccaaaaataaggatttaaggtttttagcgctttcatatagtttgacaaaattacaaaaatgtcatcacactacgaatttcatcaattttaaattttgtatctttgcacccataaaaaagctctttgaatgttaggaagacgacaaatccgtgaaaaagtagtacagacagtgtattcatactaccaaaatcctgtaaaatttgatgttttagagaaaaacatgtttgccgggatagagaaaatctattatctgtacatctaccagcttaattttttggtagctcttaaagaattggcagaacaccagatcgaaattggtaagaataagtttcttaaaactgatgctgatatcaatcctaaccaaaaattcatcaacaaccaggtattgcttaaactggaagaaaatcctgaaagattattttttaccggtcagcacaaacaactgaaatgggatatgcatgatgatttattggtaaaaactttccaaagaattactgcagggaaacgttatcaggatttcatgaaagaagaaggttactcttttgaagaagatcagaaatttatcggtaaattatttttaagatatattgctgagaatgaagattttcatgattatttaggagataaggaactttcatggtatgatgatatccacattgccaattcaatggtacagaaaacaattggtttcctgagagaggatgaagaaagcagaactttgatcaagatgattaaagatgaagatgataaaactttcgctgcaaaactgttgaaagacacattgaataactgggagaacaatgaaaagaaactggaagaaagacttgaaaactgggatctggaaagagtttctctaatggataaagtaattttgtctacagcaattgctgaacttgataactttgctttcacgccttcaagagtcatcattaatgaatatattgagattgcaaaagtatttgctacagaccgttccaatattttcatcaatggtattttagataaatattgtaaagatcaaaatagaatataaaatgaaaaagacgttatcaattatcgccttgtcaattataggctttgggttagtttcatgtaaaaaagaaaacaaagaaactcaaggtactgaaactgcagctactgactctgcaaccgttgcggctcctctaactgattctgcagcagcacctgcaactggtgaagcagcagctccggtttctaatcaaccttctacttctgttgctttatctgaaaacagtttcgatttcggaaaaatcaaaaaaggagataaagtagagcacgtatacgaaattaccaacacggggaaaaatccattgatcatttctgaagtgaagccaggatgcggatgtacagctccggactttacgaaagaaccaattatgcctggtaagaaaggaaaagttacattgcattttgattcttcaagcttcgacggaaacgttcagaagtatgcagatgtttttgcaaacgtagaaaaagctccgatcagattaacgttcactgcgaacattcaaccataataattaaaatatgctgacattatttttacaggcacagcctcagggatcttcatcaatgatgctgatcatgatgggtgtaatgtttgtagggttttatttcctgatgataagacctcagatgagaaaacagaagcaggaaaagaactttcaggaaaaccttaaagtaggaacaagagtagtgcttacatcaggtcttcacggaagaattgctcaggttcaggatgatggttttgtaatcgaaactttatccggaaagctgaaattcgaaaaagctgcggtttcaagagaaatgacagaagcccgctttggagcaaaatctgctgataaggcagacgataaaaaagaaacagccactgaagaaaaaaaataattcagtctgaaaatatttggttgcggcgggtgaacaaagttcacccgccgcagcttttttatgcacaattataaaagcaaatttatcctgtgtttattagtggaaagatattgtttaaataaaaatttatctttgtgctatgaatcaaaatacaaacaaaacggtcctgattttgggagctaattcagatgttgccaaacaatgtataaagcaatatcttgaaaaaggattttcagtaattgctgcctccagaaatacggcttcactggaaaattttatcggctcaaataatctggatcaatcaaaaatttctgttttgtattttgatgctgcggattttgattctcatcaccaattttatgctgacctttctgtaaaacctcatattgtagtgtatgccgcaggctttttagtagacaatcaaaaagcgctaactgacttcaagggagctaaacaaatgatggaggttaattacatgggaggcgtatctgttctgagtattattgcaatggacgaaagcaataagaatctggaaagaattgtcgggctttcttcattgtccggagtaagaggaaggaaaagtaattttgtctatggaagtacaaaggctgcatttacacagtttttggctggattgagacaggagctgtcttcccgtaaaatcattgtgaatgctctggtcatcggctatatcagaacaaaaataaacgaaggactggatttgaatgaatctctgatcatggaaccagagtatgtagcgaaattcattgtcaatgcaggaaattcttttactattgttccaaactttaagtggaaaattatttaccatatcctgaggcttttaccggaaaatctggtggcaaaattaccttaggtaatatttatttaattgttattttctttaaggttaatacacttcggtaccgtttttgtaattctatgacccgaaaattatttcttcctgcaaaattcaatttctgaatgagtattgagtaaagctgaaacattccgttctgcttgcaatctgtttttaaggatcaatataatttactttcactccgggagtgtaagttgaatttctgtttaaattttgcaggagatgtcaatacctattgatataaatagtaaaacacatatataatacaaaaatggacgatttagaattgaacaagatccagcagcactgggatacattaatttcttcagcaatttcatgggccccgagaatttttactgcaatcatttctgcattattaatttacctgattggatcgtggatgataagaatgattaaaaagctggttgaaaaagctttcaaaaaacggaatatggaagcttctctgcagcattttcttttaaacattatcaactggggactgaatattctgttgttcatcgtagttgtaactcagctgggggtacaaacttctgcatttgtagccatgattggtgccgcaggtttggcagtaggtttagctttacagggatccttaacgaattttgcgggtggaattttgattttattattaaaaccttttaagattggtgactttatttctaccaattcaggagtttcaggaactgtagatgctatagatatctttcatacaaaactcattacaccacaaaaccaacttatcgttattcctaacggcgttgtttccaacaatagtattaccaattttactcaattggggacaagaagaacatcattggatatcggagttgcttatgatgcagatttaagacatacaaaagatcttttaatgaatgtcattaaaaataatcagtatgctctttcaacacctgctccacaggtagtggtaacagaacttggagaaagtgctgtcaatttatctgtaagggtaagctcctccactgaaaacttctggactatgaatgaggaactgatcattagttgtaaagaagctctcgacaaagcgggaatcggaattccttttccgcaaagagatgtacatatttacaatcaataattatatttaattttttaagaaactcctgcatatattatgtgggagtttttattttaatctatattctgcagcgcctccaaagccttcatcatatcaattcccttacctaaaaccggcttgaacaaatcacccttttctttaatcctatcaagagcgttgtcaatattaaaatccgtaggcttcacacctggttttaattcatcccaatccagaggcatagaaactgaagctccctgtttaggtcttaagctatatgcactcgccaaggtttgcccggttctgttctgcaggtaatcaagataaatttttttgttatctcttttctgaaggcttctctctaaagtggtcagttcaggaagtttttcattcacctgtttcatcagaatatgggcgaaatcttttacctggtcaaaatcatatttaccacccattggaatataaacgtgaatgccagtgctgcctgaggttttgcaatagccttttattttaatcgattttaaaacttcattcacctgaagcgctgtttcaatcacatcatcaaatgtattcttttttgacggatcaagatccagaacgaggtagtcaggatgttcaagatctggaagtgagctgttccacggattcatatcaatacaacctaaattattcagataagctaaggttgctttatcattacagtaaatatagtcgatatatttgtcattcgattcagaatatacctgcgtggtttttatccagtccggtatggtgtctcctgcatctttctgataaaagccctgttcttcaattccattgggaaaacggttcagagaaagaggacggttcttcagataaggtaaaatataagtcgccacagactggtaatagtcaataacatctccctttgtaatgccatctttaggaaaatagatcttatcctgattggtcagtttaactttatgtttatctagtgtgatctccttttctttttcagaattttctgtttttttagatgatgtttttgtcttcatttctttaggtttttcggtgaagggtgattccttgatatcttctggtcctttgtcctctctgacggttataaaaacaggatgtctgaatattccgtcccgggtaatttcagaatatttgatttcgcataccagttccggctttatccacgttacaggcatattcgttttaggaattttttcgaaaggggaggattttacaattaatttctcaagtctttgataaagttcctttaaagacgttttgttaaatcctgtacctgtatggccgcaataggtaagtttttgattaatatatctccccagtatcaatgccccgaaactttcacgtgatcctctcggttctgtaaaaccacaaataattacttcttcagtatttgaaaattttattttaagccagtcactggttctgtggttttcaatatataaactgtccgcccgctttgcaatcataccttccagctgcatttttttcatttgcttaaaaaattcaatgcctttttcaggaatatgatcacaatatttaatggtatcagtttcaattaaagcttcttttaaaagttctttgcgctgaatgagcggaagttcttcagtagaatggccattcagccaaagaaggtcaaaaacctggtaaacaagtggagtgcctggattatccccgatttgctgtagaagctggaaattgggctttccctgttcgtcataggcgacaacttcgccatccagaatcatctgatatttttgcttatcgaaatcctgaacaattttgtcaaattttgataaaaatgaaatcccgttccgggaatagaagagtgggctttcatggctgaggtccgcaatggctctgtagccgtcccattttatttcaaatatccagtctttatcgttgaaagcatcttcggaaagtttggccagcattggcctgatgaaagatttaagctttttttcgtttgttaaagaattgaaacttctgaatggtttttcagaagttacgacctctttttttcttttatttttaggctttttttttcctctaaaaattttgtgaccaaagattttggtgatgtgttttcttcagcatcatacggactttctgcaaattcgtctttatgcttaatgagcagccatgagttgtcatccgtatttttcatttttaccaaagcaaattctccttttagttttttgccgtgcaaaataaactttaaagaaccagcatgaagttctttcagaagttctttttcatcagaaagcttagaattctcttccaaaggttcgtaagttccgctgtcccatacttccacttgtccggctccataatttccttctgggatattaccctcaaaatctttataatcgtaaggatgatcttctaccatcatggcaagacgtttgtcttttgggtctaaagacggacctttcggaacagcccagcttttcagtacaccttccatttcaagccggaagtcataatgaagcctggaagctgcatgtctctgtataacaaatatcagcttgtctttgcttttctttgtttttccctttggttcgctggtttcattgaactttcttttgttatgataatctttgagagccattacgatgcggatttggatttagaggtattcaagctggcttttaattgagccataaggtcaatcactttaccttcttttgcaggctgagctttgttggcttttacgtttttgccttttgctttctgtttgatgatcttcatcaattcatcagaataggtgtctttatacatagcgggatcaaattcctgtgaaagctgctcaatcagacttactgccattttaagctctgcaggtttgggagccttttgggcagggatttttaaatcttcataatcccttatttcctgagcaaatcttaaacggttcaggactaaaatttcatcattgtaaggacgtatcattccaatagctgcgctgtcacggagtacaaatgtccctacgcctaccatgccggttttttcaagtgccttcaataaaagcctgtaagcactttctccatttttctgaggttccagataataaggtgtttcaaaataaacactatctacttcctcttctttaacgaattggtcaatagaaagtatttttgtcttttcagggcttgctgcttcgtaatcttcttcatcaagaacgatgtatttgtcgtccatgagataacctttgacgatgttttcccattttacttcttttcccgtattttcattcactcttttgaaccggatattggaaaaatcagacttatcgagcatgtcgagatccagttttgtggtttccgttgccgagtaaattttaacaggaatgtttactaaaccgaagccaatggcgccgttccaaattgctttcattgtcttacgtttttaaaaatcaagcaattaatatgccgccaaaaggtcatgtggtaccttttgtaaactttgttaccaaatgacaattgttttttgcggtgacttttatacctttatatttccgcaattcgtggctgataatacatatggaagagctttttacttatatcagaaaattcgtaacactgaatcctcaggatgagcttttgattgctgagggaattcgggaaatcactgtaaagaaaggggatctttttgtagaagccgggaaagtaagccaaagaattgcttttgtaaagaaaggtgttttcagatctttatattataacagacagggagatgattttaccagatatttcatttatgaaggacggtttatcggggattttcagggttttactgatcagttgcctgcccatgaagatattgaggctattactgatgcagttctgttggtgattgattttaagcactttaaaattctggaagataaaatttccgtgtggcctgttttgtttgcaagaattcatggttttgttgccgagaacaaactcaaagtggcgagcatcatgttgaatcaggatgcaaaatcacggtatattcactttttaaatcattatcccggccttgccaatagagttccgcagtctatgctggcatcctatcttggggttacaccttcttcgttgagcaggatcaggagaaatatcttataaggtttgagagtaggagagtatagtgtttatgagtttaccaacttctgacatctcataatcgctttttgtcaaatgacaatggtctttctgtctgactgccatagctttgcctcataaaatttaaagtacaaatatggatattgtattaggactacaatggggagatgaaggtaaaggcaagtttattgatcttatcagtgagaattatgatattacagctcgttttaacggcggatctaatgctgggcacagcatagaaagaaacggccgcagaataacgcttaaaatgattccttcgggaatctttatgaatagtgtgcagaatgtaatcggtaccggaactgttattgatccggtaagttttaaaaaagaaattctgaatcttcaggtatttgataatactattcagccggaaaataatatcattatttctcaaaaagcacacctcgtaatgccaacgcataaacttcttgatatttttatggaggaaagctctgagtacaccacaatcggaactacaaaaaatgggattgctcaggcatattcaaacaaaatactaagacagaacctgcgagtaggagatatattttcatcagattttcaaagcagggcgcagcatattctgaatagagattatagaatgctggaagaaggaggaatgattgttctgcctgctttagaagaaatcagtaaagagttttttgaagcggtggaattccttaaaaaattcaattgtacagacacagagatttatcttaacaaagctttatctgaaggtaaaaaggttttagcagaaggatctcaggcagcgatgctggatattgatcacggtacttacccgtatgtaacgtcttcttcaacgaccgcatcaggcgcgagtagtggcttaggtgtatcaccgaaaaagatcggtgaaatttatggaatagcaaaagcatattgtacccgtgtggggaatggtgcattcccaactgaacttttagatgaatttggagatgatctcagaatgaaggggaatgaatttggttccaatacaggtcgtccaagaagagtaggctggctggatcttcctgctttaaaatatgcggtgatgatcaatggggttactcaattggttctgacaaaagccgatgttttaagcggattgaaatctgtagcagtctgtactcattatgaacttgaagacggaaaaacagtaacggtttcgggactacttccggaaaatggaaaaccggtattcaaatggatgaatggctggaatgctgatttttccgcaatgaaaaatccttcagagctccccaaagaaatgaatgaatttttatcatttctggaagcagaattagagattccggttgcttatctttctaccgggccgggaagggagcaaatgttgaaattggccataaaataattttagacagtttgtatatactgatctgataaacagaagaggttagaaaatttattttctaacctctttatttgtgtaaaaaagcttagttaacttttgtaagagtaaagcgctgttttggagaaggctgaaccgtttgatccgtagtgccgattacaatcggggtaagattcgttgttaaaccatcttttacctccaatcttaatgccggcgcattcttgggagcgaatccaaaaccattgttcccaaggttaaataataaccatttctggaaatctgtattagcattggttcttaattcaacagctgttccacttgttgttccgttaccttttacagtcagtacttttgaaggatccagtatggatttgatgatgtaatacccatgatctgatttactgaaagtaaatctctggttatttcctgtagatgctgaataaagaattacgctggtgccgtctgtagtagaacttccggaaatatctacatttttatcattcgctaaagctgttgttatagtataagttccgttgattgtagagcttgcattgactggtccgtacaaatgatttattcctgcataatcacctgcagataaccctgttctttgcttggtaaatgtagatccgtcaagtttagtcattacaggctggcttggatctatagcaaaatctgtagactgatacatcatgactgaaccgaaatcaaacgcaccatatcctgcgtaatcattgtaaaggttgaagttatggcggcttccttctacggctttgttaacatctacaataatgtactggtctctgtccggacgacactgttcatgcatgattcccatggaatgcattatttcgtgggcgataatggcgggatatgtaatattataaattttaataccgtttactctgtttttctgccatccaagcggagagctgttggaggttgtataagtaaaggtgatgtattcggtttggttcgtacgttgaacaaactgcatactggtttgagaagagatcatatcaaacgctttgttgatattggtaaggaacgtattgtaattctgggtactcatagttccctggctgggtaacgtataatagactgttgcattcggccatgtcttaataaatgagcttacaatagtgcttttttcagtcgtggatatttcagaattggcctgcatttttaacttgtcaaactgctcggcgctaatcgtaatatcatctgcataaaaatattcaccatttacttcattaacgtaggtatattttccgttaattaataatttgtgaatctttgtattgtccagttttgttgtttgatctattggatctgactgtgcattttcaatatccgacctgcatgaattcagtgccagaacaaggcatcctgataagagtaatagtttgcttttcatattatttaatattggttggtgatcaggtttaaatatgaacagctatattattattcacgcaaaagattattaaaattaatcatttctaagtttgattaaatcttcattataattcagctgtatgctgtaaatatattaataaaagattattattgtatataacataatataatgattgttttattgttttcttatgtgataaatgtaaatgtttcgttaattaatttgaaatattttattttttactattaaatttaaaattaagttatttcactaatatttgatttgcaaatgaaagttgtactttatactgctatagagttgattttgttgatgaattaataaatgtactgaaatttgtaaggctataaactccaaataatgctgtcttatgaacatgcatttttgtaaaagttgaattgaatattcctgtaattaagaatataaaaaaagcggggcaaataccccgctttacatttatgcttttaagttcaattgtaattccagttcgtctagctgtgcatcggcaatagaagcaggagcatcaatcattacatcccgtcctgaattgttcttagggaaagcaatgtaatctctgatcacttcatttccatcaagaatagctaccagacggtcaaacccgaatgctaaacctccgtgtggcggtgcaccatatttaaacgcattcattaggaatccaaactgagcttcagcttcttctctggtaaatcctaataaatcaaacattttagactgaagatctttatcaaaaattctgatagaacctccaccgatttcatttccgttcagaaccatatcataagcgttggctcttgcttttccaggatcagtttctaataaatgaatatcttccggcttcggagaagtgaaagggtggtgcattgcatgatatctttcagtttcttcgtcccattccaacagagggaagtcaacaacccaaagtggtgcaaactcattgccttttctcaatcctaaacggttaccaagttccattctcaaggctgaaagctgagctcttactttgttttcgtttccggaaagaatcaacattaagtctccttcttttgccccgaatttttcgatgattttcgctaaatcctcttcattgtagaatttgtttaccgatgaggtttttactccatcattctggaattttacccaaaccattcctgaagcaccaatctgcgggcgttttacccaatcaacaagctcatcaatctgctttcttgtatattctgcacatccttctacattgattccgacaaccaattcagcatcatcaaatatcttaaagtcttttccttttacaagctcattcagttctacgaactccattccgaaacggatatccggtttgtcgtttccgtattttctcatcgcatctgcgaaagtcattcttggaaaatccccgaattcctgacctgtaatatcttttaaaagagctttagtcattccttcgaatacgttcataacatcttcctgttctacaaaggccatttcacagtcgatctgtgtaaattccggctgtctgtccgctcttaaatcctcatcacggaaacattttacaatctggaaatatttatccattccacctaccatcaaaagctgtttgaaagtctgtggagactgtggcaatgcataaaactgtcccggattcattctgctcggcacaacgaaatctcttgctccttccggagtagatttgatcagaacaggtgtttccacttcaatgaaaccttcgtcagacaaataatttcttactttctgtgccattttgtgacggaaaatcagtttatcttttaccggatttcttctgatatccagataacggtatttcattcttaattcctcaccgccgtcagtttcatcctcaatggtaaaaggtggcagctgagaatcattcagaattgtaagtttttccacaaggatttcaatttctcctgtcggaatattaggatttttgcttactctttcaataactcttccggtagcctgaatcacaaattcacggcccagttttttagcctcttccatcagttgtgctgaagaacgctcctggtcaaaaaccagctgggtaattccgtaacgatctcgaagatctacccaaatcataaatcctttatcacggatagtctgtacccatcctgatagtgtaacttcttcattcagatttttcagagatagctctccgttggtgtgtgatcgaaacataattatttgtttaaagttcaatgtttaaggtccaattccggatcttgaatttttcgttggcaaagataagatttttgcaggttttataaataaaaaaaacttcctttcggaagtttcatatattgtttttagattttttaatctctattgccgccttttgcgatgagaattttctttatttcttcactgccttttgtttcatcagctacttcaagaggtgttttattctgacattttttgttaacattggctttattgtccaaaaggaaattcagaatattctttctgtcagccatcacactgaaaccaagaggtgaataaagtatatctccaacaaggaaacatttgttgtaatctcccggtgcaaactgttttttaaatgttgctatatcatcagaataaatggctttcatcttttcctgagtcattctctgggcagatagcatgcttccggacagtaacattccaaatagaaagatagtagagattatttttttcataagaataatttttaagaatatacaaatctaaattaaattttattaccaattgctaagtttttctaataattggatttgtatttttgggattatctaaattaataattgtgaaatgacaaaatatgttgaatttttgaaaaaagcgtttagcggggaagagacagattttaccagagtaaatatcagaagtgccgtattgcttttagctattcccatgatgctggaaatggctatggagtccgtatttgcgcttgtagatctttattttgtcggccatttgaaagaaagtggttttgctatccagacagttggacttactgaatctgtactttcagtaatgtattctattgcgatagggatgagtatggcggcaacagctttagtggcaagacgaatcggggaaaaaaatccggaacaggcttccagaagtgctgcgcaggtattgcttgtttcctttgctattacgtttgttttaagtttactgggagtgatctatgcagaagaaattctgattctgatgggggctaaaccagaggctgcatattatggaaagaattttaccagaattatgatgggaagcagtacgattatcatgcttttgtttttaatcaatgggattttcaggggagctggaaatgcgatgattgcgatgaaaagtttatggatcgccaatattgccaatattattctttgtccggttctgataaaaggtctgggccctgtgcctgctttgggattgaccggagctgctctggcaactaccataggacgaagtattggggttatttaccaattataccatcttttggtggcagatactcagataagaattaaactttcttattttaaacccaattatgaatcaatccaatccatcataaaaattgcaacaccgggaatttttcagtttgtcattgcttcatgcagctggattttccttgcagaattggtagcaactacaggaggagagaatgcatcggcaggttatcagactgctttgagattaatgatgttcttcatgcttcctgcctggggattgagtaatgcagcctccactttggtagggcagaatatgggagccaatgaaatgatgagagctgaacagtcggtaatgaaaaccgtaaaatataatgtcatctttatgctggtagtaagcctgatatttatttttatgggaaattttttagtagggtttttcactcaggaaacagccattaaagactttgccaaaaatgcgcttcagattatgagtaccgggtttattttttatggaatcggaatggtgatgattaatgcttttaatggtgctggtgatacatggactccaacctgggtaaatctttttgggttctggctgtttcagattcctctggcctattttttatcgaaatattttgaactggggcctaaaggagtttttatttcaattcctgcagcagaaaccttaattaccattgtcgcttttattttatttaaaaaaggaaaatggaaaacgataaaagtttaaagcagggtgctggaagatgtaagaaggaagtcctggcagtctgaatatttaaatggccttttgttatcaaaatgaaaaaaagataagtgatctgcagattaagcgtcgaaacaggtaacctgattaacttccagcctcccacttccagcttcccttcttattttataaaattttaacagcttctttaattggattttatcgctgtattttttaaattcgtaggaacaacaaatacatcatactatgggaaaaggagacaaaaaatcaagaagaggaaagattaattccggaagttatggtaaaagaagacctaaaaaagcctcaaaatcttttgtagcttctgaagaaaaatctaaaaagtaattaaaaataaaaagaccgaagattattatctccggtcttttttatgaaaattaaattaattatttacctccaagaatattaccaaggatgctgcctaagccaccacctccttgttgctggtttccaccgccacccaatacacttcccagtatatcgttcaggggatttcctgatgattgagattgtccgccgcctaaaacacttccaagaatgtcatttaaaggattagcctgctgagcctgagcctggtttgaagcatttccaaggattcctcccaacaaatctcccaagccgcctgctcctacattattttgttgcttttgctgaccgatgtaacccattacaacaggcgcaagcatagcaagaataggtccaattttatctattgaaatcccggtgttttgtgacaactggttttcgacagtgcttttttgtccgccaaagatatgatcaagaatagatccgccttcagcctgtcttgcttcaatttgtgaagcgtcatttaaaatacttccgttatggtctttatctaaagcattatttaaagcttctgcttcttttgcatcctgagacttatttctaaggtaagaaataataagaggggtcgctacagctaatagggcgatcacctggtttttgctgattccgaatttgttttcagcctgttcagcaacctggttgcctgtattccctgtaagtaggtcaattaaactcattttttgtgtttatttagtattaagtacaccaaagttatcaaaaaatatgcctcataaaatgaccgtctttcataattattgttaaagttttctgatctgttcttctgtatatcctttgctttttaacagctttatatattctacagcactattggtcatccattcaataggttccggtgcctgttttttatcaatagtaaactccagaatccctacattgttgttcatccatggaagtacataataagagagcccgcctttatattccttaaatgaatggaattcttttcctttctctgttaaggatatgactttataaaacagaagatatcccacaggaatcaacagacaaacccatgaaaattttctcagatgagcatactttgcagcagaaagaccatacccgatagacaaagcaaaaataatattgaaaggcaggaagaaaacgtaattgtctgatactgcataaaaggttgaaaatccatatacacatacagctcccactgcaaaaacaaaaaacatttttctattggtcttgtacagaaataagatacctgcgactccgaaaaatgtaaacaggttgaaattataaataagatatacaaaagattgaaaaaaatcctttacatattgaatgaaatcttttttcagggaatcttctacccatgttccctggtcagaactataaggagatttgaaaggcagcccctgggagatatttaaaatgaataaagaactgaatagcagaataaaaatcaataatgatgctgccgcatattttttttcatttctgaaataaaatagaaagaccaataaggcaggaatcagaagaatattctgaatatgcacccataagcttatccctaaaaataaactgcttaacaggatatatattcttttgttttccgtaaaacttctgataaccgaaaagaaaaaaagacttacccaaagcgaattataagtatatacttctacgatttcggcatttctccaaaaggtaaaactgaaaccaaatacaaaagcagccgtaatagatgcccattctttttttaaaatactttttactgtaagataaatgacagaaactgtagctgctgccgaagaaactactaaaaaccggcttgcttcaattgcgttgatgcctgccagatttttaatgaaaataacagtattaatatataaaaagtgactggttgcagtagcggttgtttcccataggcctttttctgcactcagtacaaatcctacacagtctgcaaaaggaatttttgaaaaacttccacaataataaataccaagaaaaataataaataaaaatacagctgatagagatttgttcatatcagttctttacaattggaacattagaacaagcttctccgaacatcagggattttactattggttttaattgttctaccaattcaatataagcattttcaggaatttctttatcagagcagccttttacaagcactctttttcctctcatttcctcaaaatcataagtctggatagcattatgcattaaaataacttccagatcttcccggcttccaaaaactattttcctggccacgtctgtaagttttgctgttaatacaaaataagcccaaagtggaataatagtatctacagaattgtagatgtatatataagtgtctttatactgttcagtatctattgcatctaccttttcacggaaatctttttctttgagaatcatctcctgaaaaagaaaatctttaaggtcaatacctcttctttccccttttggaagtaaagtggtaaggtcaaaattaataaggccgctttctgcaactttattcctgatttcaaattcttctgacattttttatcattatctttgaacaaatttacgaattaagatcatatctgtcttaatttgttctctatccttactatagaaatgaaatattatattattgcaggagaagcttccggtgatttgcatggaagcaacctgatgaaagccttgaaacataaagatcctaatgcggaattcagattttggggaggtgatctgatgaaagctcagggtggaacattggtaaaacattatcgtgaccttgcttttatgggatttctggaagttgtgatgaacctccgcaccattctgaataatattaaattctgtaaagaggatattcagaagaacagacctgatgttttgattctggtagattatccgggttttaacctgagaattgccagatttgccaaagagcttggaatcaaagtcgtttattatatttctccgcagctttgggcgtggaaagaaggccgtgtagagattatcaaaaaatatgtggatgaaatgatggtcatccttccttttgaagaggacttttacagaaaacatggagttcattctcattttgtaggacatcctttgctggatgctatctcagatttgcaggaaatcagtgttgaaaaattcaaatctgaaaacggactcaatgaaaaagaaatcattgctcttttaccgggttccagagaacaggaagtggaaaagatgcttgaaatgatgctttctgtaagaccgcaatttcaaaactatcagtttgtgattgccggagcgccaagtcttccgaaagaattttatcagaaatatgtggatgataatgttcattttgtttccaataaaacctatgacttgctaagatgttcaaaggcggctctcgtaacttccggaacagctaccctggaaactgctttgctgaacattcctgaagtagtttgctatcgcggaagcaaaatttcttatgccattgcaaaaagactggtgaaaaatatcaattacatttctctggttaacctgattatggacagagaagtggtgaaggaactgattcaaaatgatctgaatactaaaaatctggtaactgaactcaataaaattcttacaggagaaaaaagagaacaggttctgaatgactaccatcttctgagagaaaaacttggtggaaaaggagccagtgaacatgctgctgaggtaatattgaaagtgtaatatttaccaaggtctttaagaatttaattactttttaactatgaattattttaaccgtttcctgctactactgataattacatttttctcaaacagttttgctcagcagaatgatgaaagagataaagtccagatattttattacggatggtatggaaatcctgcaacagacggaagttatcagcactggaatcatgaaatccttccgcattggaataatccgaaatggaataacctcgggcaccatacaggaggagatgatattggcgctaatttttatccggcactgggaaattacagttccaatgatccaaagatcattgagaagcatatgaaaatgatcaaggatgccggagtaggagtagttgtagtaagctggctgggaaaagattcatatacagataaaagccttaacaaatatctgaatattgccgatcggtttaatttaaagatagcattccatatagagcctttctataaaaatacaacagaattaaaagaacagctttcttatctcataaaaaactattctcatcatcacgctttctataaaaaagaggggaaaccacttttctatgtgtatgacagttataaaattcctaaggaagaatgggctgaaatactatccaaaaaaggaaaaaaaacagttagaaatacagatttagatgctgtttatatcgggctttgggttgaaaaagatgatgcgaaattttttgattcagcaggttttgatggcttttatacctattttgccagcgaaggttttgtgtatggaagtacaattgccaactgggattttatggcaagttttgctaaagagcatcatctgatttttatcccttgtgtcgggccgggctattcagatacaagaatacgtccatggaatgaagctaactttaaaagcagaaacaatggaaagtattacgaaaatatgtttgatgctgccatcaaagttaatccggatttcattggaatcacatcattcaatgaatggcatgaaggaacacagatagagccagctgttcctaaaaaagcaggtgatttcaaatatgaagattatgggaaagatcctttattttatattaaagaaacaaagcgtttgacggataaatttctgaaaaagagatagcatactttcaaacgtaatttttataaaaataaattaagctttctgttgacatctttgatggataacgggacgcttatcagttatttaggagataatacatcaatcattaattatctaatttttacagataattattggaattgcaaaaacagcctcttcttattctcgcagtatgctttattcttggaatttttttccaggatgaaatggtgttggcagaatatgctatttattgggctgctgcaatttgtttaatccttctggctatagtatgctttcattcttattttctgtacaaaaccaggacagctttactgatgcttttattttttggagcgggaattattcttcatttttataattccttttcatcagatgaacattcgcagataaagcaaaaagaaataattgtttttaagatttctcaaaaactgaactctacggaaaaatatagaaaatatgaaggaacagcacaaactggaaacaaaagtttaaattcaattttttatgttccaagagattataaagagctggattttattcattactacaagactgaggcttatattacacagcctaaagctcctcaatatgattttcagtttgattacgtccggtatctcgcaagaaaacatatttattatcagacttatatttcaaaagaagtcggatctgcagaacggtatgatttaacaattagagataagttgcggcaatacaggtttacagttcttaatagaattgataaaaccggcatgtcaggaaaaagcaaagaatttttaaaaggccttattctggcagatcgaacagaaattgatgcggatactgtcagagattttaataaatccggattggttcattttctggcaatctccggaacccatattgttgtgattttcggaatgttttactttttgctgagccgttttacccctttaagcttcagaaaatatgcaatggttatcagtttggcttttatctggctgtttgctgcttttatcggatttggaaattcagttttgcgttcctgtattatgctcagtgtttattttaccttcattttacttcaacggaaatcggatcttcttcattcattggcattatcagccttctttattttaattgctgatacacaacagctttttgatgtaggatttcagctcagctttttagctgttttgggaattttttggctgaatcagcccttgttaaaatactttcccaggcaggatagttatatcaaaaaaatactgtttaataccattacagtatctctgtcggctcagctggcaacactgcctgttgtgctgtattacttccatcagttttcattcatctcgatcattgcgaattttattatagttcctttctccgaaatcatcattgtgttttcattcttaatgactgcgctcatttctgccagcgctgattttgaattgataaacaggttatatgattttgtgattcagattttactcaagatgatccattggtttgctgaggtagatgtattgttttttgaaaatattccgatgaactggatagaagtactgtctgtttcggttgttatttttttactaagacctttgatactgaaatttaattttaaaaattcaatggcattgataatggccgctttagtatttctgatgataagaacggggagtacagcttttgaaaaccgtaaagaagaaatattggttcatacctttggtaaaaacaaagttttctccataaaaacggggagtaaagtatctttctggatttcggatatgaaaagtgaggcgaagattctacagtatgtcatcaatccctattgtgcttccagacgagtgaaatattttgagataaaaagcatgtcatcctctgtccaaaaagtggttttcagagataaagtttaccatctgaaatgatggttcttaagatagagattttcgtgcatttataatggatgaattcttatttagaaagattacaaactgtctaattgtgagatttctcactttttgatattgttaaactttcttaattttgtggaaattcaaatttaaacttatatggcaggtttaacgagttctacgataggtagaaaatatgctatggcattatcagctctatttttgctgatttttcttatactgcatttgacgaccaatttgttatcagttctgaatcgtgatgcattcaatacagcatcagattttatgggctataatccttttgtgcagttcttaatgcagcctattcttggttttgcagtaattttccatttcattatggggtttgtattggagatcaagaataataaagcgcgtcctataaagtacgcatctaacaacccttctgtgaactcttcatggatgtccagaaatatgattatttcaggagcagttgttttagcttttttagtgcttcacttttacgatttctggttacacgaaatcaattacaagtatgtagaagttttgactcctgatgcagaacgtttctggccggagcttcatgagaagtttgccgatatctggagagtggctttatatgtaattgcttttgttttactaggcttacacttagctcacggattccagtcttcattccagtctatcggggcaagacatccaaaatatacaccggtaatcaaagctttcgggaaatggtattcaatccttattcctgcagggtttatttttatcgcaatttttcactttgtaactcaataatatcaatatactaatatgagtaaattagattcaaaaattccagcgggtcctttaaaggataaatggaaaaatcataaagaccatatgaaccttgttgcaccaaacaacagagataagattgatattattgttgtaggtacaggtttggcaggaggttctgcagcagctacattagctgagcaaggatacaatgtaaaagcattctgctaccaggattctccaagaagagctcactctattgcagctcagggagggatcaacgcagctaagaattatcagggagacggtgactctacttacagattattctatgataccatcaagggtggtgactatagagcaagagaggctaacgtttacagactggctgaagtttctgcaaatattattgaccagtgtgtttcccagggggttcctttcgggagagattacggaggtcagttagataaccgttcatttggtggggttcaggtaaaaagaactttctacgcaaaaggacaaaccggacagcagttattattaggtgcttattctgcaatgagccgtcagatcggtaaaggtagaatcaaaatgtacaaccgtcatgaaatgatggatcttgtaattgttgacggaaaagcaagaggaatcatcgccagaaaccttgtaacaggtgaaatcgaaagacattctgctcacgctgtagtgattgcttcaggaggatatggaaacgtatatttcctttctaccaacgcaatgggatcaaacgtttctgcagcttggaaaattcacaagaaaggagcttacttcgcaaacccttgctatgtacagattcacccgacttgtattccggttcacggaacacagcagtctaaactgactttgatgtctgaatcattaagaaactcaggaagaatctgggttcctaaaaagattgaagattcggtagccatcagagaaggtaaactgagacctgaaaatattaaagaagaagatagagattattatttagaaagaagatatcctgcattcggtaaccttgtacctagagacgttgcttcaagagccgctaaggagagatgtgatgccggattcggaattgaaaataacgatacaaaagaaggtgtttaccttgatttctctacagagatcatgaaaaaaggtagagaagccgctatagaaaaacatattcataacccgacagatcagcagatctatgaccttggtaagaagtgggtagaggagaaatacggtaacctgttcgtaatgtacgaaaaaattacagcggatgatccttacaaaactccaatgaagatctatcctgcagttcactatacaatgggaggtgtatgggttgattataaccttcagtctaccatccctggatgtttcgtaatcggtgaggccaacttctcagatcacggtgcaaacagattaggtgcttctgcattgatgcaaggtcttgctgacggatattttgtacttccttacacgattgcagattacctttctgcagatatcagaacaggagctattcctaccaattcaggatcgtttgacgaagctgagaaaggaattaaagagaaaattgatttcttcttaaataataaaggaactcattcagtagattatttccataagaaactgggacacatcatgtggaacaaagtaggtatgggaagaactcctgaaggattgagagaagctatcaaagaaatcgaagaagtaagaaacgatttctggaaaaacgtaaaagtacctggtgaaggagaagggatgaacactgagcttgaaaaagcattcagagtggcagacttcctggaacttggacaattaatggctatcgatgcactacacagaaatgaatcttgtggtggacatttccgtgaagaccattcaactccggacggagaagcggaaagagatgacgtaaactacaaatacgtcggagcttgggaatatcagggagcagatatcaacgcggaagtgttgcataaagaagaactgatctacgagaacatcgaggttaaaactagaagttataaataatctccaacctataaatataacattatgagtgcaaaaaaaggcttacatcttacgctgaaaatttggagacaaaaaaatagtaaaactaaaggtcagtttgagacctataaaatatcagatgtatctacagactcttcatttttagagatgctggatattctgaacgaaaatttaattaacgaaggtaaagaacctatcgctttcgatcacgactgtcgtgaaggaatctgcgggatgtgttccctttacatcaatggtagagctcacgggccggatacagggattactacctgccagcttcacatgagaatgttcaaagatggtgaaactatcgttatcgaaccgtggagaagtgctgctttcccggttatcaaagacttaatggtggacagaagcgcattcgacagagtaatggctgcaggtggtttcatttctgtgaatacttctggtaatacattggatgctaatgctattccggttccgaaagaagatgcagacagagcaatggatgctgcggcttgtatcggatgtggtgcttgtgtagctacatgtaaaaacggatctgcaatgcttttcgtaggagctaaggtttctcagtatgcattgcttcctcaaggtagagtagaagctaagagaagagttctaaacatggtaaaagctatggatgaagaaggattcggtaactgttcaaatactggtgcatgtgaagtagaatgtcctaaagggatttcgcttgaaaacatcgcaagaatgaacagagaatacatggctgctcttgtagatcaaggatagaattgattcaaatacatagaaaatcgccttcattttggaggcgatttttttatgatagggattggcctgttaaagtttgttaacttattgccgggtttttgctgttttttatttattaagtatatatttggagcgtagttgaatgggtttcaaaaaacacgttcaattgcttttttaccatgaaaaagagattattagacaatacaaatcctgcttttgaacggtaataataaaatttttaaaaaaaattgatagtgtgaattagcaagccctaaaaagcgtatttttgtgtaatattaaaaattgaaatgaaaaaatatcttttattgtttatcatcgcattttttgtgatgtcttgttcaaaaaaagtagaagtaaaaggaaaaattactggaagctcaccattagaaagaattgaatttgtagaagcttcaggagtaggaaccctgcctttaattaatataggtctggataaagacggaaacttttcaggaaattttgaagctcctaaagacggtatgtacgtaatcaactatgcgggcagacaaaacctgatctatcttgaaggaggacaaaaagtaaatatctccggaaacggagctactttcccaaatgaattcgtcattaccggagatgctaaaaagaacaatgatttccttacagcttctcagaagtttttagctgaatatggtactaaggttaacttacaagtattaatgagtggagatgaagctgcatttttgaaagggatgcacaaaattgaaaatgatattaataaaaatgtagatgatcttgcaaaaaagaataatccaagtaaagcacttttagaatggaagaaaaacgatgtgaaagtaaccattcttaatttacttgccaattatgaaatgtctcacgggccaatgtccggaaacccttcttacaaagcttctaaagctttcaaagattacgaaacacagttagaaactgataaagatgcgatggtgaaaactattcctctttacagacagtatcttcttgtaaaaatgactccggatttccagaaatatgctgaagcaaacagcaagggaaaaacaggaattacaacttctgagatgttcgctcagtatttaaaaactaagaaagatttgtctcagactgcaaaagattatcttttggcatttgtaatggctcaggctgatattcatccgacaactcctgccgcaaatattgacaagattaagaagatcattgattcagatattaaagatgctacgattaaaagtgatcttttaaaaatgcaggtggctattacaggacttaaaatcggagaagcagctcctgaagcagctttaataaaacaagatggaaagtcatataaactttctgaaaacaaaggtaaaccttatatgctgttcttctatgcttcatggaacccttacatcagcgaagctacagtaccagtattgaaagaagtggtgaacttctataagtctaaaatgaattttgtatatgtaaacgttgacgatacaaaagaccagttcattaagacaagcaactctttgttaaaaggaattcagggagtaaatgtttacggagaaggaggtttaaactctgatattgctaagaaatatggagtatacggattcaaattaccttgctttgtcatcattgataaagatggtaaaattgccagcagatctttcgtaaatcttggtgagcaggaattagtaactattttggataaacaaacaggtctttcagcgccaaaagtagatccgaatgctcaaatgcagccacaattacagcttgatccttctgccgcacagcagaaagcttcacagccagcaaatccgcagccggctccgacaaaataataaactttaacacagtatagaaaccttatcttcggataaggttttttttattgtatttttgcaaactgaaacgtaaggtttcaattaggaaaatagaaaattttagaatgagcaggaagaaaaaaagagatatagttcttgaaaatataaaactgttaactgccggggcaaaaggcgttgcaatcggaagaacagacgaaggtaagaccgtaatggtctcaggtgcaattccaggtgatgttgtcaatgtgagagtgaaaaaagcgaagtcaaaatattatgaaggcgaagctgtggaaattcttgaaaaatcacctttcagagtagagcctaaatgtatccacttcggtacctgcggagggtgcaagtggcagaatatgagctatgaaaaacagcttgattttaaacaggaggaagtttacaacaatattaaaagaatcggaggtattgataattttgaaaccgtgccaattctaggatctgaagagcagtatttttacagaaataaaatggagttttctttctccaatgcaagatggcttactcagtacgaaatcagttctgaagaaaactttggaagcaaagacgctttaggtttccatattcctggaatgtggagcaaaattcttgacctgaaagaatgtttccttcaggaagatccttccaatgccataagactggctgtaaaagaatatggagtaaacaatggactggacttctttgatgtaagaaatcaggaagggtttttaagaaccttaatgatgagacagaattccaaaggagaatggatggttcttttccagctttacagagaagaaaaagaaaacagagaaaagctttttgaattcttattagagaaattccctcagattaaaacgttggtgtatgctatcaattctaaacagaatgattctatttatgatttaaatattgaagtatattttggggaaggataccttatggaagaaatggacggactgcagtttaagatcggcccgaaatcgttctttcagaccaactacaagcaggctttggaactgtatagaaaaactctggagttcgcagacctgaaaggagatgaagtggtatatgacctttacacaggaacaggaacaattgcgcagtatgtagcaagaaacgcaaaacaggtaatcggaatagaatctgttcaggaagcgatagatgcagctatagaacatgctgcattgaacggacttaccaatacaacattctattgtggagatatgaaagatatcttcaatgatgaattcatggctaatcaccctaaagcagatgtattaatcacagatccaccaagagacggaatgcaccagaaggtggtagaacaaatcttaaaactttcaccggaaaaagtagtttatgtaagctgcaactcagcaacgcaggcaagagaccttgctttgatgaaagatcattatactttagtaaagatcttaccggtagatatgttcccgcagacacaccatgttgagaacattgcattgcttgttaaaaaataaattatttaaatttgaatttccaaatcttaatatgaaatactttaaatttctcattgtaatctgttttttagggatgcttttttcctgtggcggtgatgatgatatctgtgaaagcggggaaggaactcccagaatgaaggtaggtttcaggacactggcaagcggaaaagatacaaccatagatactttgtatgtatcagtagactatggtgcaggaaaggtggatctgggaaaacttgcaaacattgatttcaggttaattcctttacgtgtagacaactcaccctatacagatgtttatttcaaaaccagattaaaagggccggagtctcatgtaagaataagttatagcacaaagtcaacctatgtgtctcctggatgcggaatcaaaaaaacttatgaaaatttaacttcagaattagtaactccgaatcctgttcagaaactggaagccggacaaaatcaaatagagaatgaagacaagactaatctttacctttctttttagtttattgggaataataagctcggcacaagagaaaaaaaaggaagcagagaaggaagttcatgagaaatataagcctaattttatggttgggcttgatgtattgaataccggagttgggttcttttcggacagaaagctgtatcagggatttatttcttcgaaaatcagaggaaatgtacatgccattgcagaagcaggttttgaaaaaaatatataccagaagaacggttatgatgctaaagtaaatggtcctttcgttaagctgggagccttctacatgctggcaaaagatgcggaaaatgaatttaacggattttatgcaggagggaaggctgccggatcattctacaaccaggaatatatggcggtgcccgttcgtggatttggaggaagtaactcttctgaagcttttccttcatcatcacagtcttctttctggcttgagggaactataggaggcagagtacagttatttaattccaacttctatattgacgtgaatcttcagccaagatatctggtgtacacttccaagcaggatgatatttctccaatgattgttcccggcttcggaagaagttcttcaaagttcaatatgggatttgcatggaatgttgcttataagttttaaaaatagcaaaccttaacttttaaaatatataaaatacaaactttagactgttctaaattttgtattttttttaatgaatagacttgctgggtgtataatattaaaaaatattaacttattttatttgtgtgagttataaattagctatatttggcggaaattataattgtgttttaatttatgaaaagagtatttactgctttaatgtttacttttataggaggagcagtgttcggccaatggacaccaacttcttttaaaaaaggaaacgataacaaaagaagtacaggatttagagtagatcaatctaatgtaaaacctgatggctattataaattggacttagacttactaagatctcaattgaagaatgctaaagagatgggccctaatgctgctcctgttattatttcacttcctaatctggatgggaaaattgaaagatttcaggtgtatagcttcccggttatggttaaggaattagctgataagtatgatttaggttcttacgttgggaccagcgttgatgaccctactaaatatttaagatttagtgttgctcctaatgattttcagtctatgattattcatggagataagtatgaattcattgaacctgctaatgctgataagtccgtatatgcagtacaccctaaaacaatgaagaatggagaaggctttgtttgttcaacagaagaaagcccgcaagctaaaaagcaaatccaggctttattacagaaaggaaagtcttttacaaaccaaccaaccaattttgctaaaaattctgataagaaatacagaacaatgagattggcaatgtctgttacaggggagtacactcaatactttatgacacttgctggtgtaccttctacggctacagatgatcagaaaagagctcctgcattagttgctatcaacaatactctgaccagagtaaacggagtttttgaaaaagattttgcattgcatttgaatttacagaattttcccaatgtaatttatattgatccagctacagatccatattctgctgctaacgtaggagcgggtggagcatggaatggagaactacaggctgctttgacagctaatgtaggagatgctaactacgacatcggacatttgttcggtaaatcgggtggtggaggaaatgccggatgtatcggatgtgtatgtattaaccctactactcaggttcctgaagggaaaggttcagggtttacttctcctgcgaatggaattccatcaggtgatagctttgatatcgactatgttgcacacgagatggggcaccagttaggagctaatcatactttctctcataatgttgaaggaagtggagtaaacatggagcctggttcaggatctactattatgggatatgcaggtataacaggtgctaatactgacgttcaggcaaattcagatccatattttcacgttgcaagtattgatcagatccaagaaaatctcattgataaaacttgtgatgtagaaactgcaattacaaataatccacctgtaattggtgatttaccaacttataatattcctaaaggaacggcatttgtgcttacagcttctgctacagatgctgaaaatgaccctcttacttatgcctgggaagaagttgatgatgctatagctcctattaataaatttaatttagggttaactaaaaccggagcatcattcagatctaagtatacaggaacaaatccaacaagatattttcctagttttacatctgtaatgaatggggtacttaataatgcgaataacacttgggaatctgtttcaatgttgcctagaactactaactttgctgttacagtaagggataacaatgcaaatgttctgcaacagcaaactaaacacagtgttcagacaattgtggtaggtgataacggtcctttcagattggctaatcaatatgctgatgtgaacacgccaactccaatccagtggattgttgccaataccaatgcagctccttataatgttgctaatgtaaagattgactatactacagataacggtacaaactggactgtattatctgcttcaacaccaaacgacggatctgaaaactttactttcccttcttcattgaatggtcagactattaaagtgagaatttcttcaataggtaatgtcttttatgctgtagggcctgttagcattgcgcctctatctgcatgtagcagtgctgcaccaacgaatgtggttgtaagtaatatcacatttagtaccgcaagtgtttcttggatgtcttatactggtgctacttataaggtacgctacaaaaagacaagtggaagtgtttggactgaaattaatacaacagttccttctgttaatttagataatttagtagatgctactgcatatgaggtacaagttgctgtagtttgtaataatactgtaggtacttattctgcatcagttaatttcagtactccggcacttgcatattgttcagcagcaggaaatactggtagcccgatctacatatcgaatgtaacattggccaatatcaataacactactgcagcagctagtggttatactaactttacaaacaacacagctcttcaggttaatctgacaaaaggaaatacgtatcctatcactgttaaagtagcaaattcatctacttatgtaagcgcaatcgtagcttatatcgattttaataaggatggattctttgatgacactgaagcggttatggatcttccttgtggaacttttgccaacaatacagctaccggatcatttacaattccaaatgacgcaatcgaaggttcagctctaagaatgagagttgttggcttttacgttggagcaaataatgcaggtttctatttaccttcaagctatctttgcggtattaatttccaatacggagaagttgaagactataacgtagttattacaggtaaccttgctactgctgagactgctgttaaaaataatggcattcagatttatccgaatccggtaagtgatgttctaaacattactaaagtttcagataaagcaacctataaaatctatagtgctgccggacaattagtagataaaggaaatatcaataatggaaaagtgaatgtttccgctttagttaaaggtggttatgtaattacaatagatgataaaggaattgagcaattcaaatctaaattcattaagaaataagcataacttttaaatattagtaaatccccggaaatttccggggatttctttatttaaagcataaagagataatttgctattttttttcaaaaaaaacctaaatgcacttataaattaataataaaaaatgattagatttgtctgattaatatataatgaaaacattatgaagaaactctttacctctttaattctgtttctctgtttgatttgcacaggctttgtatctaaagtctcggctcaggcaggccagattgggacaggaacgggtacctcagtgtatctccccatacgttcctattacgggtatagttattcccagcagatttatactgctgcggaagtctcggctgccattggtacgtcgacctatatcacagccgtaaagttttatgtagacaccgtatcaaactctccggattcctacaaggattgggttgtttacatgggaaacaccacccagaataactttacgtccaacacaaactggattccgttaggttccttaactcaggtgtatgcaggagatttacctgccatatcaaatggaaactgggttactcttcagttgaatactccgtttatctggaatggtacagacaatcttgcgattgctgtaaatgaaaaaacgccaggttattcatcttctccgggtacagcctggggaacttataatgctggggctaacagaggtattctttattatgaagataccacaaacccaaatccggcttcaccaccttctgcatcaagcagatattctgatattcccagaatacagttggtaagccatcagctgactccatgtactactgctccgccaacgaatattactgtaagtaatataactacggtgtcagcagttgttaactggtatacggctacaggttctacttatgtagtaagatacagaagtttaccttcaggtacgtggcagcaggttaacgttacaactcctctttcaggaagtgcaacaatttctggacttacagagcaaacccagtatgaagtacaggtggctactgtctgtggaggtactcagggagcattttcttccagtgtaaactttacaactccggcacttagttattgtaactccggtgctacgagtacttatattgatggatatatcaaccaggttgcagttaacgcacaaggtgccccatctatgtatagtaactctgatcagagcggttatacagattacagtacagatccttcaagagtggttactttggtaagaggtggtagtgctaccgtttctgtttcaaaaacgtggccaggttatcaatatggcttcttaacaggagtttggattgactttaaccgtaatggtatttttgaagcatctgaaagagtacttacttcaccaagtaataccacaactccggtaacagctacatttacagttccaactgctgccgctggtgcttatacaggaaacctgacgacaagaatgcgtgttgtattaaatgaatacagccctattaatgcttgtggaacatactcttatggtgaaactgaagattatgcagtaaaactgatagatctgtctgcgtgtagtacagcaccgccttccggcatcatggtgaataacgtaactccttcttcagctaatgttacctgggtttctactacaggagctacctatattgtaagatacagagtttctccttccggagcatggcagcaaattgcagtcaacacaccattaatcagtaaccaattactttcaggattgttggaacaaacaacatacgaagtacaggtagctactatttgtggaggaacaacaggtgctttctctccaagtgttacctttacaacacctgctcttacctattgtacagctggtcctacaagtaatactgcaacaagcggttatattaataatgtaacggttactccgacgaacactcctataatgataagtaattctgtatctgataattataaagattatacaacagatgcaacgagagtagttatctttgaaagaggttcggccaataataaaatttctgtaaacaaatactggcctggttctcctacatcatatggagtttcagcatgggtagactttaacagaaacggaacgtttgaaacaagtgagagaattcttaacaccacttataacacaactactccggtaacggctactttctcagtacctactgttgcgagtggtaacgtatatacaggaaaccttcctacccgtatgcgtgttgtaatgagatattttgataatgctaacccttgtggaacattctctcagggagaggtggaagactatgcagtaaaatttgtcgattctcagaactgttcaacggcccctcctacaaatatcacggtaaacaatattggtgcaactacagcaactgtatcatgggttgctactgtaggagctacttataatatcagatggagaactactcctggaggtgtttggcaaactgctacagttcctgccggtcagaacttctatggaattactggacttacagaacaaacgaattatgaagttcaggtttcaacaacttgtaatggttctacaggatcttattccggctcagtaacatttacaactccaccgttgtcttactgtcagatgacaggtacaggaacaaatgaccatatttcaaatgtaacagttacctcttcaaaccttggtgttccaccaatgaataatacttcggtacagggtaactataccagctacactactcctgagacactgattactttagatgtaaattctcaaaataataaaatatcagtagcaaaaggttggacgggttcaacaggaaacgatgctgtaacagcctggatcgactttgacagaaacggacagtttacagatgcagagagaattttaatttctccggctaatacaactactcctgttacggctacatttgcagttccttcaacagcttatactggtgcattgactacaacaatgagggtagtactgaaacgttcaaatgctcctgtaatgtgtcagaatgctgtggatggagaagttgaggattacagagtaagaatcagaccttgtagcaatgcaactccgaacgctccgacatttacaaccactcatacaacagctactgttactattacaggaacaggagtgagctacgtggtaagatacagagttcagggaacaacagcgtggactgaagtatatgcttctacacaattaggtaaccttccattagttatcaataaccttacacctgctactacttacgaggttgaagtagctgcaatttgcggggatgttgtaggaacggctactccaatcaagacatttacaacaagatgtgatcctacacctcctaatgtaaccgtaagtaatataactccaacaaccgcattgattacatgggctccattagcggcaagctctacgtacactatgagatggagaaaagtaggtaccactacatggacaacagtaagcttacctgcgccaccagcgaatacttatgttttaggaagtacaactccattagagtcgtatacgacatatgaagttcagatcgctaaccagtgtaatggtgaaacgacactgaatccatattcaaaccctaaagtatttacaacagaaagaatctgtgagatcccgccaccaggattaacaattactcaattgcttcctacatcagcggcaattcagtgggatcctttccctggagcaacgtatgttcttagatatagaaaagtaggtattccaagctggacagaagtaccatcattagttaataaccttgtattgacaggccttacagaattaacaaaatatgaaatgcaggtagtaaatatctgtaatggtacgccaggaaactatactcctccttactactttacaacacctacagtaatctactgtaaaatgaaggctgagaactctacaggagagcatatctctaaagtaactgtgaagcctacaggtaagaaaacaatggagaatgagtccggagcttctacatatacagattatacaggagtgcctaaaacattcatcgagatgattcagggatcaacggataacgagatcatcatcgagaaaaaatggaccggaactacttacaacgaaggaatcgctgtatggattgacttcaacagaaacggagagtttgatatcaacgaaagagtattcacttcttcacctaattcaaacagcccggtttcaggtaaattcaatgtaccggcagatgcatttgtaagtatgacagactataagtacgttgtgatgagagtagcaatgtccagagatggtattccggtaaactgtacagacttcaagaacggagaggtagaagattacacggtaagaatttctaaacctgctgttttcaatccgattgatcagacaagtgttatgatttatcctaatccggtaagttcagtattgtttgtgaaaaatgttagcaagagagctaaatataagatctacaatgctgcagggcaggtaatcgcagacggtatcttattaaataaccagatcaacgtaagcagattgattaacggtgtttatgtaattgatatcgatgataacggtaacactacacaaaagaaatttatcaaagaataagacataaatttcaaatagaataagcctccagaaatggaggctttttttgtggtggattcacttccacataatatattttttgcgaaaaaaactcgttagaaagcttctaacgagtttttatttattcaatgccgaagattaccttttcggtctgttcctttaattcttccagattggtattattgtaaatgatgcaatctgccattttaattttatccctttcaggcatttgtttttccatgaccgcttctacctcacggtaggttttgttatctctgtccatcactcttttgattctgatattatcctcagcggttaccaaaagagatttataacattgtctgttcagtttgagttcaaaaagaagagctgtttctttgaaaactaaatatttgctttgtttgtttacccagttttcaaaatcaatttttactgcaggatgaatgatttcatttaattgttgaagcaaatctctattgttaaaaactttatctgcaacaaattttctgtcatacaatccgttttcatcgtaagcatcttcaccaagaagttccttgatttttattttcagttcttcgctttcattgacaatagctttggccctgtcatcagagtaatagaccggaaaaccgaattcctctataaaatgagccacagtagtttttccggagcctattccgccggttaaacctatgatcttgggtgctggttccggctctgtctgctgtgtttctgaatgtaattcttccataattaaaaattaatatccaaaaacatcattaaagctgaatgtctcatcaagtcttacccctttatcggtcatttttaaacttgcaagttcattatgggcatcatgttcaaagaacaataagtattcattatctacacactgcttaaggaattttcctttttcttccagtgttaaaagtggtctggtgtcatatcccatcacatatacctggttgatatgtcctgccgtaggaataagatcggctgcaaaaacaatagttttttcctggtattgaattaccgggagcatttgcttttctgtatggccgtctacaaaaatcacatccattttaagatccggtgcaaaaccgtagtttccggtggtaggaagaggcaaaaagttaagctgtccgctttcctgcatcggtataatattttccttcaggaagctggctttttctcttggattaggttctgttgcccactgccagtggttttcattagtccagaagttggcatttttaaaagccggtctgtatccggttctgtcatcgttccattctatagcgcccccacagtggtcgaagtggaggtgtgtaaggaacacatccgtaatatcttcctttacaaagccgtattttttaagatttttatcaagggtatcatcgccccaaagagagtagtgaccgaaaaatttatcatcctgtttattgccaaggccgcagtctacaaggatcagtttttttccgtcttcaatgagcagggaacgggttcccaattcgatcaggtttttttcgtctgccgggttggttttttcccacagactcttcgggacgactccgaacatggcaccgccgtccagtttaaattttccacattgtattggatataacttcatatgtatattttgattatttttttattaatttcattttctccacaatttttcttgcattatcatcagattgctcaagctgggtgatgatattgttaaaatcattctcttttctgttctgagaaagtttttgtttaataaatatctcagttggaataattttaatcccaaaagctcccttcatttctttttccacaaactcccttcccatatcttttaccatcatcggacattgctggaaactttcatatttagatgttaatttatccaaatgggtatacagttcatcatgatccattatttcaacttttccgtgaatctgtacagcttcataattccaggtggaaacattaatatgatcataccagctgctggatatataagtgtgggctcccaaaaagtcacaaagaacttcatcaccgttttttaaggtttttgcctggggattagcccttgaaatatgagtttcaatataaatattttcaggatcatcttcgttgagcatcatcattgaatgagttgcccgtatcttatcaactgaagaaatcagtaaagcaaaagaattttctctgatgatctctctcatcaaattataatcttcacttttgtataatttaggtataaacataaattaatcaattctcattaatcttaaactttaacccttgaaccttgaatttaaaatagctctcccgggtttttaggtcttgtaatattcagatgtctgtacgctttgtcagtaacttctcttcctctcggagtccggataataaatccttcctgaatcagaaacggttcataaacctcttccagtgtttccggattttcaccaatggatgttgccagggcagaaataccaacaggctttcctttaaaattttcaatcataacacgcattatcttattgtccatttcatccagaccaaattcatccacattcagagagtccagcgcatatttagtgatcttaatctcaatttcaccatttccttttatttcagcgaaatcacgtacccttctcagcaatgcattcgcaatcctcggagttccgcggcttcttcttgcaatctcaatggctgcatcttcataaatgatgactcccagaactcttgcacttctctgaataatcatagacagaagttcaatagaataatattccagcctgctttgaatcccaaatcgggcaagcattggtttggtaagcataccacttcttgtagtagctcctaccaaagtaaaaggatttaatccgatctgcacgcttctggcattgggacctgtttccagcataatatcaatcttgtagtcttccattgcagaatacagatattcctctacaacaggagaaagacggtgaatctcgtcaataaaaagcacatcattttcttccagattggtcaataaaccggctaaacttccgggtttatccaatacaggaccagaagtaatcttacagtttactcccagttcattggcgataatattggctaaagtagtttttccaagccccggcgggccatgcaataaaacatgatccagtgctccgccacgtcttttagcggcagtaacgaagacctcaagattttccagcgtttttctctgtcccgcaaaatctttaaagctctggggacggatctgctcttcctgcatcagctcctctcgtgagtagttttccttatctggatgtaaaaaatctggcattaattcatttcatttacctcaaagatagcaaatttagactaagattaaagggcagattgagaaaacgtttagattgaagtcaaggttctttccaaggttaaaaatgagaagacctaagatttaaataattgggatattttaagtatttttgagaggagaaattattaataaaaattaataaaattttgaatgtttagcagaaagatactgattgtaaaatgagtcggtctcaatctaagcattacattaactttaagcgaatgaaattaataggaccattcaggcaggtggtaacgcttgcagaccttcctttaagaggaaaaatttccgatgaacagctggaaattattgtagacggaggaataatagtagatcagaataccattcataagattggaaattttgaaacattaaaaacagaaaatcctgccatagaaattgagcatattgaaggagaacaggttgttcttcctgcttttgtagattctcatacccatatttgtttcggaggaaaccgtgctaatgattttgccatgcgtaatgcaggtaaaacttatctggagattgcagaaagcggcggtggaatctggagttctgtacagcacacaagaaatgcatcagaaggagagttgctgaaaaccttagtagaaagaaccaattttttgcttggcttgggcattaccacaattgaagtaaagagcggttacggtctggatgtggaaaacgagctgaaaatgcttaggatcataaaaaaagcccagagcgaaacaaaggcaactttagtccctacatgtctttcagcacacttgaaaccaagagattttgaaggtggcaatcctgaatatcttaaatatattcttaccgaaattttaccaagagttaaagaagaaggcttggcaagcagggtagatatttttattgaaaaatccgcatttcaacctgaagaaagtaaagaattcttactaaaagcaaaagaattaggttttgaaattacggttcatgcggatcagtttactcccggaagctcaagaattgcggtagaagtgggcgcgaagtctgcagaccatcttgaagcaaccattgatgaagatattcaattccttgcagagtctgacactgtagcaacagctcttcccggagcaagcctgggattgggggaaaagtttactcctgcaagaaaattattggacgcaggtgctattgtagccattgcaagtgactggaatcccggatctgcacctatgggcaatttaataacccaggcctctattctggccacttttcagaagcttacaacagctgaagtattggcaggcatgacattccgagctgcttatgcattgaaccttgaagacagaggacagttgcaggcaggaaagaaggctgattttgtcacttttagaactaataacttccaaaatgtattgtataatcaggggagtttaaaagctgataaagtatatattgatggaaatctgatataaaaattataaattaaccatatttgttcttcaggcagccggtttccaatgtctgctgaatgaagaacagacaataggcaaatgactgaataatgaataatatttggcaaggcagattggacggagaagagcttctctatcacaggatatttcaacgagtaaaggaagagcgtaattatgacaatatttctacaggtgattttgcattgcatggttttgctgtagatgaaggtgtcagaagaaataaaggccgtcagggcgctaaagatgctcccgatgttatcagaaaaaacatgtctaattttcctgtaatccttccggatttttcaatgctggattttggaaatgttacctgtgaaaacggcaatctggaaagtacacagaatgatcttgccaaaaatgtttcaaaagtacttttaaaaggcggaaaatcccttgtgctgggcggaggtcatgaagtgacttatgcgcattatttgggggttaaaacagcttttcctgaacaaaaaattgggattatcaatattgatgctcattttgacaacagacagcctgaaaaaggtgtagggccaagttcaggaacaggattctggcagattgcgcaggaggggccgatcaattctctgcatattggaattcagagaaactcaaatacattgaaactttttgatacagctcatcaatacgggatgaagtacatcctggcagatgaattattttttgaaaatcttccttccatttaccagcgcattaatgatttgctggacaatgtggattttgcctatcttactatttgtatggatgtttttaatgcatcaattgctcccggagtttccgccgcagcgtacaatggtatctttgcagatacaacctttatgcatttttacaggcatatcttaaaaaacaaaaaactggttgcactggatgtcgcagaagtgaatccttctttcgatattcaggacagaaccgcaagactggcagcgtgtcttgtgaatgaatggctaatgatgtaaggtaaagctatattcttccgatagagaaaatcattattttattgacccctaaggaatggaatttgctgatttcaccgtgcttttaaaataaaagcacttataaattcattagctgaatttaaaacagaaatttatattatggaacaattaattgaaagcaagcttattaaagcagataaagcgttttcagtgtggagaaaagtgccgtttgaggaaaggcagaagttaattgcaaaagcagcagagattttaaagaataattcggagaaatttggaaggatcattacaacagaaatgaataagcccatttctgaatccattgctgaagtggaaaagtgtgcattaatgatgaattattatgcagctgcagaaaatatattaaaacctgaaaaagtagaatctgaatttacttactctgaagttcattatgctccgaaaggagtgattttaggagtaatgccctggaattttcctttctggcaggtattgagatttgctattcccgcgattctggctggaaatacagtggttttaaagcatgcatcaatttgtttcggaagtggaaatgctatcgaagatgttcttttggaagctggtttcccggaagggatttttcagaatcttgaagtgggacacaaagatgtaaaagaaatcctggagcatgacactgtaaaaggagtgagcttaacaggtagtggaaaagcaggcggggaagtagcttcaatagcaggtttaaatatcaagaaatctttacttgaactgggaggaagtgattcttttatcatttttgacgatgctgatctggaagaggcggcaaaggccggagcaaaatcaaggcttcaaaattgtgggcaaacctgtactgcagctaaaagatttattattgatgaaaagattgaagatcagtttttacctgtttttattgaagaatataaaaaatatgagattggagatcctttagataaagagacgaaattagcaggaatggcaagacccgacctggcagatgagctggaagcccagttcaacagagcattggaaaatggtgcagagattattattcctttggaaagggtttcagagaatgaatttaaaccaggtttaatcagagttcaggaagggaatcccattttaaaagaagagcttttcggaccgcttggtatggtaatgactgcaaaaaatgacgaagaagctttacaaatggcgaatgatattcctttcggactttccaattctgtttggaccaaaaataaagaacgtcagttattctttattgaaaaccttgaatctggaacagttaacatcaacagaatgacaagctctgatccgcgttttccgtttggaggaacaaaagcttcaggatatggaacagaattgtctctgttagccttgaaagaatttgtaacagctaaaactattgtaggtaattaaaatatatacggatgtcattccggggaaccgaggaatgtggagattcttcactttaatccgtttcgttcagaatgattaactgtactttataagttaacagtatactttacactataaataaaagctcccgggaagtaattcccgggagctttttatgtttttacaaaagtaatttgcttattgcttatactgtagtcaatctcagtgtatttgtttttccaccttcatatgatggagtagcattgatattgattacaaagtctcctgtctcaatataaccataattatgagtcagcatatttacctggatgattgtttcatctgtagacttcttcatatcataataataggcgtggacaccccaaagcaggttcagcattgtgatcactcttctgttaccactgtatacaatgatgtgtgagtttggtctgtgtgctgccagctggaaagccgtatatcctgaatgagtaagtgttacaatagcagaaacgtttgttgttttggcaattcttactgctgcaagacaaactctgtttgtaataaatctctcatcgatgcagttataatctttctcaataggctcatttttatgttgatagaaatgagtagtttcaatattctttacaattttagccatgttttccacaacctgtacaggatacctacctacagaagtttctcctgaaagcattactgcatcagctccatccaatacagagttggctacatcatttacttctgctctggttggcgttaagctgttgatcatagtttccatcatctgggttgcaataattaccggtttggaataaaatcttgctttctctaccaggtttttctgaatggcaggcacttcttccatcggaacttctactcccaggtcaccacgggcaaccattaatccgtcacattcaagaaggatttcgtcaatatttttaaccccttcaggtttttcaatcttcgcaataatcggagtcttgaatttaccattcggatggcttgcaattaattctttcaggtcaatgatatcctgagcatgacgcacaaaagaaagagcaatccagtcaacttccatatcaagcatgaaattggcatcctgaatatccttttctgtcaatgcaggaagagatacctgtgtattaggcaggttaaccccttttttggaacttagaggtcccccctggatggttttagcttttacagtatccttttcattggtttcagtaacttccagtaccagcttcccgtcatcgataaggattctttcccctacttttacgtcctgtggaaactgttgataagtcatatatacctttgtagaatctccctccatcttttcattggtgaaagtaagaatatcaccaggattaaggtaagatccttcctttactacacctactctcagtttaggaccctgaaggtctcccaaaatacccactgaataaccatactcgctgtttagctctctaattatttcaatattttttcggactaagtcgtaatctgcatgggaaaaatttattctgaaaatatcaacacccgctttcattaaatctaacattacctcctttgacgatgaagcaggtcctagtgttgcgataatttttgtcttctttaaatacttattcataatactggataatttgataaagttcctcttcagaactcagtgtataatcttgaattggaaacacaagattttcagggagcaaaattacggaaaaatcaggaaactgttccgaactatgcaaaatatattctacatctacctgattatttaataaaaatttaatgttttcttcttctgtaaagagttctgtctgaatttttttttgcttactttcagaagatttatttgaaatgaaggtaaaacaggtctttgtagacttgtgataagcctcaaatcttggaaaaaaataatcataataccctccgtgaaagacaagatctttctttcttgaaaaacagaggtcgttggtttgatttattttatagaaaaactcatgagcgggtatatcttttgctaatcttaccagtcctatggcaatatcttcaaattctatatcatcaagatcataaagtttttgaatttccaagtatattttcttttttgtttaaaatataaaatgccctctgtgctgccttttcctctgccttctttttggaagtctccgttgcattagcaattttctcttctcccagccatacatgacacctgaatacgacagatttattggcctggatttcctcacaggtttcgtactttatattgacctttttcttttggctccattcgagcagaagacctttatagcttacaattttattttccagcttattgatctcggaaggggtcagcaatttttccagaatgatccttttacaggcatcataatggaagtctaaataaacggcacctattaaggcttcgaataaattcccggagatattctctcccaaagctgaagaactgttttgcttttgcaaaaggttggtaagcttgagatcttctcctaatttattgaggtttttcctattaacaatcttagatttcatctgtgtcaggtatccttcattagcctgaggataggtctggaacaaatgacaagaaataattgtacccaaaacagaatctcccaaaaattcaagtctttcgtaattactgtcttgatttttagaagaatttttcaaagaaaaagcttcacggtaaagagcaatattctgtacctctgtacccaacacttttttaagttcggtactgagaaaataatctctctccgttaattgtctttttctttttttgagaaggaatttagaaaagtatttctgtaactccattcattgaatttagattttcttaaatagaacgcaagcgttgtgcccgccaaatccaaaagtattgctcatggctacttttacatctttctttacagcggtattaaacgtaaagtttaatctgctgtcaatgttttcatcatcagtaaaatggttgatggtaggaggaacagtaccatgaataatagttcccaatgcagcgatagcttcaataacacctgcagcacctaaaaggtggccagtcattgattttgtagaattaatctgaatatcgtaagcatgctcgcctaataatttcgaaattgcattggattctgcgatgtctcctaatggagtagaagtaccatgcatattgatatgatctacttcatcagcagttaagcctgcatcttccaaacagtttttcattaccagataagcgcccagaccttcaggatgtggagcagtcatgtgatgtgcatcagcacttaaaccacctcccaataattctgcataaattgtagcaccacgttttaccgcgtgctcatattcttcaagaacgatacatccggctccttcacctagtacaaatccatctctgtctttgtcgaatggtcttgatgctgtttttggatcgtcatttcttgtagaaagtgccatcattgcgttgaatccaccgacaccacttgctgtaacggctgcttcagagcctccacacacaatcacgtctgcttttcctaactggatcagcattttggaatcaattatagcatttgctgaagatgcacatgcagatacagtagtataattaggtccgtggaaaccatattcaattgaaatatgtccaggagtgatatccgcaatcatttttgggataaagaaagggttgaatctcggaatttccgtattggcccatcctaacacttcagtttcaaaagtctctaatcctccgattccggaaccccagattacaccgactctgtttttatctacattgtcttcaataattccggaatgcgctactgcttctcttgcagcaacaagtcccaattgagtatttcggtccatttttttagcctctttcttatcgaaatgctgtagcggatcgaagttttttacctcgcaagcgaactttgttttaaagtttgtggcatcaaaaagagtaatcggagcggcaccgctctcacctttcacaagattttcccagtattcttttgcattatttcctattggtgttattgctccaaatccggttacaactactctttttaattccataaactttgtttaatttctttttttgttgaagaatattatttatttactacttcttcgatgtaagcgatagcgtgtcctacagtagtaattttttcagcttggtcatcagggatctgaatgttaaattctttttcaaattccatgattaactcaactgtatctagtgaatcagctcctaaatcgttagtgaagctagcttcaggagttacttctgtttcttcaacgtcaagcttatcagcgatgatagcttttactcttgatgcaatgtctgacatagtaaattatttttttaattgttagatggtgcaaatatataaaattctttacgataaaacatttttttagtcttttttgtggaccagaaggttttattttgggttgtggagttttagtgttttagttttcagtaggttatatttattatctgaagatgaatgtaaaatcgatatttagaaagactggaagagtccctgaatgatatgctttcaatttccatcttatggacttcagtttttagaatatcatcttacaattaactatttatttagctaaataggttttctttttttgaaacatacttatatatagtataaaatacacgatgtattgcatgaaatattcttaaagactaagatgtataaagagtataataaaaaaaccatcgagaaatcgatggttttgtggagttggagggattcgaaccctcgtccaaacaagcaatacataagctttctacatgcttattctgctattggttttcgacgggaagcagagagcagacgcccaacttccggcttatcttctaaagttttcgtgctttagccgaagcttctaaagccttatttccgcattcctatatcccaggatcaaacgccgcagaacagagcatttgtggaatatcttgcttccttactgaaatcttcgggaaaacgcttgaatctactatacttcgatattaagctgcaagagcgaactcttcgttgccagttaaaattctgtagcaagggattatagagatcgcgctacggttctctgcatgcttacttacccattggtcttgctgtcgaaaccagtcaaccccatgaataaagtaaatgcaaagatagtattttttgtttatatttcgttactatagatggtttttaatgaaaattaaagcttaaataatttacttggggtaggtgagatttgaatattaagttattgtggataaaaatattattgtctgctaaggtcctttattacggcgatttttcgaagatccggggcagagtggtgatggtttattgtaatatattttgtgttctcataaaaaatgtctacttttgcaatccaaaatgagatgtaaaatatgttaataattccagtaaaagatggtgaatccatcgacagagctttaaaaaaatacaagagaaaatttgataaaacaggtacagttcgtcaattaagagctagacaacagtttattaagccttctgtaactttgagacaagctagactaaaagctgcctacaaacaaagaacacttagcaaagaagagcaggcttaagattttttcttaaccatatattaattcatttcttaaattcttatatttgagaaatgaatttttatttttataccccatgatgctggaaaagtttttagaatacctggaattcgaaaaaaggtactctcctcatactatcacaagctacaaaaaagaccttgaagacttttcccatttctttctccgaacagaatcttccgacaatttagccaaagcagacaagaaaattatcagaaatttcattgtcgaattgagtgaacataatatttccaagagaagcattaatagaaagctgtcctctctccgtagtttttatctttttcttttaaaaattggtgaaattaaagtttctcccactgaagggatctcttccctgaagttttatgctgaaaaacagattcctatgtctaaagaggaaatggcagatcttaatgatagggtgtttgaacaggtgcatgatgtgcttgaaaaatgcattatggaagttctttatcagaccggcatgcgtaaagctgaactttgtggcctgatatttgagaatgttgacttatacggaaaagaattaaaagtaataggaaaagggaataaagaaagggtagttcccatatccaatgaactggctgaacttcttacaagttatcttgaaataagaaatccgcagacagaatataaatcatatttttttgtcaataagaaagggaaaaaactcaacgaaaaatttgtttatgtggtagttaataagtaccttagtcttataacaacgaaagaaaaaaaaagccctcacatccttcggcatagctttgctacacacgttttggataatggggcggagatctccaaagtgaaaaaaatattagggcattccagtcttgccagtactcaggtctacacgaatgctaatattgaacaattgaaaaaagtgtttaatcaggctcaccctcgagcatcaaaaaaagaagaattatgaagatttcagtacaatcaattggtttaactccacacgaaccactagaatcacacatcgacaaaaaagtaagcaaattagataccttctatgacaagattcaggagtgtaaggtatttttgaaagttgaaaataattcggataaagcgaataaaacagccgagattattttagcggttccgggagacgatatcgtagtaaagaagactactacaagttttgaagaaagtctggacctttgtgttgatactgctaaaaagctattaatcaagaaaaaagaaatggcataggaaaaaaagttaaaaaaagtttataaaaaatttgagaattcaaaaaatccgttctatatttgcactcgcaaaaaaggaacagcgatcttttgaattcttttttatattgcctccatagctcagttggccagagcacgtgatttgtaatctcggggtcgtgggttcgaatccctctggaggctcataaaatataaaactttggggagattccagagtggctaaatgggactgactgtaactcagttgcttcggcttcgtaggttcgaatcctgctctccccactttatatttttataaaaaaaacttgcaggattaaagaagttttcttagttttgcacagcgtttaccaataattttggaaacaaaattgcggaagtagctcagttggtagagcgtcagccttccaagctgaatgtcgcgggttcgacccccgtcttccgctcagaaaatcactcttatggtgtgatttttttttaacactgaaatgtgtagagtagagtttctcaatcgctttcagtccttattaaaatgcctccatagctcagttggccagagcacgtgatttgtaatctcggggtcgtgggttcgaatccctctggaggctcattttaatgtaaacatgaggggagattccagagtggctaaatgggactgactgtaactcagttgcttcggcttcgtaggttcgaatcctgctctccccacattttatattataaaaaaaaacttgcaggattaaagaagttttcttagttttgcacagcgttaccaatagttttggaaacaaaattgcggaagtagctcagttggtagagcgtcagccttccaagctgaatgtcgcgggttcgacccccgtcttccgctcaacgaaaaatcacgctacttagtgtgatttttttagttgatgccgacttagctcagcggtagagtgcttccttggtaaggaagaggtcacgggttcaagtcccgtagttggctctcaattttcccgaattttgttcgggatttttttttacccgtcagaaaaagaaattgccggccgacagatctttatcgttaaacctccaattagataattcttgaaattatttttcatttttatataagctttttattgatgaaccgaaatgcagggatcattgaaacttttgattcacctttagaatcacaatcataaattttctttaaattcgtgtaaaataaattttgatgaatattcttttattggaagatgatctcattctgtctgcggagctttgcagatttttagaatcaaataattttaactgtgataagatctacgacggggagacttttatccgccagataaaaaataatacctatgatctgtatctgctggatatcaatgttcctaaaataaacggacttgatgtttgccagacaatccgttcttttgataaaaataccccaatcattatcatttctgcttatggagatatctctgataaaaaagatgcttttacaagacttgctgatgattatctggtaaagccttttcagtttgaagagcttcttttaagaattaattcattgttgagaagaaaagctccttctgataatgcagatcaggatattctaagaattgatgaccttattattaacaagacagaacagaaggtgtatcgtggaggaaatgaaataacccttacgctaaaagaattccagctgctggtttatcttgccgaggcgcagggaagaacagtttccaagcagcagatcacagaacatgtctgggaacataatttcaatacgaataccaatacggtggaagtttatatcaactttctgaggaaaaagattgataaagattttaaaataaaactgatccacacccgttcaggtttcggatactacctaagtccattataaatgtctttaaaaagaaagatagctttaacgatcagtatcgccttttcattactttttggaatggtgatggcggtcatttatttatcttttaatgatttcaggagagatgaatttaaagaacggttcagacagaggcttgaatttacttcccattttatctcaaaatccaaagactttgaagaagaagctcctgttttttttaatgagaattctgataatattcttttaaatgaaaaaatcttaattttcaacgagaaaaaagagttaatctacagtacaatcaaagaccggaatgttacctgggacagcgccatgctgaaagagctggataaaaagaaaatcatttataccgaaaaaacagttccggaaatttatgcagcactcaggaatattaatggtgaaaactattatatccttaccagtgcctttgataccaacggaaaatccaagctgggatacctgaaatatcttttgattacagcttatgtgatgagtacgatgcttattgggtttttcagctattactttgttgagaagtttcttcgtccgctggaagaccttaacaaagaaatttccgaggttaccgctcataaactgacaacacagattcctgttgagcaatctaatgatgaagtcagcgttcttgcaaaatcttttaatacaatgattgcaagactggatgatgtatttcagtcacaaaaggattttacggcaagtgcttcgcatgagattcggactcctattacaagaatggcatttcagctggagaatcttattaaattcgaagaacactcaccggaaacattatcttctttaaaacaaattcaacgggatatctatcagttgtcagatcttaccaattcacttttactgctgacaaagtttgataaagaaaatattcagagcatttatgaagaagtaagaattgatgaagtaatttttgaagcttttgaggctgtagaaaaaagttatccacagcttaaactggatttcctgattaatgaagacagctccgaaaatgcgtttctgacgataaaaggaatccagtcactcctggtgattgtctttatcaatttgttcaaaaatgctgccgtttattctgataatacagaagtaaaagttttgattaccgaaacaaatgataatctttccattgaagttatttcccatggcaataccatccctgaagaagagcagagtaaactgtttgaagctttcacaagaggaaacaattcccagaatattgcaggatcaggtttaggactcagaattgtcaaaagaatcctggaatatcatgatgcagatatcatttattcttcacctgaagaatacataaacaggtttacactatattttaaaaaataaattaaagcagctggtccggaaatcagttgctttttttgttaaactcccgattaaaattttaataaaaatatcaacgttccgggaaaaaagatttctttttttattgattaagctttcatgaaacagcctgtttaaggctattttaatatttttttaagcgtcatttaagtttcttttaatcgcatcaaagcaattttgtattttaaaaagaaaaataatgaacagaattgcagtgctgtgcctcgccgtttcctcattcatggcggcacaacagcagatgtctcttttggaatgcgaagaagcctttcagaagaacaacctccagctgctcgccgaacaatataacatcaatatggctgatgcggatattctgcaggctaaaatctgggaattacctcagttaagcgggcagttcaatgcctataatcctcaggataaaaagttttttgatgtcggacactcaaaaggagcaggaattacacaattgatttatatgggtggtaaaaagaaaaatgaaatcgcttttgccaaatccaataaagaactggcgcagcttcagttttcccaattgcttgccgacctgagagcccaactccgttctgcttattttaatctttactacgaaaagctaaaacttgaaaataccaacaagcagctgggatatatgaatgatcttttgaatgcatatcgtatacagtcagcaaaaggaaacgtttctctcaaagatgctgtaagactgcaaagtattgtaatccagctgaatcatgacaaacttgagattaataaaaatattctggatttcgaacagaatttaaaagtcttaacaggtgtttcagaggatatagaaccgacaatgtctgaggcagaagccaaagaagttttgtcagcacagcctttcggcgatgaagaagaacttaaaagtaaagctcttgagaataatgctgattaccggtacaatcttaaactcattgataacagtaagctctatgcacagtggcagaaatctttgaatgtaccagacgtcacagtaggtgctgcatgggatcaggcaggtggaacctttaataatgaagcaaatctgacattaggaattcctttacctttatggaaagccaatcaggggaatgtggaaaaagctaactatgctattcagcagaatcagaaaaatgctgattttcaaaaactgacccttgaaaccaaagtgcagtctgcttataaaacctggaaagctcagtatgaccagctacaggatgttaaaaccacagatcttcagaatatggagcttgtctacaccggaatgctgaataatttcagaaaaggaaatgtgaatctgattgagttcacagattttatggacagctacagggaaacagcccttcagatctatgatatgaaaaatgagatcatgcaatctgcagaacagcttaatcaactagtacaaacgaaaatcttctattaaaatcatgaaaacatatattatccccgtattgatggtccttttgttagcggcctgttcaaaaaaagaggaagaaaaaaccaaccaggccaaaaaaggatttgaattaagcaataccatgttgaattccatttccttagccaaagttgaaaaaaagaatatagaagatgaatacagtttttacggcaaaatctctgcagacaaaaacagttatatagatgtatacccattggtaggaggaaacgtaatgagtgtcaatgtggagcttggagattatgtgaaaaaaggtcaggtattggctactatcagaagtactgagcttgcagaaatccagaaagatgtaagtgatgccaaaaccgatctggtagtggcaaaaaataaccttcgtgttgccaaagaactctacgaaggaaagctgaatactgaaagagatgttctggaagctaaaagccaattacaaaaagccgaagaccaattgcagagagcaacagcggtaagtacggtttataatgttaaaaccggaaacatatacagtgtggtggcaccgataagcggatacattgttcagaaaagtatcaataaagatatgcagctgagaagtgataggagcgataacatttttgatgttgccaataccactaatgtatgggccattatgaatgtcaatgagtctgatatcgataagatcagccttggaatgaaagctcaggtttctacactttcttatccggataaagtttttgatggtaaaattgataaaatattcaagattattgatccgcagaccaatgctatgcaggcaagagtggtcctggataacgccaacggacttctgattccggacagtaaggcaacgataaaagtttccagtctggaaagtaatacaaccttaacggtcccttccaaagctgtcatctttgatgataataaaagctttgtagtgatttttaaatccagaacagatgtaaagatcagagaaattaaagtgctgaagcaggtaggtgatatcacttatgttgccgacggactgaaagaaggagaagaagtaattaccaacaaccagttgctgatctaccgctcgctgaacagctaatcttatgaaacccttaagaatgctacatttttctttaacggcttttttaggtcatcaatttatctgtcatgaataaattcattaaaaatataattgctttttcattaaaaaataaagcatttacctttatctgggttgcaattttagccatctccggatttataagtttcaaaaatatgcctattgaagcttttccggatgttaccaatacccagatcgtaatcattacccaatggaatgggcgtagtgcggaagaagtagaacgttttgtcaccacacccatcgaattggcgatgagcccggttcagaagaaaacaagtgtgagaagtaccactatgtttggactttctattgttaaaattctgtttgacgacggggtggatgatacttttgccagaaatcaggttaataaccagttaagaaccattagccttcctgatgaggtagatccggaagtacagccaccctacgggccaaccggggagattttccgctatacattggaaagtaaaacaaaagattcccgggcattgcttactttacaaaattgggtgatagaccgtgccttaagaggggtacctggtgttgccgatatcaatgtcttcggagggcaggataaagtttttgagctgagcattgatcccagagcactggataaatataatcttactccgcttcaggtatatgatgccgttaccaagagcaatctgaatgttggtggtgatgttattgaaaaaaacgggcaggcttatgtggtaagggggattggtttggtaaaatcagttgcggatattggtaatattaccatccagaatgacagcggaaaccctgtgctggtaaaaaatgtggcggatgtccatgaaagctctatgccaagggtaggacaggctgcactgaatcatcatgacgatacggtggaaggaattgttgtgatgagaaaaggagagaaccccagagaagttttggtaggagtaaaagctaaaatcaaagagcttaacgaaaaaattcttcccaaagatgtcaaaatggtcactttctacgatagggacaacctgatggattttaccacccataccgtaatgcataaccttattgaaggaattgtactggtaacggtaattgttttaatttttatggccgactggagaacaacgctgattgtttccattatcattccattatctctattgtttgcatttttatgcttaaaactggctggaatgagtgcaaatcttctctctttaggagcggtagacttcgggattattatagatggagccgtcgtcatggtggaaggactctttgtgatgctcgatcataaagcgcaccgatacggaacagagaaattcaataaactagcgaaaggaggctggatcaagcagaccggtaccggattgggaaaagccattttcttttcaaaattaatcatcattacttctctgattcctattttttcattccagaaagtagaagggaaaatgttctctccgctggccttcacacttgggtttgcattaatgggagcgctgatatttactttaaccctggttcctgttctttcccatatccttttgaataaaaatgtgaaggaaaaaaataacccttttgttaacttctgggacagaatcgttttaaaaggctttaatttcacatttaagcataaaaaaaccagtatgatcgtagcggtctccttcctggcagttactctgttttccggaaaattccttggaacagaatttttgccgcagttgaatgaaggttcattgtggattactgcagaaatgccgatgagctcctcactgaaagaatctctgaaaacagcagaccttctaaagaaagacattatgagcttctctgaggtaaccgatgtgcttgcgcagaccggaagaagtaatgatggaacggatcccaacggattcggatttgtacagtttgctgtaaacctcaagccaagagaagaatggaaacgtaagattacttatgatgaactgattaatgaaattgacaaaaagctcagaagctaccaaggaattactttcaactattcgcagcctatttcagataatgtggcagaagcagtagcaggctttaaagcagaaaacgggattaaaatctacggtgataacctggaaacactggataaacttgctcatgaagttttattgaaaatcaaagatgtggacggggtaaaagatcccggaattattaaaaatattggtcagccggaagtaagtgttgttttggacagagataaaatggcagcttatggagtaatgccggcagacgcacaagctgtgctggaaatggcttttgggggtaaaactgcttcagaaatgtttgacggtgaaagaaaattcccgatccgtctccggtattcacaggaatacagaacaaatgagaatgatattgctgctttgatggttcctactcaggatggagcaaagatccctttaaaggaaataagtacgattgttaaagataacggagctgcgtttatttacagagataatatcaaacgttatatcggggttaagttctcaatccgtgacagggacctgggaagtacgattgcggatgctcagaaaaaagtagcaacaattgagctgccggatggttattccgtaggatggactggtcagtttgaaaatcagcagcgtgcctctcacagacttgcgcaggtggtgccggtgagtattctcatgatcttcttcctgctgtttatcctgtttggaaatatgagggactcgcttcttgtattagctaacgtaccttttgccttaatcggaggaattatcgccttgcatgttaccggaatcaattttggaatctctgccggagtagggatgattgcccttctgggaatttgtatccagaacggagtaatccttatcacagaatttcaccagaatgttaaaaatggccttgatatagatactgccattttaaatggcgtgaaatcaagaacaagaccggtgattatgactgcccttatggcatctatcgggcttatgcccgcggcgttgtctacaggaatcggttcagaatcccagaaacctctcgccattgttattattggaggattgattacagcaaccgtacttaccctgcttattttcccgattattttctggattttcaacagaaccaaaaaactcagccaaatctgatcttatctttcatttatattaattgagcctggaatattctgtatttcaggctttttagtaaaaggtttcagaaagtttttttcaatccggaaaaatgtgtaaatttgcagtctcaatacgttaaaatataaggtttgtccttcactggatgagaatattgaaagtttttttaataaaaagtttttggtatttaaaaattcattatatttgcacaccgaaaatttgaaaaacaataaataaataattttaaatcatggcaaaggaaacgtttaatcgtaacaaaccacacttgaacattggtactattggtcacgttgaccatggtaaaactacacttactgcagctatcagtagtgtattagctaacaaaggtcttgctgagaaaaaagacttctctgctattgactctgctccagaagaaaaagaaagaggtatcactattaatacagctcacatcgagtacgaaactgaaaacagacactatgcacacgttgactgtccaggtcacgctgactacgttaagaacatggtaactggtgctgctcagatggatggagcaatcttagtatgtgctgcaactgatggaccaatgcctcaaactagagagcacatcctactttgccgtcaggtaaacgtaccaagaatcgttgttttcatgaacaaagttgatatggtggatgatgctgagcttttagagcttgttgaacttgaacttagagatttattatctacttacgaatatgatggagataactctccagtaatccagggatctgctcttggtgctcttaacggagacgagaagtgggttaaaactgtagaagaattaatggatgctgttgatacttggatcgagcaaccagtaagagatcaggataagccattcttgatgccaatcgaagacgtattctctattacaggtagaggtactgtagcaactggtagaatcgagtctggtgttatcaacactggtgatccagttgatatcgttggtatgggtgatgaaaaattaacttctacaattacaggggttgagatgttcagaaaaatcctagacagaggtgaagctggtgataacgtaggtctattgttgagaggtattgaaaaaactgacatcaagagaggtatggttatcgctaagaaagattctgttaaaccacacaaaaaattcaaagctgaggtttatatcctttctaaagaagaaggtggacgtcacactccattccacaacaaatatcgtcctcagttctacgtaagaactactgacgttacaggtgaaatcttcttaccagaaggtgtagaaatggtaatgcctggtgacaacttaactatcactgtagaattgttacaaccaatcgctcttaacgagggtcttagattcgcgatcagagaaggaggtagaacagttggtgctggtcaggttactgaaatcttagattaatatcttaaaatataaaagcttccgtaaggaatctctttacggagctttttaactacgggcatcgtccaatggtaggataccggtctccaaaaccgttgatcagggttcgaatccttgtgcccgtgcaaatataaattatgagttcatttgtcgattttttaaaaggttcttataacgaattcagacataaagttgaatggccaaaatgggctgaccttcagtcttctacaattgtagtgactattgcgacagtgattctggctttatttacctttggagttgatgaattgttttcaaaagcaatcagcaacataataggaatgttaatcaacttgtttaattaacaaaaaagtattttcccataatgagcgaattgaaatggtatgtgctgaaagctatcagcggacaggaaaataaagtgaaaaactatattgagacagaaatcaaacgtctagggtttgagcagtacgttactcaagtggttattcctatggaaaaggtgatccagattagaaacggtaaaaaagttcctaaagaaagaccttactatcctggctacttaatgatcgaagctgatctgatgggagaaattcctcacgttatcaagaatattcctggagttatttctttcttaagcttaacaaaaggaggtgatcctgttccaatgagaaaatcagaggttaacagaatgcttggaagaatggatgaactttctgaatttgcaagtgatgttgaaattccttacgtagtaggtgaaaacgttaaagtaatcgatggacctttcaacggattcaatggtacagttgagaaaattcttgaagacaaaaagaaaattgaagtttctgtattgatcttcggtagaaagactccaatggaactaagctacatgcaagtagaaaaagtttaatattattttataaaatataagaagactgcttaatagcagtcttttttgtgtttattggattctggtaattttacaaagttaagatcagataaagacattgtgaaggtgacacccttaaagaaattcaatgatgctttgtaaagtctataacattaaggttgattttaaaattccaatattctattaacttataataatatatagatatttaattttcataatttttcccttttattagagtttttttaagtttattgaaattgttttgctaatgtttcaaactcataactctgttaactgcttctaagggatagtttgctttaataattttatcactgttttgtgattatacttgttttctcataaaggatctctttcgaattgtttaattcaattttggatggcatgtttcttgcaaccaaggtgttaactaatccattgattttatattttttatttcatacactgcttgcggttgtagaataattttctattttaagttgaaaataaaaaaatataaaaaaaacaggttggttaaaaacacaagtcttatataaacacatacccaatgacaaaaattatttcgatgatcactctggtgagtacatctgtgctcgcgaacgcacaggttggtatcaatactgcaacacctgaaaaggagcttacagtaaacggtacgatgaagacatcaggaattgttttcaagcagccaatggaaaaactgaaagcggatgagaattacactttcattatcaaatcgccggctccggagaacaaaattactgcttataatgactcttttgtacctaattcaccggctcccattaaccttattcagttcaagattacgtgtgatcctgcagataaagattgggtgaatcagtttgatacaaaaatcaattctaaaaaattcctggtagtcatttcttcttttggctttacacaacctacaagaacgttttctgccaactggctaactcctgtacctcagatttttgcttattcttcaggagggacgtggaagctgaaggcagactatcatggattctctccggattcatcacttcccacaggggtttggacgctaaatctgttggtatttgacagatcatatgccaaggatttcaattctacacaaaaccttaatgcttcaggaacaggggctgcagcaactccattaattcaataaaacataaattatatgaaaaaaattattgcgatactctttacgggttttgctgcattaagcatgcatgcccaagtaggaatcaatacaaatacgccgaaaggaactcttgatgtggaaggtgaaacattggtagagtcctatttaatagatacggaaaatacgaaggcgggagggaactaccttcttcttacccgttcaaaagacagttcaccggtaggcaaagttaagctgctggatatatcgcttcgtaatgtagcgcccgtaaatatgtataatgttgtattgaaaaatgtgagacaggatgaagtagtgaatctcaatacaggattagatgcgagcaaatatgttgtggctattacaggtgctgtttttacagaagcggtttcagcggcaaatatgacaacaaatccaaaatcgtatggatcttattccacagaaattactcaggtaaccagtggtggtaaaagctaccatgctattaatttagcttttaaaggagccggaactgtttcatctcaaaacggtacatggatgtttactttaaatgtctttgaaaagtcattggttaaagactggggaactttcaacggttctgtttcagcatcagcttcgcctggctattcaggagtttcaaccaacacacctctaggacttcaataaaaagctatgaaaagaaaaatttatatcacaataatcatgtgtctgggattgtttataaatgcccagcagggaaaagtagggatcaacacagcaaatcctacggaaacacttgacgttaatggtaaaacatataccaattctttatacttgagaaatccgggagaacctaccatgtcgggaggaagctttctggcaacttcagaaaatgctttgcagttatatgacccagctttggaaagcagcggattgtttaattaccttaaacttacccttaccggagtgccaggtacaggaattgaagattatgacacaaagatagacgctaacaattttcttgttgtactccataactactcattcaaactgaatgatggtacgaccagtgtaatgcttgactacggagataacggtattaatgataacaaacagggatctcctaatgttgttgcattcaaaagtaacgggacatggcatatcagagcaaagtttacagacagcagaattattgctatgaatgcatccactccgtcaagaacgtataataactttaccgttgatctgtatctgatggcatacaaaagattaattgaaaaacaaaacatcagtgatgttaatgctgatctgggaggaaatgatggctctacccagacgattaataaaccatcgggtttttaacagattttcccgtcagaatatatgaaacggctatttaattttaaatagccgttttatttttattacccgaaatacttaagaatttatttccgcgggataataactattttataaaactttttaaaaatcagtaatttccatttgctaattcaaaaatattttatacttttgcagtccaaaaagtaggtttgtcataggtgagtacgataacctactgaataataaatgcttccaaactcattaattattcaaatttaaaaaacaaacaatggctaagaaagtctttaaaatggtaaagcttcaggtgaaaggtggcgcagctaacccttctccaccagtaggtccagcattgggttctgcaggtgtgaacatcatggagttttgtaagcaatttaacggaagaacccaagataagccagggcaagttttacctgtagtaattacagtatacgaagacaagtcttttgaattcgttattaaaactccacctgcagcaatccagctaatggatgcagctaagatcaagggaggttctggtgaaccaaacagaaacaaagtaggttctgtaacttgggaacaagtaaagaaaatcgctgaagataaaatggcggatcttaactgttttacaatggactctgctctttctatggttgcaggtactgccagatctatgggattaagagtaacaggaactaaaccaactaacgcttaaaacttaaagaaatggcaaaattaactaaaaagcaaaaggaagctttaagcaaagtagaaaaaggaagaatctataaccttgaagaaggttcagctcttgtaaaagaagtgaacactacaaagtttgatgcttcagtagatatcgctgtaagattaggtgtagaccctagaaaagcaaaccaaatggtaagaggtgttgtatctcttcctcacggaactggtaaagatgttaaagttttggctttagtaactccagataaagaagcagaagctaaagctgctggtgctgactatgtaggtcttgacgaatatttacaaaagatcaaagaaggttggacagacgttgacgttatcgttacgatgccagctgtaatgggaaaattaggtccattaggtagagtattaggtccaagaggtttaatgccaaaccctaagtcaggaactgtaaccatggaaattggtaaagcagtaactgaagtaaaagcaggtaaaattgatttcaaagtagacaagtatggtatcatccatgctggtattggtaaagtatctttcgatgctgctaagatcaaagaaaatgctcaggaattaatccagacattgatcaaaatgaagccaactgctgctaaaggaacttacgtgaagtctatttatttgtcttctacaatgagcccgggtattgcaattgatactaaatctgttaactaatatttaatcctaaaacaatgacaaaagaccaaaaagttgtagcaatacaagagatcaaagatttgcttcaggatgcaaaagtagtatacgtagcagatttagaaggtttgaacgctggtaaatcttcagatttcagaagacaggctttcaaacaaaatatcaaagtgaaagttgttaaaaatacacttttacaaaaagcaatggagcaaattgatggagtagattactctgaaatgttcccatctttcaaaggaaactcagcgttgatgatttctgaaacagctaatgctcctgcgaaattaatccaaggattcagaaagaaagaagaaaagccggctttgaagtctgctttcgttcaggaaactttctatattggtgacaacaacctggatatgttggctaacatcaagtctagagaagaaatgatcggtgaaatcatcggattacttcagtctccaatccagagagttgtttctgctcttcaaaacaaacctgaaactgtagaagctaaagctgaaaaagctgctcctgctgttgaagaaactcctgctgctgaagctccagaagctgctgcagatagcactgaagaaacaagtgctgaataattacactcaaaaaattaaataaataatcaacaaaaacattacaacaatgtcagatttaaaaaatttagctgaaacgctagtaaacctaactgtaaaagacgtaaacgaattagctgctatccttaaggatgagtacggaattgagccagctgctgctgctgtagtagttgcaggtggagctgcaggtgaagctgctgaagaaaaaactgaattcgacgtaattcttaagtctgcaggtgcttctaaattagctatcgttaaattagtaaaagatttaactggtgctggtcttaaagaagctaaagatatcgtagacggtgctccagctccaatcaaaactggtgtatctaaagacgaagctgaagctcttaagaagcaattagaagaagctggtgctgaagtagaattgaaataatttcaattttattataaatatagaagcccgggcgtattgcccgggcttttttgttgtaaattattgtaatctgtattttaatttataattgtatttgattattgttaactcctgttttgttatattttattatgattgattatttagttaaaaatagtgatttattttgtcttttatttatctattgtttgttttatgtaaatttttattaataaaatatatttttgattgaaaaaatattatatttgtaaaggaaaaacacacataattggatagaaattattttctttcttatagtcataagatagtacttctgttgctgctggtggctgtgggaaaactaaatgttaaacttatatctgtaactgatggtaaagatgttttactttattgtgcagatatatatactcaacgatgcataactgatgtttcagttcatcatggggtggatggctcagttttacataaatctgctgatcataattcagtcaattcattgtgttctggctcacagcatcatctttctctttctaatcatctttttaccgagattttacttgttaaaaatataaagactattgccaatcataatgatctgatatttttgcatcttttcggcagacgaaatatttttttcaactttaaggagttgggaaactttcatattaattcagccaggctcattgatgggtttaaatttgttattaaaattcccgataagctgattcatacaattaaccattaattctgaacaatttacggtgtgttcattgtgaaatattcgttatttcatttattgtcagatgaaatcggctataatttcatttttaaaagcacatataaaaacatcatatatcattagaaatgaaagatcaattattaaaactagttctttccagttgatttgttaattaacgcacagatagggattaattcatccttaccaaaagttcttttgatcacttttcaatagaagtaaaatttgcaggagtgatttgcttctaggattacaggagtagaatataatctaaaagccaataggtaagggtagtatggtttagctaaaacagatagattaaatcaaaataaaatcttataaggttattgtgaaataatcataagattagcttgtgttgtggaggggttgctcatcgttggcagcctctcttattttaaaagcctcaaaatgagatgatttatttgttattgtggataactttttgtatctttgcccctcttttggcgcgaaaaattgtttgtaaatttataaaatactgaaaatcagctctttcattgtgtaaagcatggaagggatttcttgtatataaatacagcagaattactgcctcaaaagtaagaaaaatattttgcattacgctgtgaaaagatataccagtgttgcagttagaaagagccaggtacaaaggagaaagagcataaggtctttcgtgagcgccaaaaacacttctacctttacttttgccttgtttctcgttcttttctgatattttttaatgaatcaaaatattttttaaccctttcttaaaagttttatgagtaaaacaaaatcaacaactcaaggaaatccgagaattaatttctcatcagcgaaaggaaaaatcatcactcctgactttttggatatccaaatcgagtctttcagagagtttttccagcttgatacacttcctgaagccagaaagacagaagctctttacaagactttccaagagaatttcccaattacggattcaagaaaccagttcgtattagaattcttagactatctggtagattctccacgttattcaattgatgagtgtgtggaaagaggacttacttattcagttcctctaaaagctagacttaaattgtattgtactgacccggaacacgaagatttccagactgtggttcaggatgtatatttaggtccggttccttatatgacgccaagtggttctttcatcatcaatggtgcagagagagttatcgttacgcagcttcaccgttcacctggtgtattcttcggacagacttaccacgcaaacggaaccaaactttactattcaagaattatccctttcaaaggatcttggatggaatttacaacagatatcaacagcgtaatgtacgcgtatatcgaccgtaagaaaaaattaccattaacaactttattaagagcgatcgggtatgagtctgataaggatatccttcagatcttcgaccttgctgaagaagtgaaagtttctaaagctgcccttaaaaaagtggaagggagaacattggctgcgagagtattgaacacatggttcgaagacttcgtagacgaagatacaggggaagtagtttctatcgaaagaaacgaaatcatcctggatagagaaaccatcttggaaaaagaacacttagatcttatccttgatgctggagtgaaatcaattcttattcacaaagaaaacagcaacgaattctctatcatccagaatacattacaaaaagaccctaccaactctgaaaaagaagcggtagagtacatttatcgtcagttaagaaacgcagatccgccagatgaggaaactgcaagaggaatcattgaaaaattattcttctctgagcagagatactctttaggtgaagtgggacgttacagattgaacaaaaagttaggtcttaacattcctactacaactgaggttcttacaaaagaagatattattgctatcgtaagacaccttatcgaacttgttaactctaaagctgaggttgatgatattgaccacttgtcaaacagaagaattaaaactgttggtgagcaattagcaggacagtttggtgtaggtctttcaagaattgcaagaacaatcaaggagagaatgaacgttagagataacgaaatctttactccacttgaccttgtaaatgctaaaacattaacatctgtaatcaactcattctttggtaccaaccagctatctcagttcatggaccaaaccaaccctctgtcagagatcactcacaagagaagattatctgcactgggacctggtggtttatcaagagaaagagcaggtttcgaggttcgtgacgttcaccatactcactatggaagaatctgtccgattgaaactccggaaggaccaaacatcggtttgatttcatctttaggaatttatgcgaaaatcaacaacctaggtttcatcgaaactccatatagaaaagtggaaggtggtaaggttgatcttaacgctgatcctatttacttaaatgcagaagacgaagaagctaaggtaattgctcaggcaaacgttgaattgagcgataacggtgatttcgaaacagacagaattattgcaagattggatggtgattatccggtagtagaacctaatcaggtagaccttatcgacgtagcaccaaaccagatttccggtatttccgcttcattgattccattcctggagcatgatgatgcgaaccgtgcattgatgggatccaacatgatgcgtcaggccgttcctctattgaagccacaggctccgattgttggtacagggcttgagcaacaagttgcaagagattcaagaattttaattaacgctgaaggtacaggtacagtacagtacgtagatgctgacaaaatcgtaattaagtacgaaagaagcgaagacgaagatttagtacaattcgaatctgctactaaaacatacaaccttaccaagttcagaaaaaccaaccagagtacaaccattaccctaagaccaaacgtaagagtaggtgatgtagtggaaaaaggacaggtgctttgcgacggttatgctactgaaaaaggagaattggctcttggtagaaacttagtagtagcgttcatgccttggaaagggtacaacttcgaggatgcgatcgtaatcaacgaaaaagttgtgcgtgaagactggtttacttcaatccacgtagatgaatattctcttgaagttcgtgataccaaattaggtatggaagagcttacagcagatattccaaatgtatctgaagaagctaccaaagatcttgacgagaacggtatgatcagaatcggtgctgaagtgaagcctggagatattatgattggtaaaatcactccaaaaggtgaatcagacccgactcctgaagaaaaacttcttagagcaatctttggtgataaagctggcgatgtgaaggatgcttcattgaaagctgactcttcattaagaggagttgttatcaacaagaaattgttctccagaaatattaaagacaaaaagaaaagaactgaagaaaaacttaaacttgaagaaattgaaaacacttacaaggctaagtttgacgagttgagaaatactttaattgagaaattaaatacactggtaagcggtaaaacttctcagggggtacacaatgaccttgacgaagagatcatcggcaaaggtgtgaaattcactcacaagttattaacttcagttgaagattatgtaaacgttagcggttcagactggacagtagacgctgacaagaatgaattgatcaaacaattgattcacaactacaaaatcaaatataacgacatccagggagttaaaaaccgtgagaaatttgctatttcaatcggagacgagcttccggcaggtatcatgaagctggctaaagtttacatcgctaagaaacgtaaactgaatgtaggggataagatggcaggacgtcacggtaacaaaggtatcgtatcaagaatcgttcgtgaagaagatatgccattccttgaagacggaacaccggtagatatcgtattgaatccacttggggtaccttcacgtatgaacatcggacagatttatgaaacagttcttggatgggctggtcagaaactgggaatgaagttcgctacaccaatctttgacggggcaactcttgatcagattactgaatatacagacaaggcaggtcttcctaaattcggtcacacttacctttatgatggtggtaccggagaaagatttactcaggctgcgactgtaggtgttatttacatgctgaaactaggacacatggttgatgacaaaatgcacgcacgttctattggtccttactcattgattactcagcagccgttaggaggtaaagctcagttcggaggtcagagattcggagagatggaggtttgggcacttgaagcattcggtgcatctaacatcctgagagaaatcctgactgtgaagtcggatgacgtgattggtagagcaaaaacttatgaagctatcgcgaaaggtgaatctatgcctgaaccaggtattccggaatcattcaacgtattacttcacgagttacaaggtcttggactagacgtaagattggaggagtaaattaaagatttaattactaaaaattaaagaattaataaactccgagatgataagagcgaaagtgtaaagctttcaatctttaatctttataatcaaaaataaaattatgtcaaataaaaataaatcaagtagatttaataaaataaccatcggtttagcttcaccggagtctattttacaagactcaagaggggaggttttaaaaccggaaactattaactacagaactcacaagcctgaaagagacgggctattctgtgagaaaatctttggtcctgtaaaggattacgaatgtgcttgtggtaaatacaagagaattcgttacaaagggatcgtttgtgaccgttgtggagtagaagttactgagaagaaagtaagaagagaaagaatcgggcacatcaaccttgtagttccaattgcacacatctggtatttccgttcattaccaaacaaaatcggataccttttaggaattccttctaagaaattagatatgatcatctactacgaaagatatgtagtgatccagcagggtattgctaaaaaattagacggttctgattttgaaaacatggaattccttacagaagaagagtacctggatatcatggaaactcttcctgtagaaaaccagtatcttgatgattctgatccaaacaaattcatcgccagaatgggtgctgaagctgtggaagatcttttaaaaagaatcgatcttgatgcattgtctttcgacttgagacacaaagctcacaacgaaggttcaaaacaaagaagaacagaagctcttaagagattgaacgttgtagaggcattaagaggtgccaatacaagaatgatcaacaggccggagtggatgatcatgcgtgtacttcctgttataccaccagaactaagaccattggttccattggatggaggacgtttcgctacttctgacttaaatgacctttatagaagagttattatcagaaataaccgtttgaagagactattggagatcaaagctcctgaagtaatcttgagaaacgagaagcgtatgcttcaggaatcagtagattcattattcgataacacaagaaaatcttctgcagtaaaatctgaatcaaacagaccattgaaatcactttctgattcattgaaaggtaagcaaggtcgtttccgtcagaacctactagggaaaagggttgactactctgcgcgttcggtaattgttgtaggtccaaacctacagcttcacgaatgtggtattcctaaagatatggcagctgaactttacaaaccgttcatcattagaaaactgattgaaagaggtattgtaaaaacagtaaaatctgcaaagagaattatcgacagaaaagaaccggtagtttatgatatccttgaaaacgtgatgaaaggtcacccggtactattgaacagggcacctactcttcacaggctgggtattcaggctttccaacctaagatgatcgaaggtaaggcaatccagctacacccgttagtaactacggccttcaacgccgatttcgatggtgaccagatggcggtacacttgccactaggaccagaagcgatccttgaagctcagttattgatgttaggttctcagaacattctgaaccctgcaaacggttctccaattacggtaccatctcaggacatggttcttggtctttatttcatgactaaagaattaagctctactgagacgatgaaagtaaaaggagaaggtcttgctttctattctcctgaagaagcggaaatcgcttacgcagaaggaaaagtttccttaaatgctaaggtaagatgtaaattacctgttaaggaaaacggagaaattgtaacaagactgatcgaaactactgtaggtagaatcttattcaaccagattgtacctaagcaggtaggatatatcaatgaacttcttactaagaaatcattgagaaatgtaatcggtaagatccttgctgatacagatttccctacaactgtgaagttccttgatgcaatgaaagacttaggttactcaaacgcattcaaaggaggtctatcgttctctcttggagatatcgtagtacctgtggagaaaaagcagatgattgcacaatcaattgaaactgtagacgaaatcagagctaactataacatgggtctgattaccgatacagaacgttataaccaggtaatcgacgtttggacaaacaccaacgccggattaactgaaatgatcatgagcagaatgaaaactgaccaaggtggtttcaactctgtatacatgatgcttgactctggagcgaggggttctaaagaacagatccgtcagttatcagggatgagaggtttgatggcaaaaccgcaaaaagccggttctaccggtgcggagatcatcgaaaacccgatccttgcgaactttaaggaaggtctttcgattctagagtactttatctctacccacggtgcccgtaaaggtcttgcggataccgctcttaagacagccgatgccggttacttaacgagaagattggtagacgttgcacaggacgttatcgttacagaagacgactgtggaacattaagaggtacagaagttactgcacttaagaaaaatgacgagatcgttgaaaaaatctctgaaagaatcttaggtagagtatctttacataatgtttacgatcctgaaacagatgaattaatcactgaggctgaccaggtaattactgagcaattagcgaagagaattgaggaggctggattagaagctgttgaggttcgttcaccattaacttgtgaggctaagaaaggtatctgtgcgaaatgttacggtagaaacttagcaacaggtaagatgatccacatgggtgaagcggtaggtgtaattgcagcacaatcaattggtgaaccaggtactcagcttacgttgagaactttccaccaggggggtactgcaggaaacgtatcagaaaacccatctatcgtggcaagaagagatggtatcgttgaaatggatgaagtaagaacaattacttctgaagatgaaaacggtaatactgctgaggttgtggtttcacgttcaacagaattcagattagttgctgataatgagtcaagaactccattaatggtagctaacgtaccttacggatcgatattatctgtaaaaccaggtgataaagtgaagaaaggagatacaatctgtagatgggatccgtataacgcggttatcattgctgaaacttcaggtaaggtagaatatgaggatatcatccagggtatttcattccagcttgaaattgacgaacagacaggatttgaagagaaagtaatttctgaatccagaaataagaaagccgtacctaccttgaaagtggtagactctaaaggagttgagcaaaaagcttacaacttaccggtaggagcccacttgatggttaacgatggtgagaaaattaaggctggtaaagtcttaatcaagatcccgagaaaatctgcaaaagcaggggatatcaccggaggtcttccgagagttaccgaattattcgaagcaagaaacccttcaaacccagcggttgttactgaaatcgacggggtagtttcttacggaaaaatcaagagaggtaaccgtgaacttattgttgaggctaaaacaggtgaaagaaagatttacctggtaaaactttccaaccagattcttgttcaggagaatgacttcgtaagagcaggatctccgctttctgacggttctatcacaccggaagatatcttaagaattaaaggtccaacagctgttcaggaatacttagtaaacgagattcaggaagtttaccgtctacaaggggtaaaaatcgacgacaagcacttcgaaattatcgtaagacagatgatgacgaaagtatctatcgtggatggaggtgatactcagttccttgaaggagctcttgagcacaagtatgatttcttggaagaaaacaacagagtatttggtcttaaagtcgtagtagatgctggtgattctaaagaattcaaaccaggtcagatgattactgcaagagaattaagagatgaaaactctaagttgaagcgtgaagatttagcattggtagaagtaagagaagctcttcctgctacagcaactcctgtactgcaaggtattacaagagctgcccttcagactaaatcattcatgtctgcagcatcgttccaggaaaccactaaagttcttaacgaggcagcagttgctggtaagatagacgatcttaacggtcttaaagaaaatgtaattgtaggtcacagaattcctgcaggtacaggtcttaaagagtatcagaacgttattgtaggttctaagaaggaattcgaagaccttaactaaaattaatgatttgaaatttgggatttgaaattatttttatattttcacaatctcaaatttcgaattttaaaaacataatttataacaatggacaacaatcaaaatccacaagacgggaacatcaacatcgaattaaatgaaatggtagctgctggtatctatgctaacctggctttagtaaaccactctccatctgaatttgtagtagactttattcagttgatgccaggtgttcagcaggcgaaagtaagatcaagagtaattcttgctccacttcacgctaaaagagtattaaacgctcttcagcagaacatcgctaactacgagcagcagttcggagaaatcaaagaggttgagcctttcgtattaggaggaaacaacgttcaagcgtaagatttcttttacaataaataaagaatgccctggttttttaccggggcatttttttattatctgttttgcatataattcactaatcagtttctttttttctccttttttatttttcgcaatattattttaaaaatatactaaaaaaatgtaaataatgtaatttaatatattaatgttaatttttgttataaattattgataattaatttaaattagttaataaattcgtttttcttgattaaatttgtgaaaaattgaatggaatgaaaatctaccctattgcagtagctttactctgcgtcaatgtatgcgcacaaaagcaaaatacacttaaagacaatcaaaaacacttgcagaagctgtatgctaaatatgacaaagaccttaaaaaggctcataaaattgcaaaagcggcaggaatacctcctaattcatacaatgaggaagactataaaagaacaatggatcctgtaacagggagaacaaactttgaaggactggcaaagataaacgaagatatcttaacaggtaagtatcagccttcacagcctatgtcttttatttctaacaatacctctgctacaggtaaaatagtaaatgaaccctggattgaaagaggtccgtatagtgtaggaggaagaacaagggcaatcatgtacgatccaaatgatcctacaggtaaacgggttttcgcaggaagtgtttccggaggactttgggtaaatcaggatccttctgtagctgctaatgaatggcagccattaagtacattctgggcaaatacttccgtttcaagtattacttacgatccaaacaacccacaagttttctatgtaggaacaggagaagctccaactgctgatgcagtaggatcgggaatatggaaatcaacggatgctggtgtaacatggacccagattttcaccattccggttacttattcttcatccggagtaagaaacggtaacttttatattaatgatatcaaagtaagaaataacaatggagtttctgaagtatatgcaggggtaagtggctcttatgtaggaatttcgtttaatgacggatggcagggattaagccaggccggattgtacaaatctacagatggaggagcaacatttacaaaaaacagcagtttattggctcttaacacaactactggtgtaaccagcacaacaggatattctattcagcagatagaaatcggagcagataactcagtatgggtttctaccagatcttccagattttcaaatatagattccggagggcgaatttttaaatccgctgacgggaatacatttaatcaggtatataatgtagggaacagtggctcgagagttaattttacactttccagaacagatgccaataaaatatatgcattcatgcagggagcatcctcttcagaacctatcagaattgcaaaatctacagatggaggaacaacctggctggcaactaatgatgctgcaccggttttagcattgcctactgctactgataccagtattcctgctaatgacttcacaagaggacagtctttctatgacctgatcattgcggcagatcctttggatgataatacactttatattgggggtatcgatttgtataaatctacgaatggaggaacaagctggacgcagatctccaagtggtccaataacaataatatggccgctttacaggtttcacaggtacatgctgatcagcacgaaattgtattcaatccttataataactatggaacagggcaaatgatgtttggaaatgacggaggaatctattatgctgccaataaagctaatatcggcgctgtaggtgggtttgcctccagaaataccagatataatgtcacccagttttactctgccatgctgaacccaacgaaaacacctgttgacgaagaattattggctggagcacaggataatggctcatggtggctgtatggagtaccacaggcaaattatttccttacctctcaatctgctacaggaggtgacggaatgtataccgagtatgacgatcaggataattatgaaatcgcaagttatgtttacaatagccattatttattgactaacaactcatattaccttatctctaccagtgctaacagaaacatggggcactttgtcaatgaaattgctttagacagaaccaatgatgttttctattcttaccgttccggactgacacttttcagaacaagcggactttctgcaacagcaacatcttttaccaataatgtggttacagtgggaactgcacaatcaaacgagcagatttcatggatgaaagtatctccgtatacaactgcttccacaacactttttgtaggaaccaatctgggaagaatttttaaagtaacaaatgccaataccacagcatatgctgcaactttgttaacctcaccggtaacaggaactgtttctgatatagaatttggcgccaacgaaaatgagattattgtaactttttccaattataaccttaccagtgttttctattctacagatggaggaacaacctggcagaacaaggaaggaaaccttcctgacatgccggtaagaaccgtactcagaaaccccgacaatccgaatgaagtgctggtaggaactgaaatgggagtttggggaacaactaatttcctggcaacaactccggaatgggcttcagtgacaggaaatataggaaatgtaagaattaccaacttagattacagacctgttaccaaaacagttttggtttctacctatggcagaggagcatggacaacccaaaatacagtacctgctttgtcaacagctgagaccaaatctaagaaagacatgaccattatatatccgaatccttcaaaaggaatttcccatttgagatttaataccgctaaatacagcagtgtggatataagcatcgtggatggctcgggaagattagtttacagtaagaaaaatgtgaagtctgatgaagagttcggacaaaaacttgtacctggaaattatattttaaaagccgagtctaaaggtgaaatcgtatatagcggtaacttcctggtattaggacgcacaggcggtgatgatgattagaaaatgaataatcaattgtatataatattattttggatgctggcttcctgcgggatgccggtatcctctttatctcaggataaaacagtatctgtgatttccgctgaaaaaaaagaatggataggaggaagagctggcgtaagaggagcggtatatactgttaaactgaagaagaaaaataacagtgtcatcactgtaaaaacttttagagcggaaggaaataccattccgtttgtacagaataatgcaggtagtataatagcaataatcggaaatcttccctacaaaaatgatgaagatataaagactgctgatcagatgccggctggatcacctgtagaaaattctgttcccaaaaaattaaatccaaaagacaattggatagagtatactgtaaaaggttcgcaggtattgcataaaataaattttgaaagatttatatccatagaaacatctgaagagcctgcaccttaaaattaatttcaatctttgaataaaaaattactttttatttttctctgttttccggtaatcatattattcagcaatgtgatgtattctgtagtttctcatgttaaaagagaactgtatgaaaagacacaatacagtattgcaaagaataatttcaggaaatccgaaaccatttgttttaccgaaaaagatcttactgaagcagaatggaaagaagaaaaagaatttacacttcatggattttcttatgatattatccggataagtaaagtgaatgggaaaaaatattttttctgttatattgataaaaaagatattatcatcaattctctattagacttttccaaaaaaattgcttttaaaaaaacatgcttaaagctgcagattaaccttcccggtaacaataaaagcatccttaagacaccgggcttttttgccgtttttgaaaaaaaggaattttgttttttttcagatcatttcttaaaaaccatttccaaacattataatcaacaggaaaatactcattatttatccattatttttccccctccggaaattcattgctgctacaatgaaatatgatattaatggtaataaatttaaataatgaaaaaatatataggcatagcagctttgttaggctgtactattgcacatgctcagcaaacacaggaaggatcaattgatgaggtcaatatccttggaagaaaaaaaattaagcaggaacgcgcagaattcaaaagacatgcacaatctgtagaaaccttgtctgaagaagatcttaaccgaaataatcccgcagcaattgaccagactttatccacaatgccaggacttcaggtagataaacgaacgaattttggagggcagaggctcgtcctgagaggatatgggaatgaccagaaatttaataactggggagttaaggcttactggaataatatgcccttaacaaacgccgaaggcatcactgttttggacgatgtggactttgcttacgtaaccaatgttgaagtgatcaaaggtccggctgcaaccatgtatggaggaggtgtaggtggagctgtgcgcttctatacacgtccggattttacaaaaggagcatcagtttcagaaaacgcaatgtttggtgctttcaaaacctttcagtcaagaacacagctgaatgttgccgatgataattattcagtaagtgctgcatacggacatcttgaaacagatggatacagacccaacggtggaggtttgaaaaactttttcaatgtcaatggtacggtcaaattgagcaaaaaagaccagttaagcttctttgcaagccaggcttattcctatgaacatacttcaggacagatttcatatgctgattattatgcagggattgataatggaaatgctgcttatatcagcaaaaatgccggcacaaaaataaaatccacaagagtaggattgagtaattccgtaagtcttacttcaaacctgagaaattataccactttattttattataacggaaatacagaaagtgtttcagcaggagcatatggagtgacaagttccccgaatgtagggctacgttctacttttaccctgaaaaatgaatttaaagactttgaaaaccgactggattttggagctgagatacagaattctgtttctacaacttccagctatcgcttcgatgggactaatccatcacagccattactgaccacaggaatgtccggagcttcttattttaagtataataataatcaatctacctattttgtgatcgattatcttacgtataagccctggggacttacattattggcaggaataagcggtaacagaaccaactatgacaggaaagacctttttgctttgccagggttggttgcaggccgtaaggaccagtctttcaacaagaaatatgacatggcctttacgcctcactttgcattacagaaagaatggaaacatcagatctttaatctaagctatagtgaaggctataattctcctacggcagcttcttcgtttataacagccaccaacaccgtaaatgatgacctgaaacctgagcgtgcaagaatgctggatttcagtgtacatgggcttttactcaatacaaaattagattaccgtatttcagcattcagaatagactattccgataagcttacacagctcacaattcctaatagtaagattccgggacaaacctattggacaaataccggaagtcagaaaaatacaggacttgagttcagcgtaggatatcagtacagaacagagaactcatttattgagagaattgttccctttgtaaatctttcttattatgacgcaaagtataaagattttacaaccatagtcggaggaatagaaaaaccttatgatcacaaatctgtggtgggtgttccaagaaataaatatgctgtaggattagatatttttaccaagccgggattttatcttgtgaatacctataactatctgggaaatgtttattctgattttaacaatgagaatctggtaaaaggttttgggttacttaattcaaaattaggatttaaaaagtcattcaataaactggatctggacctgtatgttatgggcaataatcttacgaaccagattaactatacctttttattcttggggagtaatatcaatgattcagataagggaagcaattatacagttcctacagaccttaacccggggcctggaaaagcttatttcttttatggattcaatgtaaaatacagattctaaattcaaaaacttactctatcaagttggttttgatgataaaataccctggtttttgccagggtatttttatacccttaaatatgaaaaataaaactgaatttgattaattgttaattttctttaataatttaaaaatatacagtaacgatatgtcatttttatatctttgtttatgaaaatgtagaaaatataagttatgattgataattcgtttgctgtaagcaagtttggctttcttggtgctgattttttatcagagctcgaaaagcatgctgttgttactgatataaaggccaaaaccgaaatcataagagaagggcaaaaaaataaatttgttccctttttaataaagggatctatcaaagtttttactcttaatgatggaagagaactcatctactattatattaaaccgaaagatagttgtctcatgaccttttcatctatcctgacggattatattagtagagtatatgcgattgccgaagaagattccagagcgattctcatccctgtttctgtaatgcatgaatggctgatcagatttccggagatcaacaaactgttttaccatgaatatgaccgccggttttccgaggtgatgaatatggtgaatgatgcagtttttcacaagttggataagagagtgctgaatcatatcaaacagcagattttgtccaccggaaacaaccctattaagattactcaccgtgaaattgccagcagtctgggaacttccagagaagtggtaagcagggttttgaaaaaaattgaaagcgaaggagaaattgttcagactaaagaaggtataaaagttcctgtaaatgaaaatgttaggatagtctaatttcaattgtttgaaaagtttatttctgttattgataaaaacaattcgactggtgacttttatcacctgattttgaattgggaactcaataagtttgttatatcataatttaatgcaaattgtatatgacaaaaactctcttatttttgtcggtactttcatcaggtcttgtctttgcacaggaagatctgctgaaagatattgacacggttaaaaccaatacagaaacttcacaacccgctttcaaagccctgcagattgtaacaggacaatctacaaaactggcagccaaaaaagaatggtatattgtggttgcccatagatttggagatataagtgcaggatttaaagactttttcggtctggatcatgcttcaaccaaactgggggtgatctacggtatttcagatgccgtttcagtaagcctgtccagagaaacaaacatgaaaacgtttgagggagctgttaaatacagactggtaaggcaaaatgaaaatttcccggtagatattgtgggatacaatgtattggctgccaatactgaactggataaagatacatatccacaccttaaattcagtgacaggcttgcctatcttacccaggcattgatttcaagaagattcaatgataagctttctttacagcttaccccttcctttattcataaaaacctttacgaacctactattgaaaacaaaaatcagtttttagcaggtttgggaggacgatataaagtttcaaaaagagtttctgtgaatgcagaatactttgtgagttttgacgatcacagtttttataaaaacccactatcacttggggtagatatagagaccggaggacatgtgttccagcttttacttacaaactcccagattaattctgatatcggatatcttaccaatgccaccggagcatggggaaagggacatattttctttgggtttaatctttatagagttttttaatatgaaaaagctaacatccttattgatattgtcgtcagcaatcatactgacggcttgtgacagcagaacttatgaagaaatttctgataatacccccatcacagtacctgtaaaatatacagcagatgtaaaacctgtagtggataacaactgcatcagctgccattctgccggaagctttaaaccactggttacctatgatcaggtaaaaaacaacatagacggaattctggaccgtatccaaaggccaaacggagatcccgggaaaatgcctcagggaggatctttatccgcagcccagatcaatattttcatcaaatggaaagctgacggactcaatgaaaattaaaaaaaattgatatgaaaaaattagcattattaagcgtattactgctttccgcgggttatgcttcagcacagaaatacagttctaagacaggaaaagtgacttttgaagcttcggttcctttgtttgatgacatttttgcccaggatgataataatattgtgatcctcaatgcagataatggtgaaatggcatcagtctcaaccgttaaaaactttcattttaaaaccaaattaatggaagagcatttcaatgaaagctatgcagaatctgcaaaatatccgaaaacaactttcaaaggaaaaattatcaactttgataagacaaagcttacggctagtcctcagaaatatactgttcagggaactttaaactttcatggggtagacaaagctgttgcttctgctgccacattatactcaaaggacgggaagatctatatgcagggcagttttatagcaaagcctgcagactataaagtgactattcctaaaatggttaccaaaaaagttgctgagaatgttaacatcgaatacaactatgtaatggtaaaacaatgagaaatataatcttagtgttaggactctttctggggatatgcctatcggcccaggaaaaagcaaaatcaatctttgatattgccagaagcggaaccgttgcagaagtgcaggaactgatgaaacaaaatccggatattataaatcaggtgaatgaaaatggtttctcaccacttattctggcctgttacagaggaaatgtcagcgttgcagattttctgattgacaatgtaaaagatgtcaattataaaagtcgtgaaggtactgcattggccggccttgccattagatacaataaagatctggtggaacatctgcttaagaaaaaagcagaccccaatattgcagacgctaccggatatacccctttattctgggctgtaaaatcaggaaataaagagctgatagagcagctgttgaaatataaagcagataaaacaaagaaagattcaatgggaatgacaccttttgaatatgcattacaaaccaacaacaaagaaataattaatctcttaaaaaattgatatgaaaaaaactctactagcgcttagcgtacttcttgccaattttgcattggcgcagttttcgtcaggaacggtaaacttaccggcaacttccatgacggtgaaattagatacgactcctaccggagcaacgattacagtaacaggtgacagcaactctatgttaggaatcggctttggaactgtgggaatggctccgggatcagacgggtttatttacaactcatctgctaacagagattatacatttatcggaatgacaactcctaccgctgatgcagttcaggactggattgaaacttccaacactgtttcaggatctacaagaactgtagtggcaacaagaagtctttccggaggagcaggcgattttgccattgccaatgctgcaggaacaattaatatcttctattcccgtaaaagtggaggtacttctttaggatatcacgatgcaggacgaggatatgcaacattaacaatgactgcagcttctttgtcgaccaatgaaattgctgctaacaacaaaaaggtaaatctttacccaaatcctgctaaagcaacagtaagtttcaaaaactttgataaaatcaagactgttgatatctatgaagcaacgggaagaaaggtgaaatcagtaaagcctgaaggcgaaagcatcagtgttgcagatttacaatcaggaagttattatgttgaaatcctgctgaaagatggaaccatatcttacgaaaaactgattaaagaataatttttcagaaaaaacacacctaaatattttttaaacaaggtacctctgatctgtcaggggtaccattttttttcttaaagtcccgatgtcagggcgattgcgttaaaattcgtatatttgtgtatatccggattcttaacaaaaaggcaatttttagctttataacttttacgcacaatggaatttaaaaccttagccaatatcacaacagatgagcttttatcagtattcaattattcattttcagattacgttgttccttttcatttaacgaaagaggtacttatttcaaaaattgctgcagaaaaattagatatgagtttatctgcaggggcatttgaagatggcaaactcgttggctttatccttcagtctgaaaaagttgaaaatggtgaaaagattatttacaatggcggaacgggagttattccggaaagcagaggtaagggattggtgagaaaaatgtatgattttattattcctgttttaaaagaaagaaatgccaatacattattgctggaggttattgaaggaaatcagcctgctatcagagcctatgaaaacctgggtttttcggttgtgcgaagattactttgttttaatggaagtatccagcagggaaaagaaaatgctgaggtttctattaaggatttgaaagactttcaatgggagttgttacgctctttctgggatatcgaaccttcatggcagggatctgttttcgtgctggacccgatgccggaaagctatattaccttgggcgcttatgatggagatcagctcgttggatatattgtttatggggcggcagctaaaaaaatataccagtttgcagtagataaaaattacagaaaccgtggaattggcacaaagctttttaatgccataagagaaaaaaatggcggacaaaccatagccttgaataatgtggatgattcctcggaaagtaccagcaaattccttagtgaaaaattaggacttaacaactggctttcacagtttgaaatgaaaagaactatttgatgatctttaattttgatttaaaaaaataagcgttttaatatacttttaatcatttaaactttccaagcagaaatatagaatgtaactttgcggaaaatttaaaacaatgaagcgaggaatccattttttactgttgctgatctcttttacgacatttgcacagcaggtaaatattgatacagctcaggttgtcatcccaggaagacaaaacagtaccgaagcacagtcaaagccttatgtgattatgatatctactgacgggttccgttatgactatgcccggaagtataatgcagaaaaccttttgaagttcgccaatgacggcgtaaaggctgaagcaatgattccaagctatccaagcattacatttcccaaccactggagcttaattaccggactttatccatctcatcatggtctgatcgataattttttctacgattacaagagaaaagaaggatatgcaatgagcaataagaaaaatgctgaggatggaagctggtatggagggactccgctttggggacttgccgaaaaacagggaatggtatcagcctctttaatgtgggtaggttctgccagtgatgcaggaggaatgaggcctacttattattatccgtatcatgagaaattcacgccttctgaaaaagttgaaaaagtggtaaactggctgaaattaccggaagataaaagacctcattttatttcattgtattttcctgaagtggatgggagcggacatcattacggtcctgatgctaaagaaactgaaaatgcagtacatctgatagatcaggctgttggcgatcttgttcagaaagtaaacggccttggcttaaaagatgtcaattttgttttcgtttcagatcatgggatgatcaaagtagacgggggcacacctcttgaaattccggctgttctttttgataaaaacagattcgatttttataattctcagactttgctaagagtttatgttaaaaatcccgatgaggtaaaaaaggtgtataaagaactgaaagccggtaaaacagatgattacgaagtatatcttgataaaaaacttccaagatatctgcattttgcagccagagatgatcaatacaacagaatcggacagattttactgatcccgaaagcccctaagatttttctggaaaaaggcaagaaaacttcggttggaaaacatggttacaatcctaaaactgttccggaaatgaaagccacattctttgcatggggaccggaatttaaaaataacctgactatcggagagtttgccaatatcaatgtctatcctttggtggcagaaattttaggactgaaaattgatcagcctatcgatggcaagcttaaagttttaaaagaaacactgaacgagaaaaaataatcttgaggattaaaacataataataaacgagtttcggcgcaccaaaggtgcgccgaaactcgttttaatttatcttgaaacaagacaagaaattaaaatctggaagaaaactccttcgcaaaatcctctaacttaatctttcctgtcacaggagaaccgtgatcaataaaatctttttgcacaacccctgttctgattcctctacccatttcaacatacaacttagccatatcttcgggtaatccggcctgaagcattccgtttaaagactcttcatcagagaattctacccatggaagctcaggtttatcaactgaagttcccagaacctttgcaaaatccgaggctgttcttacatcactcacaatataacggatattgttggtatttcctccttttaccagttcttcagcagctgctttggcaatatcattgggatgtacaataggtatttcaacacttgcaggataatttgctccaatgattcctgcattctgaattaatggaatatcgttgaaaaaattattgtaaaaatatccagcccttaaaaaagtaaaagaggtattttctacttcattatacaatttctcaatattatgaagacctgcgatagggccattttctacgggagattctgctcctacgctgcttaacattactgctctttttacatgggcttttttcaaagcttccgcataattttttcctgcattggttgtgttttcaacaatcttatccggactgattgctggaggagtcataacaaaaacagcatcagctccttcaaatgtctgagttaaaaagttaacgtttgtgatagatcctatggccggggttgctcccaaagattcaatatcctgttttctggcctcattgctgcttataacagtaacagtatgcccttcggcaattaattgttgggctaatggtttagctacatttcctaatgatcctgtgattacgattttcatatgtaaatatttttttatttctgggaacaaagttatatttgtacttacttttatacaagtacttaccctaaagtatgtagatatgacagctatcaaagagagttcaaccattcaggagaataaaaagacagtacaggattgtccggtaatgtacgttatggaaagaatcggcggattctggaaaccgattatcctgttcaatctttccaccggggaaaaaagatacagcgaattgaaaaaagcaattcctgccgtcacagaaaaaatgcttattcagcacttgaagcagcttgaagcagatggattaattgtcagaacggcaaaacctgtcattcctccacatgttacttataaattaagtgaagccggtaatgagcttgctcccgttattgatgcgatggctgcctgggcttttcaggatatggaaaggaatgataataaatgtgctgaaggaaacagatatatcaccaatcaggatcagaatgcttttagccggaatctgaaaaaataaaaacaggcgcttacgatgaagcgcctgtttctgttaatattttatagaagaattataaagactgcatatcaataacgaagcggtattttacatcgcttttcagcattctttcataggcctggttgatatcctgcatcttaatcagttcaatatcagaaacaatattgtgttttccacagaaatccaacagttcctgagtttctgcaatacctccaatcaaagatcctgcaacagaacggcgttggaagatcatcggtcttgtacttacctgcgtttcctggaattcacctacgaatcctacaagaaccagagttccgttcagagaaagagtttgcatataaggattgatgtcgtgctcataaggtaccgtatcaatgataagatcaaatttaccctttacagcacccatctgtgaatcatcggtagaaattactacatgatctgctccaagctgtttcgcatcatccgtttttcccggagttcttgagaataaagtaacttccgctcccaatccttttgctaatttaatagccatgtgtcctaaaccgcctaatcctacaactgcaacttttgaacccgggccggcgttccagtgtcttaacggtgaccacgtggtaattccggcgcatagaagcggtgctactgctgccagatccagattttcaggaacacttaaaacaaaatgttcgtcaaccactactttttgggaatatcctccaaaagtatgacctccaaggtgtttatcttttccgttgtaagtccctgtaaatccattctggcaatattgttccaaatcgtgtttgcagctgtcgcaatgtccgcatgaatctaccatgcatcctactgccgcaagatctcctgctttaaattttgaaacctcgcttcctacttttgtaattcttcccacaatttcatgacccggaactacaggatacaaagacccgccccagtcgtttcttgcagtatgaagatcagagtggcataccccacagtatagaatttcaatttctacatctgttgcggtgacttctcttctttcaatattcatttctttcagatctgctgtggtagactctgctccataagcttttactgtaattgtactcatttttatatttagtttatttaggataaattatagtgtttttcatttgttatgatcttattgctttacaacctgttgtcaatctgccgttcggagtggaaatccataacgatacaaaagtcgaaacttttcaatgaactgtacttatacagattaccgaattacttaccaattttacagacactatttcagttataaaggaaagtggtaattttggatagaattaaaaatatacttcatggaaaatcaggaggttgaaatctataatagtgtctcggaatataataaaatggccaatcatgaaacccttcatccgttggtcagtattattgatttttcaaaatccgatcttatctgtcaacataaaaggaaattcggcttttataccgtttttctgaaagatgttatgtgcggagacatgctgtatggaaagcatagctacgactatcaggaagggacactggttttcattgctcccgggcaaacctatggaatctataacaaagataaatttgttcagcctgcgggctttgctttgatctttcatcctgatttaataaaaggaaccaacttagggaagaatatgaaagactattcctttttctcttatgatgtgcatgaagccttacatctctcagaaaaagaaagggaagtggtactggactgttttaaaaatattaagctggaactggaacaggctattgataaacacagtaaatctttaattgttaataatattgaactgttccttaattactgcatgcgtttttacgaccgtcagtttattaccagagatcatatcaaccagggagtgatcgggaaatttgaaaatctggttgatgattacttaaaatccgaggacccgaaaaatataggttttcccatggtcaattattttgcagaaaaactgaacctgtctgccaattatttcggtgacctgattaaaaaagaattaggtatttccgcccaggaatttatccacaataagcttattgatgtagcaaaagaacaaattctggatcaggaaaaaacaatcagtgaaatttcctatgatctagggtttaaatatccgcagcattttacaagactgtttaaaaccaaagttggtatttctccgagtgaatataaaaccctgaactagttttttaacacgaataacactaatcttttcacgaaagacacaataattattagtggatattagtgcgtttatttgtgacattcgtgtttagaatattttatcacaaataacactaatctctttaccaattgacacaataattattagtgaatatttatgtactcatttgtaatatttgtgtctaaataattaaatttaaggagaaaagttttactattctaaaaatgacactaaacccgaaagagaccgctgtttttgagacccgttttggaagaattacagcattaaaagaagaaggcgttttccagattaaaagcatccgttatgcccactctgaaagatttaaaaaaccggttgctgtagaagctactttatcttcaatcatcatttctcctgaaaaaactccggtttgcccgcaggctttaagtccgcttgttgaaaaaatgattggagcgactcctgttgaaagttttgaacccgatgaatctacccaatatctttccgtaacaagacctgaaatcgtttctgaaaacgaaaaactgcctgtcgtggtttggatccatggaggttcccatgaaataggttgtggcgatcttgccactgctgatcctgctgaatgggtgaaagaacagcatattattgttgttacggtttcatatcgtctgggacttttcggtttcctgggaggagatgaaaaaagacctgccaatctagggctgttagatatcattgaagctttgaagtggattaaaaaatatattgcagatttcggaggtgatgaaaataatattactcttttagggcaatcttccggaggagatgccatcgcccatttgatgatttcggagggcgttgaaaacctgtttcaacgtttgattatccagagcgctcctctgggcttacgtcataaaagacagaaaatgtctgcagaatttctgaaaaaaactgaagtattgaaagatgaaaccgatgttttaaaaatgatggatgaatataagatatttgttccttcagtaataaaatatggtttaaaagcagcaatgccttttggtacgcagtatggattcttccctttgtgtaaggaagaagagtcggtggagatgtggaaaaaaaatgctctgaaatatgatgttctgattggtctgaataatgatgaaactgcattttatctcaagacatcagaagctttaaataaatatttcggaaaagggttgggactaaagattatggataaaactgttgaaaagactacagaatttatctatggagctccggcaaagcaatttgcagaaaatctggcagatgccggtggaaatgtttacctgtttagaattcattcaaaactgaaagataatcatatcggggcaccgcattgtattgaccttcctttaatttttggcaacgaagccgcctggaaatcttctgaattgctgaaaaatattccctggagccgcattcatgagaacggaaaaaaactaagagcgctctgggcagaatttgcgcgcaccggaaaaatagctgatacctcagaaagaccggaaatcctggagctccgaaagatataaccgcacatcaacttaccaggacctctcaactttatccatattcaattaaagacttaaacattccctcctgtggagggtggcgaaaattcaaagaattttggacggggcggtacactgaagtatcaacactcgttttcaattttaatgtaaattttatatattgatttatgtttttggtataaaatgttcattcataattgcaatttttaatgtatatttaataactaaaccataaaaaataataattatgaaaacaaacaaagatttcaaagtaaaaaaaattaaccgtcaggagttgaagagcttaaaagccggagatatcaacagaggcagagtgtgctgtacttcaaacgaagacggacaatgctgtgaatgggctaaagatatctggtactgccagtatatctattgctaaatacagtctgataaaatataaggcatacataattatcatgtatgcctttttatgtatagaagtttattttattccgggatccagacgcttacatttcccgccggaacaggaaagttgccccagccattttcatcaatgatcactttgtctttacatcgtttcaataaatctttaaactttttcccggcgtaaagtgttccgacctccataggcttattataagcatctttattgcttaagactacggcacagcctgtatgatcatcgtctcctgtacgaacccatccgagacagttggcgtcctcaaaataatcatgctgatcaccataagcgtgatcttttcttgcctttaacagctcttcaataccgtctattttgggcatgaatatttcctgatcattaccttctctgtctttatccacataatgagctccatagagatcaggataaaacacacatggatagccatcttttctcaataaaataagtgcataagcaataggtttgaaccaaggctctacaggagcttcgagatcctgtaatggctgtgtatcatgattggctaccaaactcacagaatgcatggggtctgcctgagtaagagtttcatcgaaaatccgtcggagatcgtaagaactcccttctctggaagctgtatgaaaattattctgtaacgaactgtcgaaaagactcatgcagccttctgtcacttcaatgtatttctggagaagattaagatatcccggagcccagtattctccaacggcgaaaatatcttttcctgaattggagcgtaaaagcgtaagccattctttgtaaaaatcaaaagaaatatgttttaaagcatccagtctcaccccatcaaaatctgtctggtcaaaataccattttgcccaattgttgagttcttcccgtacaaaaggattccggtgttcgatgtcattatacatcaggtaatcataatttcctttttcatcatcaatcatttcttcccagtcgtttccatattcagattggattttaaagatatgagagtccataccttctgcgtaatccacaccactgaaacaggtaaaattccattcaaaatcagaatatttttttcctcttccgggaaaggtaaatttggtataagactctatttcgatgacatcagagattactttctctctgttttcttcgtctacttttactactttgaatttttccagttcgtcaccgcctgctttatgccccagaacaatatctacaatcacttgtatattgtgtttttttaaggctttaatagctttgatataatcgtttttggtgccgtattttgtaggaatagttcctttttgatcaaactctcccagatcatacaggtcataggcatcatatcctatcgaataaccgccgtttgtacctttataagctggaggaagccatgcagatgttattccaagttttgctaaatatccggcctgtttttcggcctctttccataactttccgtctccttcagaataccagtggaaaaactggatcatggttgggttcatacatttactgatttggtggatacaatttagtgaaaaaatatgacctagtcactttcaaattcttcaaacgggatttttagttgaacggaaacctgctttttttcttctgtgttaagatgagaaagagataatcctaataagcgtaccgccttatcgaaaggccgaagttcccatagtttttttccggtagtaaaatactgttcgggagaagaaaaatattcttcctttgtgatacttcttgtgaaaagagagaaatctttatactttatttttaatgttaaagtccttccgagaatattgtttttctgtaatctctggtgaagttcctgtgccagactttccagtttttcattaatctgctgttcatccagaagatcttcaaaaaatgttctttccaccgctacacttttctgaatccggtgaggttttacctcagaagtatgaataccgcgcaccacgttataataatgctggccggactttccaaaaattcttatcagatcttcaagagatttcttttttaaatcttttcctttataaattcctaaactaaacattttgttagctgtaacctttcccacaccataaaatttttctacaggtaattcttccaggaattcttccatcttatccgggtggattgttttctggccattgggtttattgatatcggaagctactttagccaggaatttattgaccgaaattcctgcagaggctgtcagtccggtctgctcaaaaattttctgacggatttctttggcgatgaggttggcagactccattccctttttattttcggtgacatcaagatacgcttcatccaatgataggggttctaccagatccgtatattcatagaaaatttcccggatctttttcgaaatttctttatatctggcaaagcggggaggaacaaaaataagctgcgggcatttttctttggcagtcttactgggcatggcagaacgaacaccatattttctggcctcatagcttgcggcagcaacaacaccacgatgctgtccacctacagcgatgggcttacctttcagtgtaggattatcatgctgctccacagaagcatagaatgcatccatgtccacatgaataattttacgaagaggcaaagaaaaatccatatacaaagatatggattcctttattgacggtaaatttttttgtaggagggaagtctgaagctgggagagggaagttaatgaggacaatatagaaattgatgacctgtttattgaaaattaataaaaaaaatcacaagctattcttagtgcatcaactacttccagcttccagcttcaatcttccagcatttactccttcagtctcatggtgagcagatgcggctcaaaacctgctttttcataagcttttacagcagattcattttgggcatatacatccagtcttacttcattcattcctctggatttcgaccatgaaataagttcatcggtaatcactttattgattccttttccacgatgttcaggtctgacgtacataaaacctaaatacgcatattctttaaactgatagtaatctttctctgcttttttaatcagggcatatcctgatgcaataatctcattattttcttctgcaacaattactgtcgcgtccggagactgtatcagatgttttaaatcataataatgaatttctccttcaataagcgtactattgaaaggtctttcagcagtcacaatgccctgttcaaattctaaaagagtttttaaatcctgttctgtagcttctcttgtgatcatggtgttatataaataaaatgttaaaactcattgaaagcagatcatttccaatgagtttttatgttttaaagttaatggcaactattttaaaagttgatcgatggtttgttgaatctccggatcttcaggtgatattgcgtaatattttgcaattgaagatttctgatcgatgaccatatatctcgggatccagttaagatctacataattattaaaatcatttttccagcctgtggaaaaccaataattttctttgtgtttcatatcaaatctttcaagacttttttcaaacccttcttttgaacggtctaatgacagaaatacaaaatcgatattcttgtttttttcttccagttccttagcttttggaagtgcgtttaaacagtctctgcaccatcctgcccagaaatcaataactaaaacttttcctttatgctgatcaagaatctgctgtatggtcacactttttccgtcttcatcttccaatttttgctgtaaggcttcttttgaaaatcctgttttaaggacagccgggactttttgtgaataacttatcccaaaaattcccatcataaaaattaatatcaactttttcatctcgtacaatttcatttgtacaaatctaaacaatggatggcaatctgagattgatttcttcggaattaggaaaaatttataatattgacggactctatgggtaggagagtggaaatctggaaacctccccttcaaaggaggagaatgttgcgtcttcagttgtactatagggttatttctactgatagtttttaatcaggccttttacgactgcaattacattgggcattgctttgttggcggcattcaatacttcttcatgggaaacggcgaaagcaatatccggtccgccaagatctgtgatcactgaaatacagaacacgtccatccccatatgtctggcaacaataacttcaggaacagtgctcattcctaccatatctccgccaattgctttgatcattccatattctgcaggagtttcaaaagtagggccttgcagtgccacatagactccctggtgtattttaatatgctgatcagtagcggcctgttccgctgtggcaatcatttttttgttgtaaggttcgctcatatccacaaaacgtggtccaagctcatcaatattttttccacgaagcgggtgctcaggcatcatattgatgtgatctttcagaataacgatatctgcaacgctgtagtctgggtttacgcctccgcaggcattcgaaagaataagattttgaattcccagcagatgaaaaactcttatcgggaaagtgaccgtttccattgaatgcccttcatagtaatggaaacgtccgctcatcatcagtactttttttccttccagctttccataaaccagtttcccggtgtggccggccactgtagtttgcggaaaatgaggaatgtctttgtactctaaaacgtggatcggttctacttcattttgtaatttccccagtccggatcctaaaacaactgcaaaatcaggagtttcctgaataatatttttgatgaaatctgcagtttctttaattttttctaacataatctaagatgatttgattgaattcttctttcttatcaatcaatacattgataggccagtagtaaacaatttctctaagatagtcaaaagttttcagacgtacgtaatctttctctgtggttaatatcagtttatattctcctaattttttatactccgcaagtatttttttaatatcatcatccgtaaaattatgatgatctcggaactttaaatgtttcacccttttcgagaattttgccagatgctccagaagcggtttcgggttggcaattccggtgatcagtaaaatatcgtaataattcaggttgttatccggaagcattttatcttttccgtatacattttcgtcgtaaccgatggaagaaaagaatactttttgtccatatgaaggttttattcttgagatataatacctttttgtttcctctgtcaactcatcaggacatttgctgaccataatgatgtcggctcttttgtatcctgaacgggattctctgaggtctccggctggaagaagataatccttgaaaaacggatcattaaagtcggtcatcaaaatattgaatcctgccttaatcgctctgtgctgcatggcatcatccaatacgagaacctccagatccatatcgctgatcacttttttggcacccggaacacgatcttcagaaactgcaatgacaaagcggtttttaaaacgctcaaaaagctgcattgcttcatcacctaccattttgtagttactttcgtaattggttacttcgtagcctttggtcagccttccgtagcctcgcgaaagcacaccggttctgtaatgtttggatagaaactgggcaagatacatcaccatcggggactttccgcttccgcccacagaaaggttcccgacattgattatcggagtcttgaatttagttgacttaaaaattcccagatcatacattgtgtttcggatacccgttaccaaatgataaccgagggaaaaaggataaaggtaccatcttttcatacgtttgcaaaaataggaattttcataagcattgatgtaatattctcaaagacttttcaacaaatatttcgttaaattaaagtatttttgtggagttattacaatactttgagatactttattgaattttcttacaacggaaagaattatttcggctatcagatacagccggatgctatttctgtacaggaagaactggaaaaggcgctttctacaattttgcgcgaagagattaaaactacgggtgcaggaagaacagatacgggagttcatgccaaaaagatatttgcccattttgatacggaaaaagagttggatgatcagcttccccgaaggctgaacagctttcttccgcctgatatttccattaaaaggatttttcctgtaaaagatgattttcatgcccgctttgatgcgacatacagaacctatgaatattatatctccctggaaaaaaatccattcacgcaggaatctgcctggcagcactggaaacgttctctggatgttgatgcaatgaatgaagcgtgcaaaattctttttgaatatgaagattttaccagttttgcaaaattaaaaactgacaacaaaaccaatatctgtaaaatttacaaagcagaatgggagcagaacggaactgaacttaaattcacagtttctgcgaatcgctttttaagaaatatggttcgtgctattgtcggaacaatggtagaaataggaaccggaaaactgaaacctgaagatctccgtaaagtaatcgaagataaaaaccgtaatgcagccggaacttcagcaccgggacacggactgtatctggtggatgtaggctatgaattttaaataaaacaaaaaaaacaaataatcatgttatcaatttttattcttatcggtgcttaccgatattacgcacaattagcagaaaggtttggaaaaacaaagtggaagtatggtgttctggctattggtatttatttaggaacccagcttttgttaggttttgcttacgggatgtatctgggtattacagatcctgaatccgcagaaaatgtaaattatacaggattttccgcagtgaatatcgttggctggttgatctctattgttgccgtttggggagtttataaattccttgaaaataaattgatcaaagaaagatctgtaaaaccaatagtcgaaattgaagaaatcgggaagacttctgaataagatctcatatactgaagtggatgcaaaagaatggttaatatattcattttgtaaatggctggtatctgaaactttctatgacgatttgcaaaagttgtaaaggcagtccgggtataatgtcttatttttgcatagaatttttattttaattctttctttcgattcgtacaatgaaaaaacaagatacctgggggattataaaaaggctgttctttatcggaatgaaatttcgttcttggttcatccttacccttatcatttctatatttctttcgatagtttctacttacaggccgtatcttaccatgcaggtggtggataatgatataacaaagcttcatgataaggctttgatgatgaaacatatctatatccttgtgggattggtgtttgctgagacaattttaaactttttcctggtttatttttcaaattttatctcacagaatgtgatcagggatatcagagagcgtttgtatgctaaactgatttatttcaagacttcattttttgataaaaccccgatcgggcagttggtaacccgtgcagtaggtgatgtggaaacaattgctactgtttatacagacggtttcctgatggtattcggagatatcctgagaattctgtttgtattggtgatgatgttcagtaccaatgttcacctgagttatattacactggctatcttacctttgatggtggtcattacgagattcttccagaaaagactgaagaaagctttcggggatgaaagaaactggacggccaatcagaattcttttgtgcaggaaagacttgccggaatgccgattatccaggtattcaacagacaggaagcagagtttaagaaatttgatgatatcaatattacccttaaaggggcattgctgagaaccgtatttattttctctcttttcttccccgtagtagaacttatttcatcattatttataggatttatccttttctatggtggttatattaccatcagtgccggagtggtcattgcattcattcagtatatttctatgctgattcgtcctttgagacagattgcagaccgtttcaataatatccagcggggaattgtaggtgcagaaagagtgctgggattaatggatgaagaaaattcaatgccgaataacggaacagtgaagaaagatcattttgccggaaaaattgaattcaggaaagtccactttgcttatgatgaaaaacaggaggtactgaaagggattgactttaaagtaaatccgggagaaacggtagctatcgttggagcaactggtgccggcaaatctactatcatcagtttaatcacaaggctgtatgacatcaattccgggaatattctgattgatgatgttgatttgaaagattatgagttgtataatctgagaagccatatcggagttgtactgcaggatgtattccttttccatggaagtatttttgaaaatcttgccttcggtgatgagagtataacactggataaaataaaagcaggagcgagagaaattgaagttgatcagtttatcgagcagctacccggcggatatgattatgtagtgagcgaaagaggttcatccatttctttagggcagagacagttgttatctttcctgagagcttatttatcagatccgaaaattttaattctggatgaagcaacctcttctattgatcatgaaagtgaaaagctgatccagagagcaacagaaaaaattaccaaaaacagaacttccattattattgcccacagactttccactattgaaaaggcagataagattattgtgatggagcatggtaaaatcgtagaagaaggtaaacatcttgagctcttggataagaacggatattatgctacactttacaaagcccagcttcgccatgaggtagaaatggaggaagaaaaagaatcataatccgtaaggaatgattccaagatcttttttccaggcatcaccatatttttctgttaacgtttttgcaacagccaggttgttttctttggcctgtttagatatttcatagcttatgatgcagttttggtaaaaaactcctgtatggtatttgtttttaaaatcttcgtggtttttagacatgataccgaactgaataaagtaaggaatgttttcttcttttgcacctgattttggatctttctgttgtgtaagcactgtaatttctgttttctgagcaaacagtaatcctgaaaatggtaatgccataagtaaaagcgctaatctgatttttttcatgagtattgatttgtaggtatgatagagaaataacccagaggttaaatcaacaaaaaagagaatcattctggattccctttttattaataaaattttgaaaacggaattggatttcaatcctgaattttcaaatgctttttaaaactgcagaatacaaaattctgaactgtttcaaaaggagtaatatgatcttctgtaatacattttatttttgtaaaaccagctccaaatttttcagttaatgactcttcatcatactgctgaatatccagtccgctgcatttggtgggaccatttttagaaaaagttccgataatcataaagttatttacattcttttctgcgatatcaatatattttgaaacctgctccggttttgtaaggaaatgaaaggctgctctgtcatgccagatgtcatacatttccgttggttcaaaagcagtaatatctgtagcaatccattttactttgttagcagcatctcccaatctttcctgcgccttttccaaagctttggcagaaatgtcaagaacagtaatgttttcatagccttcctcaagaagaaaatcaacaaggttgctgtcaccgccaccaatgtctatgatgctggcatcttttcccaatcccgaagatgtaataaagtcaagcgatgtctgaggttttttctgcgtccagcttacctggtcaggatttttggtttcatatacgttttcccagtggcttttgttgtcggaagatatcatgattcttttaattgattattgatctcttcaaatttattaattaattcgtcaagtttgccttgctgcttttttatggttcgtggtctcagataaaaccagttgaaagcaatccatgctgaggttacagcataggtcagaatggctgagccaagagtcattcttgatgtgtattcatacatataaaagcatattccgagaaacagcatgatgaaatagagattgagtatggtggtctgcataaacttctgcttattttttaccacatacaaactttggagatattcgttatttgattgagtctgatcaattttgtagaataccataaacattttgttgtaggcaagcaggaaaataaccattcccaaaactacaagtacaattccgatttttgtcgtgatcatttcaggctggtaacggtaccagatgaaaagaatcaataaggaagtggcaattaatccaatgttagcaaagaccagtctgcgcagattctgatttctgaattttttcagtttaccgagaagctcttccatattgggtttattggaagtctgctgcttccatatatttttaaagtcgatattagaatccattttctttaaacttttgcgttaatttttcttttattctgtgaatctttacccggatattggattctgaaagccctacgatatgggctatttcagcctgttttacctcttccagttccagtgaaatgatgatcctgtccgtttccggcagttccgaaatatactggtagagcatttgtatctgagactccatggattcctgctttttctcttccagatttaccggtaaatctgctttggcaaatttcttttccttttcaatctgccggagacagttattggaagcaattctgaaaatccatgttcctacgctggattcattcctgaatttgggaagctgctgccatacaatgataaaggtttcctgtgcaagatcctgtgcaagttcggtgtcattcacatatcccatgcataaacggaatatcctttgccagtagagttcgtatatctcttcaaaaaccattatttcgaagataaaaagttagtaagctggctaagataccaatccttgtcatcatacatgatgaaatgcaatccttttgaagcatactgcatattggcgttttttaaattcctgtactggctttcaattgttggcttaaggttaacaaaaaacgattccagaagaataagagaaggacattgtatattttttattttttctctgagatcggtattgagaaagtcgcagtacatttttgcgaatgtttttcggtctgacttcacactccatccgattacagtttcctgcatagaaggatctgcaaggagacgtgggattgcctgggcctgcatttttcggaactgctcgtcgttcatagcggttaattgagtaatggtagatgaacagtcattattttcttttgaactgaaattgggatcagacattgctgccaggcacggaagagcatcaacaataacgattttacctgcaagttcaggataatcggctgcgatagctaaggcaaggccgcctcccatactgtgtccgatgatgatgggtttattaattttattatttctgatataagctgcgattccattttcccaatctttaaaactggcttctgcttgtggttttgttccggcaaacccagccatcgttaaagtgtagcaagtgaagttgttttcaaattttgcagccgtttcactccatacgtctcctgaagaagcaaatcccggaataaagattaatgactggttaccttttccggttttctttacttcaaatggatatgctgtttgctgtccaaatatgttgcataccgctaaaaaaaataacatgatgataagaaggaatgtaaattttttcatgatttctaaagttttaaggtttatttgtcttttagagacgaatctttaaaaaatgttacacaaaaatttattttttttatgaaaaaaaatatttctccttctccgaaacccattcagggcaaaaccatatagaatttattttataaaaattaatagctcgtattattcaataataaaaattattaataatgaatcctgttaatctaatatccttccatagaatctgctgatgtcaaaataaaatcccggcactttatatttacctttttcaaactcctgataatcacattttcctttcaggctttgtgattgggtctccatctgaaacctgttgagcagtacatattcatcagttacagaaataacatgaaatcctgtttcacacgtcaatccatcaccggaagttagaatagcgtttaataagccgtgaaaattccctgcaattttttcagcagtggcgtcatcattgtttaagtgatacagataagcaagataattcattgcacgcagatccagcggattttcatccaaagcatccaaaaacagtttgattccttttgagagatctttttgtgaaataccttcaccacgataatatttggttacttcttctgctttcttgccgatcttatagggctgatattctttttgaaaggtatagccgaaatacagatgacgatattggctgcctgtaagaagcgtatcattctgttttaatctctttaaaagtttcggataatagaattccgagtttttatcttcgatatttttttgaatggcagcataatccggtgctttgaattccattttctgaccgtgcagaaaagtgagcagtgttaaaaagaataatgagaaaaatgctttaataatcatggtttgtataatgttgttgcaattttttataaagctaaaaatacgaaatatgtagtaatcgaatattattaactgacaatctgtaaaaaaaatgataaaatattgtaaaagtgttactttgtgttaataaatttactaactttattcggaatttgagaagttacccctaacatttgaaggggtaaatggaatttttaactaaaaaaccaaaaatattaatgagcagtagtatccaagatgaatttaaagtcttcaaagacgaattgagaaagttgaatattgaagtacagaaagtagtaaaagtaggaaacggcagtatggatttccatgaggttttctataaatctccaagatatcaggaggtaaaaagcatatatgtccagcgtcataatctggacagtatgattgaaaagtttaaacaggcctatcattaaaatagaaatagcgccgcagagaacctgcggcgctattttttataaagctctgagattttaatccttatccagggtagagatctttttagtatccttcattccgatataaacaatcagcgaaaagagaatacatccggtaatgtaccagtaaaaatattcttcagaaccaattttcttaaaccaaagcgcaatatattctgcagttcctccaaatacagctaccgtaatagcataaggaagacctacgccaagtgcccggatttcagaagggaaaagttcagcttttactactgcgttgatggaagtatagccgcttacaataattaatgcagccatgatcaggaaaaatgcactccatattgaagtggtattgctgagggctgtaagaagcggaaccgtacataaagttcccagtattccaaatcctaaaaggagcggtcttcttccgattttgtccgaaagtgctccaaatacaggttgaaggcaggcaaatataaataaggaaataaaagagaccagtgtagactcttccttagtaagatgcacggtattcactaaaaatttctgcatataagtggtgtaggtataaaatgccagtgttcctcctaatgtaagacctaccacagtaagtaaagctttggggtgtttcagtaactcctttaccgttccttttttcttctcactcatttcttttttattctcaaaagcttcggtttcatggagattagcccgaagatacaacgcaataatagaaagcatagccccgatcacaaaaggaattctccagccccattcttcaagctgggtctccgtcagcagcaatttctgcaaaataagctgaattcctaaggcaatcagctgaccgccaattaaagtgacatattgaaagctagaataaaatcctcttctgtcctgtgtagccatttcgctgaggtaagttgcggagactccgtattctccaccaacacttaagccctgaagcagtcttgcgagtaaaagtaataaaggagccagaatgcctatagatttgtaagttggagtaagcgctatcagtaatgatccaaaagacatcagcagaacggaaagcgtcatagctttttttcttccgattttatctgcaatactcccgaacatccaaccaccgattggcctcatgagaaaacctactgcaaatattccagcagtattcatcagttgtgcattaaggtcagaatccgggaaaaaggaatgagaaaaataaatggcaaaggcagcatacgcataccagtcgtaccattcgacaagatttccgatagatccgcctatgatagccttgattctttggccagtagtgattgaggtcgagttcatagtataattccagaaagttttaatgggattcaagatacaaatttcagaaaaaaataaaccgtactgataaagaacggtttagatattatacattgtatatttaaaatctgtatcctatcgaaagtccgcttctgaaacctgcccagggaccgtcaacttttattctggctccattggcattggtttctactgtatattttacaaacggaatatcaaggttttcgatttcctttttcagctgagcctgcatatcaggagtcaatacataatctgaggtcatggtaaaatccccttttccacttccgtaatgggctccggcaatccagaagtcaagcacaagattctgacttcttgtcaaaaagaattgcactccaaccatcagtccgccgctgtttcctttggtatctccctggcctttaatagggatctggtaggtaaccccacccggacccttataatcataataaaaatcaaaagtattggaagtgacactggagtagcggtaataaggtgcaaaataaaatcctttgccatagcctttaccgatataaaatcttggttcaatggtgaaattggttgcttttactttaagattctggaatcttttttcatcttcatctttcagaaaagcattaatgaaaggcacttttccttccggcatagttccaaaaccgatattcacagaaaaccactggttgatggccctttcataagacagattgatatttctgaatgcatacgccgtgacattggttttgatgatattcatcttttctgccgaactgttggggatttcctgtgcctccaatacggaaaacagaaagcacggaattaatataagtaactttttcatgattttatattttgcagtgtaacgaataatcagcaaaaaacgggctgaatttaacataataattagaatttaaatgaaaattatgaatatttttttaatgagttgttatcaatgtaataaacttaagagatgggttgtcttaatggtacaattcatcttcagaaatgaaaaaaactatatataccattttcttcctttgtggagctttcatattttctcaggagaagaaaagtgatacggctgatatggcggctaccaaagaaattcaggaagttattttaaaatctcagcggaaaaaacagtttgcggataaagcggtttatacctttgataaagaggctcttgaaaaagcccggtatgcaaaagatctgcttcgtacccttccggaattacaactggatccggtagcaaatacgattaccggtacaaaaggaggaacaacattatttcttatcaatggaattgaagctacggatatgcagatccggagtgtggcgcccagtgaagtagtaaaggtggagtattatgatataccgccggcaagatgggcaacacgagctgatactgtagtgaatattctgacaaggtctactgaaacaggatatgtttttggagctgatgtttccacagctttgaatactggttttgtgaatggatctgcctatgccaattatacaaaaggaaaaaataatttcgggttggaatattctctgaatctgagggattataatgacagaagggtaaacagtatctatgattatcagctgaacggtaaacattaccgttctgacgaaaacaggaaggatcatttcggctatactttccagaatatcgctttgcgttacaccagactggttcctgatgattatgctttccaggccaagcttaatatggatattttcagcaggttttcaaaagggacagggcagagtgtattcaatgaagatgccctgaaagaggaacatgcaatgtttaaaaacaatggctcagattatgtaattcccaagctggatctttactattcgaaaaagattggggaaaaagatgagctgagcattaacgtagtaggatctcattatactaccaatacttccgaaacagccagcgagtggatagtaggttcaggtctgtcagtgtatgataatgatatgatgctgaaagcaaagcagacgagcctggtaggggagctggcccatactcatgatttcaaagcaggaaagctttcgtccggatatcgtatttcaaggtcttccatttctaacgatctgaataaccttgccggatattcccaatacagtgttaattatctggagcagtatttttatactgaattttcgggaaaagttgatcaattcagctatcgtattggtgcaggtcttacgaatattcacaataaaagtgcagagaatacttttgatgaatggacttttactccaaaggttattttagcgtaccagattaaaagcaatcagaatcttcgctttacatccagttacagtccggtgagcccgtggagtaatgctttgagcagtaatgtagtacaattggcacccaatgttgttcagagaggaaatcctttcttagaatctcaacaggtattttccaataacctgacctattcttttaacaataaatattttgattttaatgcgggattattttaccgttataccaacaggataatcaatcagtattatattcaggatgatgtgttgggaggctatgcacttacttatgagaatggtaaaaacggacagcggtatggtgtacagcttacaggatcttataagcccttcggaaacagtctgcttgtagtaaaagctgtgatcacgcctacttctgaaactgtgagaacaagtaccggtgctttaattaaaaatgattatttaggaaattattttgtagtttcttcggagtataaatctttttctgttcaatatcaggttaatattccggtgtacagccttagcggtgcgttcctgaatacgaacgaaaaccagaataatatttttgtcagttacaaacatagaaactggacattttccacagggatgtactggataggaatgccttcggaatacaaaacgaaaagtctaccggaaagtctggtagattacagagttcatactcagatcatgaataataaatccatgtttgtattagggctgagttacgatttctccaaaggaaaaaagaccgagatccagcgaaagcttaataatgaaacagctcctgcagcaactttttagatgctcatttgaatgttaataagaaatccccgctcacttgtaggagcggggattttgcttttttatttcttgatgaattttatattcttggtgtctgcagtattttttccactgatctcaatgaagtaagacgctggcggaaggtctgagatctgtacgtttccggattttatatctgacgttttaaccaactttccgtccagactgtaaatatttgctttggaataattatccgtatttcctttaaaaccaataaagtcctgtgcagggttaggataaacagtcagattttcttttttcacggcattgctggttgacagaaatgtttcattcaaagctaatgcagtggctactgtctggttaatgctcaacaatggaatactgatatttccacttgtggaacttagcagcgcatatctgtgagaagcatcataatacgcataagcagtattggtaagtgttcctatagagttagaataagtaacatcaaaagacgaatacagattaaaattctgtgtatattttactctaagtacgttgctgtatgtttgatttcctataatcagagttccatacgcgtcagcaacggcagtcattgtgccgctgaacaatccgttggcggaagatgaagagaaagttcctttggctgtgtcgttttgtgcaggtccataagttagtggatagcttatataagtaccgttgtccacactaaagtttagggtggcctgagggtttacaattcccgtgatttccagtttggtagaagaagctttgtaataaactgtagttgctccatctgtcattttaatagtagaacctggaaaagttgttatctcagtagaattaggaactgaataggtcgtttgtgacgagactcccattgtaagacctgggtttgagaatgtaacgttggctcctgttgcagaattgtttacggttccggttacatggttgtaattaacaacattcccggcaatagggtcattagctgcttttgtaagcgtgatctgcgcagagaacatggcagatgctcctaataaaaggagtaaagattttttcatagtcagaaatttttgttaaaaataattaaaaaatagtattcaaatgttaatttattttgtttttaattgaatatttgaaaaaaccgcctgctgatcgtatcaacaggcggctctgtgcgctaaaaatgtttaagtctaattgctcgttatcattttgcggtaagcataaatatcttcgatggtcaccacgctcatcccttttctgttggcaaagtccacaatttcaggaagtctggccatagagccgtcttcgtttgtcagttcacaaagtacggcatcgtcacccagattagccatttttacaagatctacactgccttcggtatgaccgcgtctttcaaatacaccaccttttctggcgatcagaggaaaaacgtggccaggacttgcaatatgctctgcctgtgcatctgatgctacagctgttctgattgttgtgacacggtctttggctgaaacaccggactctacgccttctctggcttcaatggaaattgtgaatgcggtctggttttttgagttgttgttttccaccatcggacgaaggttgagatggcggcttttttcctcagaaatacataagcagacgataccgctgcattcgcggatcagaagcgccatgtcctgttctgtaattgtggaagcgggaaagatgatatcaccttcattttcgcggttttcatcatctactaaaagaataccttttccctgctgtaacgttgtaagtgctttttcaacacgttctctggagtttgctccgaattgttccaataatttttccatgttattttacttttaaaagttaaaatagtcttcggtacatggaaatgaaatacaatacaataagaatccatagggaatcttactgatcatctcattttcttctcccatccagactttaactgtcggttccggaatttcaccagatcagtcccttcaaaagaagggagtcgcggactgtaaccgccggtagggaatttcaccctgccccgaagaaaacttatactaagttttgctgtatgttgtaatttaaatttttatttcattgaatagtatttaacgcacagaccgctaatttcgggaagttttttgaattggaaaagagattttcaggttttataaggtggataaagagcgcttttaagattattcagaatttatcttcaggcatttcttaatatcttctccattttctttccttttgccagctcatcaatcaatttatccagatatcgtatatttctcatcagttcatcttcaatttcctccacacgatatccgcaaatgacacctttgatcagtgaaacattcggattgatctggggagctttttcgaaaaatgttttcagatctgttttcagatctaatatttcctgaagctctttttcattatatccggttagccagaatataatctcatgaacttctgattttgtacgtccttttctttccgctttttgaatgtaatgtggataaacacttgcaaaaggcattgcgaaaattcgggtattctgcatattgattgtttattggtttcttagtctaatctttttatgacctgatcaagtatcctgttaaactcttccggcttttccagcataggataatgcccaacgccttcaatggttacataatcatagtttttcagatatttccggttgttttccaaatgcgtgggagaagcatctgaattaatagctataacgggtacctgaatctgttttgcaattgttttgaagtctgttttatataaaggccacagagcattgattgccaattcaggttcgttttgaaggaattcgcgctgtactctttcttttacatctggtggagttccttctgcaaataaaaattgtggcagaagttttctacggcgtacttgaagtcttttctgtattgagagagtacttcttcagcttgctgctcagtaaatgattcgtccaggttttttaatgtatctatcagaattatagcttttacagccggaattttcaaagaagcttccaaaacataggctccggacattgaatgtcccacaagaattatttcccgggcatgaacagcatcagcgactgctttaatatcatcggcatatcgggcgcttgtccattcttttctggatgaatcagattttccgtgtccggcaagatccatcaaaacaatgtgatattggttttttaaatattccttctgaccttcccaccacccggtgttgccgagccatccatggatgaaaattaaagttgtatttccgttgcctgattctttataatgaattttctgtccatctgatgagattgcatgtttttccatttcaatgagtaattggtgtattttatttttagcccaatttacaaaaaggctattagaaattcaatggtttaggtgctaaaagcagccctgtatttaatacagggctgcgaaatttattttttatcagttgatctcaggttgactataataatggcatatgatgttcccagcagatcttttatttcacatttgaaaaaaataagattttttaaaaactgctggtgagaaatttcaattctgtattctattcctgtcggcatggccttgcttgcaaaaccttccagattgtctatttcatacatgccggtatttcccatgaaattaaggatttcccttaacgtacaattcatgataaaaacagaaggtacaatggggtagttttcaaaatgacctttacattgattaggtgtaaaagggttgagtaaaacgttaaatttatgttcattttctattgtaatcctgccttcgggaagattttcatcgtaatattccacaggagcatcattgaaatagtctttgtaaaaaagtttgaacgtatcttttgcaatgatatgataatcaagctcgaaagagtagagtggttccccggagtgattatctctcatcaggagtgaagacttaccttttcttttggattccaggaagctttcacagatgatggaagaggaatcggattttttataggaaagttgccttatcctcaccttttcacccataaaataaatcgggtcggtggaggaggtgtttaaaattctgtaaaggttacaacttcctaatgaagataatatctttatcaattttgaaaaattttcattgctgaaatcgtaatctgaaatttcagcttccatcctgctgccattataaataatattttcgggaatggaaatgtacggtacagtttccccgagataagggatgatgttttctttgatgtctgttgttgtcatttgaatgagggattattaagttattcaatctgttttcatttgtggataactttttcatcatcgtgttgtagtttttttgtgcagatgggtatataatggttatttggattttatttaatcgggaataataaataagaatcgttatcacatctgtagtttgtttttgtaaatatattcttaattacttggatataattgttttgtggtatttatttctttctatggtgatttgtttttgttgcaatttataaaaaaatattcataatgaattatgaataaatgttcattattcaaattgggaagatggatattatgaaggtgtaactgtggataacttattcacataacttatccacagtcttttctatagtgaaaatcccgcaaaaaatatttttgttcttaatttgttgaattatagaatgttattgaattgatttcaatgattaaaaaacttatccatagtttatccacaacggtagattggtatataaacagttatccacaaatattaaaatatgtggataactgtttatttacggtgtaagcggttttaaatcaattttttatacatttactacagaacgcttgaaaattacttttagacttatccacaaagggcatttttactatttgtctttataaatattccagaagttaaaatcggtcataggagcatcagtaattccgatgtttcttcccattgttacaatctgtcccctgtgataggtgccatgaagaatagcatgctggatatattcatacttggaaaagtcacattgaaaccattgggattctatctttacatttttagaaagatcatcttcagacaagctttccacataatctaccagtttttgtgaattgttttttatggcattgaaaatgtcctctttgctggtaacttctgttgttttagtaaaatcaaaatcattattttcggaaatgtggccccaccagtattcctgagtttgccagatatgatgcagggtttttaagattgtaggaaagctggaaatagtttcctgattcagctgtttataggactttgtggataaccagtcaatatatttgttgactacccagttattgtactgtacacttttgctgactaatgcttttaggctcataatattatatttattggatttgagaaatgatgctataatccgaaatgccggtcgttatctgtattctccggattgatgagcgctttgttgctgtaggtcgctgcttcaaaatcacggatgtttacagaaagaaaagaaatatccggcagcaattctgaaagcctggtactgatctgttttgaaagaccggctttttgatctgttgtacggccctgcatgatataaccgaatacgtgtaaaaagtctttcttatctgtacctaatctgtaatactgataaggctgaagccttactttgatatcgttgggagcaaatagtcctgttgcgtctgctgtttcgtaaacagcatccattaattcatcgggagttctctgccggagaatatcctgcgaacattctataataaaatgaggcataaatatattttgtggtttgattttgtacgagataaaagtagtaaaagatgttaatagattttcaaaataaaaaccgttctgaaagcaaaacggtttgaaaatgtgtattttttacttgaaaataataattttataggtttgatttcctaatagtgtattttggctgtacaatgtcggtcatgtcaagaacaatatcataagctccatcttcactgataggaaagtcataggcatcaagatcaatagatttaccatcgttattaagtccgaaattgtatgcccagtcattattaaatctgaatttaaaattgcctttggccagcttataatttttcagaaaatgaatatccggatttttgggatctgtctgcaatgggatatcttttccgtcccaaccgttaggagtagcattgccaatgatgccccaggaaggggtattgggattttttttaacttctttcacagttccatcccggaaatgaatgacagcagtgtccggttttccgttttgatctggcttcaatgtgaaggagaacttttcatcaagttgaaatgaagtattgctcacaggtaacaatgagcatcttgaatagccgtcttctctgaaaatgagctgaccatcaagaaatgatatataaaagtttgagtttccgtcagaatatattccttccagcttttttaaattcttaggacttatctttgctggggtaggaacactgtagggttgatcgtataatattttttcgatcttaggaatgataaaatcagtgtgtgacaattctgaattggatattacaatgagacagatatcatcttctaaaaccctgtagtatctggttctgtatccgggaccgccaccatcatgacccaccgttttttttccggaaacatccgaaatctgaaaacctaagccataatgatcattaagataaggtgtaaaagctctatctgttgtttcttttttcaggatagtataattcttgagagcttcattgaatttaaaaagatcttccaccgttgagtacatagctccggctccaaaagggtggtcggttttaaagcgtaatgcttcgtttgatctgttatcagataaaaattcatacccaaatgctttgttttcatccgtaaccttattgaaattaaaaccgctgtgttccattttcaagggcttcaggatattgttttctatagctttatcataattcaggcctgtcactttcttaataatataaccgagaatatagtatccggaattggaataatcccattttttgcccggagagaaattgaaaggcttagcagagatatattttataaatgtttcttcatcaactgtattttcagagcctgtttcattgggaataccagaagtgtgggaaagcagattggcaatggtaatgctgtccccttttggaaagtcaggataatatttggagagtttgtcattcagagataattttccctgttctgccaactgaaaaataacggctgcagtaaacattttggtagtggagtaaacccgataaatgctgttattggtatttttctctttttttggagcgtttttgtagccatagcttttttcaaaaataatttttcctttttcagcaatcagaacagaaccactgaacagaccggcttggtcataagtggcgaataattgttccagttctttggatttctgtgagaaaagagaaacagaagacaataataaaactaagcaggttacaataggtttcatttagctttttataataagacacttttaagtgttatgttgttacatgttattgcagaaatagagatgataattttatttaatttgaattaatgtcttaattccctggatcataaccatagatgcttttcttgtctcaataaaatattttatggtttttccatgttccagaatgatttttccaaaagtgagtttctcatttccatatcccttaaaatttccatacaatccattttctgcatgcataatgagtccggattctaaaactccgttttcggatgtaatcaatttttgagttgtcagaatgctgtaattatctaagtcaataatagtagaacagatcagaagttcttcttcatttaattggattgagatgccaggatatgcatcataaaaagaataattgtcttcataaaattttgtccattgaaaatcatcgtaaggtttaatagtagttctttttatctttgaaatacagatacggtgttttgattgatcgttttttttcattttaataccacatgttttttatttcattcactatttcactggctttgctttcggtgatccagtctaccattctggtttcaatgtctttctgtataagaacaacagaatatgttgaaccactcagagaaaagtgatagcgaaccccgaatttatatttttccacttgaaaatcttttactaaaatctgatcagtttcttttttcaggtaagttttaggttttgtaaacagtttgtttttatatcggacagttactttttcagagtcaatggtaagtatcgtttttccaaaggtattccataaccagatatataggaatagtataaaaaaagctataaaaggaatgataaatgaaatataatttaaaaagaaaaagaacccttcttcctgaatacttataagagggataagaatcagaatagtaaaagagagtaggaacaagcctaaacccaatatgatggtcaataaccaattggttttgttttttattttaatgatggtgggcatttattcaatatcgttataagaattaaccttataaagcagttgaaacttaacagtatcttttttagaattgggatatgtttctttattcacctgtttttcaaattctttcataatctccagatccaggtcatctttaaccgcaaactgaatgtcgtttttcttttttcccaattcaaattgaaccattatttttccttcatttttagaatctttaaacaggctttcaaaaattctgttggtcttttcaataacagatttaatatcctcaaaggaagaattggcctttaattccgaatcgccggacagaagtatgaccttttcaagtttagtttctttgttgcctttatcagtaacatatatttcattgccatttttatatgttttaaaagtcccttccgttctataggttccgttgtcaataggattgctgtaagagtttttatacgggaactcgtccagccagaataattttagctcttccttcagaaagttgacaatataataatggttttcggtctgaatgatgaacaaaggttcctgaatatcaaatgagatggtagaccagtaatattttaattcatcttcattggcttttctaatctgataatttccggaaacctcttttttaaattcattccatatttttttggagtcatccagctttttagccatttttccttcaatttccacatcatcgatatggaaaatcaaactatcaggaattctttttagggtttctatatttttaaatctcttccagagcgttggccctataattaaattttttcccaacaaatcatcattggctgtattcgtaaggctttcggtaagcaatttttttactttttcgttgattgtatcatctgcataatgataaactaccccattgggaatggttattttctcggtgatttgtgctttgacagcattgacgatgaataaaagaaggagaaggatttttgttttcatgggttgtttttaattggagtaaaatacaaaaaaagaagaatctggctttcttatgggtcttgaatattattttgcaaaatttaatgtctgaatggcttttaaaagttctacctgattttcttttttcagatttgtaccatatagattgaatctgatttttcctatcgattcggtcttgaggctgtcgatataaacacctgtaattccttttcccacttgtttgggctccaatatttttgccttatatccatcaatttttttataagttattttacttttgatgaaatcttcctgattctcattttcattgagaataataaataatgtagtatcagcgtctggatttacttttaaaagttcattcaaatcttttctgctgataacaggagttgaaagctgctcaagagaatttgaataaggtccgtaatcataaaaaatagaatcattattttttgtgacgataattccggcattgctatcataagcatccgatttcaacttgctccagtctttaggtacctgaagtgtaaaactgcgaaaatccattgattgtgttttttgagaattatcagtacaagcaaataatgtaaaagcaataaaaatgtgtgaagacatttttttcatggctttatcggagcatgttttagatacggataacatttcttttttagttgtattttaatagtactttctacttgattgctagattcaaaatgtgttacattctttaactttcctattcttatatagagtacttaaaaaacttacgattgttaaaataaaggttccccattcaaatccgtcgtcagcacttcactcatataatcaaaaaaaggacgcatggcaagcaaggtaagaactgcttctttctgaaagttatctgataaaacttctttatctgtaaatttccgcatcaccaggaattgtttttttctgatcagatcaatagccggatgatttttatcaaaaccctgcggtgctgtttttacagagtctcctttaagttctccgaaatattttataaaagttttatcagcgataattttttcaatttctttgctgctgatttcaaattctttacggatgcggagtaaatcattggcttcgggaccccaaaatccgcctcctacaaaactgttgctcggttccagctgaatataatatccacctctcaacatgggttttgaccgcgaatatccaacgccaaaattggttttataaggcgctttgtttttggaaaaacgtacgtcattataaatcctgaaaatatgcattcccttaagctgatcatgctcctgaagttcattgtagatctgagtaaataaaactttattttcctttacaatggtatcatattcagatttgtgctttgcgaaccattcccggttgttgttttcttttagctgggtgagaaattcaaatgcttttttcatattcagatcaggattttccttcgttgatatattcttgataatcttcttctaatttgtcaatttctttgattaaaaagtcataaatatttccttcaaatacttcgtaatcctcctcgtcatatttgtcgtactccactttgatgatgccgttgtcggtataagctctgtacagatttccgctgcgtttgaaaaatagctggcccagaggcttttctttatattcaagagcttcggcgtgtttctcttcaaaacccatccatgaaggcatttcttcatcctgcgaaagtccatatacaaaaaagccatatccgaatttccaggccggaagaacatcaaattcctcaggtcgtttccatatttcttctttaacctcaaaaatcaaggatccgaatgttgtcaggaaatctttaatatcttcgctgaacgtatagcccgtactttcttcatactttgtaatttgttcctcagttgcgggtttggccacagagcccattacgaaaaaatcatcatttaatttctttttcctgtcccagaattcttctttagttgccatgttttttgtttggtttatgccgtcatcattgatcagaccgttattgaacaaatataagggaaagttggagggataaaaaatgaaggaagggtaaatgatgtggcttactcattttcaaatgtaaaaccattttctttgtccatttgttcacgttctttttgtgacattctttttcttaaaactctcgtagtgtaacctcctttcacaatatttttatcgatatacatccaatctgtaatatagtatggattaatctcaatagtgtctcccagttttacttctgttgttgatatgggatctccatctacaattccatagaatttatcatcagaatattgaacttcacttatccagatatgttcacctccggaatcagcagtggtaaatctttctttcagtgcaaaattggagtaatccggattgtggctttctattgcttctttgaacctatataatgagttccgggcattttctatcgcagtattcatttcggtatcttcaccctgcagaatatgaatatcaggctcattatctctttttacaacttgatcttttctttggcagcttaatacgataagacttagaagtagatagattggatatttgcagcgcataatttaatctgatgatattaattcaagtttctaattgtcacttattaatcttataatcttctaatttctgtttcagttcttcagaaaccaggttgttttctatcaggtagtggctcgttattttcaggaaatacctgcattcctttaagtaatctttatcaggtaaagaatgatcttttaaataagtgtttgctctgtcaacaaataatccggcaccttcgaaatctttgcttatgaatagtgttccaactaaggatatataggaaacaaattcatattcaccatcatttccttttaaatagtgagaaggcatctttttgttcatcccctgaaaataggatatgattccgatgtctttcaggtatttctccttttcgataacaaaccagtcatctattatttcgccatcaaaatccatttcaagatcataatacccgatgggttccaggtttttaagatagatttcattttgcacacaaagacttattcttgcccggataataggttcgcggtattgctgttcaatcagatattggtatccctcaaattgaaaagtaatttcgtggcgggcaaagcctcctatcaattcttcaggattttctgagagtattttgtggagcatgtgaaatgcttcatttttgagatgaaatttttcagctctttcagtgagtaatgtttgaagttcctgggcgttcatatcatgattactagtcgtcaaatctgcgaataacaaaaaaatctattcaaacattttttttgttgcatgaggtatgatgaagtacatacttgttgtatttccattgtcgaaattaatatcaagaatatccagaaaataaccatttttatcctttccagaccccatttttccaatcttcatattaaacccttttcttaaataatcctgtccatcactaggatttaatgcaaatgttggatcatcaggactaaatccctgcccgctgtaggccatcgcatgaaatattattcttgttttcaagagatattgatctgctgtttctttacgatcagttttaaaataggcataggatgtttcgaaaagtgttttcaggtcgaaagggtgggttttcaaaaattcatcacccagctgaattactttctcatattccttatctgtattcaattgatataatctttttccaaattcaagatctttatagggcttataaaatttattatctgtaaaaccaattagtaaagccagtacctgcttatctgtgagtgttgtatctattttgttatatctgtctaataaattatcataataaagctctgattttatgttttttgtttctttaagtattttctcaaaatcttttttatactcaaatttatcttgagcaaagcttagaaacggaaaaaaaagaaataggaggaaaattctcatattgatgtttattattaaattatatcttttgcagagtatattctgcattggtcttcggattattatgatggaattaaaagtatgttcgaggtttattatcatcttacaattctaatcttctgcaaaacccctttctcatctttaaaactaaaaatataagttcctctttgtactttggataaatctatatttctgttataataggcaaagcccctgttgatcacttctccatctaaagagtacacggtaaactcaaattgattgctgttatttttattgctgatgataaaaccatctttagatgcgttggtatacactcttgttttggtctcacgatcttccccggctgtatttgaagagagcgcattctcagaaatatcagctgcctgtaagcttttaatagctgatttggttacagaagttgtacttccaccgatgatgtataatttatcattgtatacttccgctgcagcgtgtcttcttggaatcatattggatgttagctgatggaatttattggttgctgtatcaaaataggccagaaacgtctgattattataacctcctgcaataaaaatcttatcaccggataccgctaatgaatgtcctgatatcccggccggcatcgtaatctgatcggtccagcgattggtgttgatatcgtagatattgatcaggcgggatgaggtaccgttgaaaccgccaatgacatacaatttatcatttacaattttgccctttgcttctttggcggtgggcatatccggtaatggatgccatgtgttggaagcaatatcatagtattggaacctgttggaaaaggcagtggttgcagctccattgagtccgctgccgccgaacacatatatttttccgttatggatggcagaaccggcatttcctgtatacgaacggttcacagctcccttcgttactttcagggttgcaagatctacaatttcaagatggctgtttccccaaccgttaaaaatatagattttattatcatacgtctccgaattagcaaattttttaggactgatggtaatattgagaagactccatttgttgtctgtaatattgtatttttcaatataattggccatacctccgctttcctgatatccgttgctcacatagatattatcatctacaattacactgtttgtagctcctctccctaaagacatattggcgagacttttaaaattaagcgtttgtgcatgagccagcagtgaacttaaaaataacaggaataataattttgttttcaatggtatgaggtttagtgtgtttgtttttatctgattttctttataagagtccggactattttagtactgaactttaatagaataaccattgtttaaagataggaaaaaagttgacgagagtttttctagaattgcttttacataaggtcaatgattctgccacttttaagtttgaatggcccctgcaaactgctattttcctgaattgttctatccatagctatatagaagttttcccaatgttcttctagttgatcataattttttgtttcccaatactctccttcatcaacaacattgagacattcgaaatattcttttaaaatctcaagtaattcaattatttttatgtgtatttcagtggatgcaaattgggtcttgcagaattcctgaatgtacaaatctttatcaaactcgaaaattaagggttctgaattttcgtgaggttgtacatgaacacctttggtaggaccttcatagtttacattttcttcgtcttttactcttttcagagttacagattcattttcaaattgaaaatgatcccattcttgaaatgatgaaaactcaattactttttttactaatgtattgtagctttcttcatttttaagtcgtccttcaaaatgaattgttattcccatagataatatgattttaatggcttgctacgaaaatatcaaaaaagaatttaatataaattcttgtagagcatttaaattatgcagtaatatattatgattctatccggattcataagaaaaatgaaaaggtctgcgttttatttctgatgaatttaattattatttacctttttcaagtccatttccgaatataatctatactgtatatttcctgtgttttcatatactttgtcgtataaaacttttgctttccggtattttcccaattcatcataaagtgctcctagcatataagcagcttctatttgatcaggttcattttttaaaatttctttatacatcctttcagcctgttcattttcattatgagcaaaataccagttggctatttcccaataatcagataaaagctttgtttcagtaaatttattttttagagaatcgatacttatttctttgtaatcatttctaaacttgtccatccctgttttctttacatcagccatatgaatatagaaaggatcacaattatttattaatctgatcataaggtctttcatgaaatcatttctgtttttgttagctgtgctgttatggaagttttcaaaatctttctgaagttttgtcattacttcataggaacaagttttaaatgtttcatcagtataatttgttttaccagataaacaagtgcaaaattccttttcaaatttttgtggaaaatcctgagctttaatgtgaaaagaaattgaaacagagaacaatattcctaagagtaattttttttccatatatagctttattttattaatgttcttctgttcataacaatattcttaatcacaataaattgtccgttgtatctgagactttgcggatcgggtataaactcaggtaagcaacagttattattttaattgaatttcaatctttttatcttccataaataactttatccaattcggaacttcattatttcctggaatgcattcgattaaacttttattatttttataattttctatagcctttttcccgaacttgattttcatttcataaatttcattgccattatatccaatccaagcttttgttattatttgcttgttgttttcaatattatgataaagtaaagattttgtgtcttcgggtaaatgatgtataccatcacaccaaaaagtcttcgtataatattttatattttcattttcaatgtttttaaaatccagagaccattctaaatgactgcaaaattctaaattaaacacgggttcattaagattataattaaaagcaccacaattgggacattcaatatattctccattcaatttttcaaactcacattctgcacatctgccatttctattgtttacatgttgaataataattcttgcttcattttggtctacattgaattcgtcaattatttttttttcagcaaataattttaaatcgttttgcatcaaaatataaagatcaagcttttgttcttcagaaaattttagagtaataacttcatttttacatttgttgcaattaattttcattcttaatttgtttttttgttacaaacatccaaatttaaatattcaattaacatttgagaatatctatacgttcaaatttaaatagggagcatataatcgtgcggtagaggggatgaaaatatataaagttttatttagtataatcccctgcaacaatagatttttccattgtacttacgatctcagaaacgggaatcgtaaatatcccggcatttcctttatcaaattcttttttccagtaagaatatccgtcgagttcaagagaatccggctttttgccggtctcacttttcaggctggtgacacttttgttcaaagcttcttctgatagaggcagatggctgaggttttctgcatatccagtagggctggcagggtttttcatcttcaaaccgctgacagaaatatgaatcacttttccgatttcagggtagtcttcaatctttaatatggtaagggtagagcttttttcggtaggacgggttttgtagttccattgctggcctacacggtattggtctttttttgcacagctgaaggacagcaagaataatactgctatgaaagtatagagtttcatgaagggtcggttattagttttgtttttttatttctgaatcagctgctccagcctggccatcatttcatctttttctttcagcattctttcgtacagcgcaattttttcttcgtgaagttttagtacctgttcaataggattgaaaataggattatcatttttctgataaccaatactgtgatcgccaaaagtattcgcaattacatttacagcttcttcctcatcaaagttttgaaacgcttccacaggaattttcaacacttcagaaatcttttgcaacaaaggatcttctacagtttctttctgctccaaaagcgaaatcttcttctggttccaatcttcaccaagatcaaaagccaaagcctcctgcttgatgcccaacatctcccgaaaacgcttgatatttctcccctgatgtatttttttgtcttgcatatttgtgtacgttatagaaacaaatataagtaaaagttgggggataggaaatgggagagtgtgggtattttattcaggttaaaagatgatgttgtgctggcatttgctatccgaagtctcctgattttggaatatttatttttttgcgcaaagtcgggagactttgcgcagcaggtctttaaatactattcataggattttcccaattgtaactatataattgattatttaaaactgcttcaagtttatttcgaatattttctttatcaattttagtctcagttgttaactttaaaatatcataaaatcttttagagtttataagttcaataggtatacctctatcatgtgatttttgaactgttttatttactccactttgaaaatctgatgtagtaacaaaaataccttttggtatatcagaaagaaaaagagcgcccgttaactctcttatttgatcaacctttattttattcttgtatctcttaacttggacaccaatttgctttccttccttttctagaatgacatcaattccaccatcatttgaataacctgttacaatggcttcgtatccgaggtttttaaaaacctgccccgttacatcttcaaataattttggatgtaaactaaatcttgcttcatatttagctagaagatattttgaaatttcattgatcggaacatcaatattgtgcaaatctaattttttcaatagaccagctgtgccatagaaaaattgccatagctgccatactttagcactgacagtcacatcctttattattctccaccaaccacatttattacagtgatgaaagtatgttttacacgaatacttagaaagatcaagctcccacatttcttcatccattccttcttcataacaccagctctttcctaattgatgaaaactataaatttcttttaaatttacatcccaatagtcatctattaaaaatacttctaattcattttgacaaaaaacacatttttgcctatgaggattattatcaccaacttttaatgggctatcaaaatgatcatattcaaagattgccataattattaatatcaggtagtatgcatttacggattattaaaaaataagctgctcaaaatattgagcgattgtggcttatttattagagcaatgttagaaactttttggaattagatttattataaatattttggatttacaatgttcctgaaattattatatttttcaatattaaacaaatatgttttctcttcttttttattgatttgtttatctctgaaataattttcaacagtttctaaggctttattatatttacatctaaaaatttctacagattcaatagattcatctccataatattcaccttcaactttatatttctggagtgctttttggatatcaatttcaaccatatttgcatgatcacatttaatagcttttataacaatccaatcattagtatttccaacttttctagaatttaattttcctattcttttaattggatcttctgttgtcattcctattttaatatagttttttataatactaccagctatataaacatagccggttgctttggttcttttcataaaagcaatgtgtgcagtattacaaactatgcaatgtgaatgtctatctcttatagtatgacctgcatttccacaaggtgtagtattataagcaaataatatatcattgattttcatttcatcttttatctcagaaatactgagaccttttgcatccattatatcacttttgtcaattttatgatattcaatgaactctaataaatttgttttcataataattttgtatttaaagctttagtaacatttttaatataggtaaataacttagaatatataaaactaatacaatcattgtgtggtagttatttaaaaatcttcaaaatttccaaattcatctccaaaatctaatataaatgcttttttagctaaactaagttctattttaaggatatttttaaattcttctctgaagtcttcggatttaaaactattattatcaacatttacatcttttttcaagatgcattgaatataagcttttataaaaggatttgaaaagtaatatctatttgagttttcattgaatcttagaatttcagacctgattggagagcaaaattcatctatatatttttttaaattatttcctacatatgaagaattaattgtttgaataatttctttaatttccgaaattgagaagttttctttgtttacttgtataattgcatgtaacaaatcaagaggattttcattttttcttttgtgaattattttggtggcatgttcataaataattttgaatgaatccgagttttcttctaaaaactcttccattgcctcattaaaagatgttgatagtattttctttcttatagcttgggattctctaatattattaagttcacacataattaagcataaattatgcgttacagcaggtaagccacttgaatatgtacttattctattttttattgcatcatcaaagtcaatgtttaggtacttttctccattagaaatgattctttttaagttcggtatatccattagtggtacttctaattctgcaatacgatttcgcatttcaggatcatattgaactacctcacgtgccgagttgacagcacctaaagctattatttttaattttttatattctatagaagaatccatgaaaactttcataatttgtgccatttgagttttctgactctcttcaatcttatgaaaatcttctataacccaacataattccttcgctcctatatattttgctaaattctgaggagttattggaagttctacagctcgtttttgagaaatcttcgtttcagatttattctcatcttttaaacttgctttaattatccagaatgatagatttaaatcaataccaccaccattagatttagttttacttttctctactgggtaatagatatctagttgattaaatgcatccaaaataatatcatttattgtcattcctgtaatacaattcgttttgatatattttaattcggattctttcagtttgttagctaagagagtcgttttacctacgcctgaatagccatacaatattatttgtttccctggagttttcaaagccctgtcaagtcttctatttatttcatttctttcaacaaatgttatatctgcgggttgacttggtgtaaaaatttcttctaactgataaacagtttttttttctttcataaatcatggttattattcaaatctacacaattctctagactttaaacttttgtttatttcataatctaaattaatttattaaagtattattatattacgggaaaccatattccacaaaaaaaaacgccctacaaagtagaacggtttatatattaaatttgtcttagcaactcgctattacatcattcctggcattccaccacccattggcatagctggttcagcgctcttcacttcagtgataacacagacattttctgaagtctccggattttggagaatattttaaaaggggagttttttaattttgaataataactgcttttgttggtaagtaattatctactttgcttctttcaataatttcaatttcaactttttcgaaatcgtttgtctgcatttgaattttagcagtttcatcatgtttgtatatttttgaatttagaatttttaggatctccataaattcattattcataaatggctcaataaagcaaagactataaacttttccgctggatttataagaaataaatcttggatttcctgcaaaatattcattcctattgagttgtttttgtttgacaaaggattcaatatttttgcctgataatgagtttaattggttaatttcttctgaagttaatgtgtattggaaataatttttcccatcccagctatctgaatagacggttaagtttcctttcttatctaatgtagcgtaagacttaatttcaattttattattcgatattaattcataatcaacaatttttaaatcttgaattatatttttttgtgaaaacagatttatacataaacatataaaaataagtaatgcgaactttttcatgattgattaatcggtttgaatgtgctttttgttgtaattacggttgatattcaaatttacactttaagctcatatatgatatataattgcaaataaaattttaagtaaaaagttctttagattttctatataaaaaaccgctccacaaaagcagagcggttaatatattaaattgtctcagtgacaagatgttacatcattcctggcattccgccacccattggcatagctggttcagcgctctttacttcagtgataacacattctgctgtaagaagcataattgatatgggatgattttctatgtatttgtaaaaagttttttaatcttctcaatcacagtttgtaaaggggttaattcatatccaatatgttcacaatgtaaagattctaaaaattcaggtaaattggaatatatatttacttttaacgttgcgatttttctattttgattgttgaataggcttataaattcatttccatcatcatcaactccatgtttatatcctagaatgtcctttaaatgaatcgttttttttataagtaagaagttatgatagactagattttcgttttgaatcttggctcgtatcaattcataataattcttttttcctaccaggtatatcataaatagaaagattaaaatgaagtaactaaaccataaataatgacctttcgaaatcatattttgatatgcccctttggtaaaaacaaatggcaaggagaatgaaaaaagaaaaagtgtagttctgaaaaaaacaatgaaataatttttgatttttagtgtcattacatttttagtgatttatttaagtaaagtgtgtcaaatatatgaaactttgcaactttttagaaatacgtttttttgtcctataaaatgcataaatctgtagatgaatatcgaatgttgtaaaaacaatcttaaataaaaaaaccgccctataaaaatagaacggttagtatattatattgcctcggtcgctgaccgttacatcattcctggcattccaccacccattggcatagctggttcagtgctctttacttcagtgattacacattcagttgttaaaagcaagattgtatttatttttttacaataacttgcttcgtgagggatttattatttttgaaagttaattttaggtaatatattccaggagaaaaatcagtcacatctaacttaatgaaatcttttgtatttgtaatgaatttaggggttaaaaatcttccatcagcactatataattctactttttcggctttgccatttaaatttacattgatataattggaagtaggatttggatatacaacaaattgtttttcagtttctttttctgatgtacctaaaactgtatacccggtaaagcttctgtatatttttccatttgttcctgctgtgaaaatataattattaactaattcaagagagtttaatctatactgagttgttactgatgaccaatttattccgccatttatggttttgtatatttcaccattttcatttacaatatatcctatattaggggtgtaaaattttgttaatgtataatagccgtaaggaactgacatttgtgtccaacttagaccaccatttgttgttttgtaaaatatagagttatctcccgcaaagtaaccattattttcatcaacaaaatgaaaagagttgattccatctcctgctaattcaatgagttgattccatgtgttacctccatctatagttttatacattgctccataataattcccaactctattagcataacccacaagcgagtttacaaactgaatatttccaaaggcttggtttgatacctgtgtccaactgcttcctccgtttgttgttttcatgacttttttttggttaaaaccaccagaaataaaaccagtattaccatccaaaaaacaaatagaacttatcccttcgtctataatatcatttccattatttaatatttcccatgttgatcctccatcagttgttttataaacatgtcctccatatgttcctccagtagttgcataccctaagttttcattaataaatgtgaaatcactactattaacagaagtgccaagatttaacgtgccaaccaatgtccacgtgtcaccaaaattattggttttgtaaaattgattattagttaatgcaaaaccaacattattattcactatttgtagttgtctgaaatcattgtaggtgggcgaatgttgtgtccatgtgtttcctccatctatggttttaattattcttcctcttgctcctgtagcaaaccctttgttactgtcctgaaagaaaatgccatacattgaagtattgtcaaagtatccgttttggaaaaaaatctggctccatgtaattccgccattagtcgttttataagttgcaccataattacctgtggcaaaaccattattttcatctaaaaagtaaaaatcatacattgcttcaaatgatcctgtaatttctgtccaactttcgccaccatctgtggttttaaataagtcatcgtgttgtcttgatgcaaaaccgacattctggtttatgaaataaactgtcaaaaagttagatgggtatacattagtattataagtattataccaggtgtttccaccatctatagtcttctgtatcttgccgttattacaaacagcatgtccaatcagagaacttgtaaaggccgttttgacaactgttacgtttggaatagtataactcatccacgtagttccaccgtcaagggttttaataatactattcgaacctgatagaataattgtgttattgtctataatatttactgtattaaaagaagtattaaagccagtagatatttgttgccaacttacaccattatctatggtctttaaaatataaccggaatcccctacaatatagccaatcccattcttaaaactaatatcattaccacttaaaatattttgtttttttgtccaggttgcaccagaatctatagtttctaggagttcatttgatgtaattataaaaccgttattgctagaaacgaattcaatatgctttccagtgtttgttgttggcttggggtttaataactcccaattagtctgagaaaatattttattaaaagtaatagtaattaaaaatagtaaaagtatttttttcatttatgattttctttttataacgtttttatgatcaggtacgatcatgaagatataatatttataagcaaaaatagtgtgaatgcaattttagttaattgctaaatctttttagaactttgattcaagtttaaagtttgtataatgtatgttttcatggttttatttagagggccaaatatagttaaaaaactaatacagaaaaaaaccgccctacaaaagcagagcggttagtatattaaatttgtcttagcgacacgctattacatcattcctggcattccaccacccattggcatagctggttcagcgctctttacttcagtgataacacattcagttgttaaaagcattccagaaacagaagctgcgttttcaagggcaactcttgttactttagttgggtcaatgattcctgcttcaagcatgtgtacatactcgtcagttttagcattgtatccgaagtctccgtttccttctgctactttagcaacaattacagaaccttcaccacctgcgttggcaacgatttgtcttaatggctcttcgatagctcttttcacgattttgatccctgtagtttcatcagcgttagatcctgaaagattgtcaagtgaagagattgctcttactaaagcaacaccaccaccagcaacgataccttcttcaacagctgctcttgtagcgtgaagggcatcatctactctgtcttttttctctttcatttctacttcagaagcagctcctacgtaaagtacagcaacaccaccagctaacttagctaatctttcctgaagtttttctctatcgtagtcagaagttgttgtttccatctgagctttgatctgagctactcttcctttgattttcgcttcgtcaccaccaccgtttacaactgtagtgttgtctttgtcgatcgttactttctcagcagttccaagcatatctaaagagatgttttccattgtgaaaccttgctcttcagagatcacctgtccacctgtaaggatcgcgatatcttccaacattgcttttcttctgtctccgaatccaggagcttttacagcagcaattttaagagaacctcttagtttgtttactaccaaagtagctaaagcttccccttcaacttcttcagagatgattaataaagacttaccaccttgtgcaattggctcaagaaccggtaacaattctttcatggaagagattttcttctctactaaaaggatatacgggttttctagttcagctaacattttctcagggttcgtcacgaagtatggtgactggtatcctctgtcgaactgcataccttctacaacgtctacggttgtatcagtacctttagcttcttctacagtgattactccttctttaccaacttttccaaacgcttcagcgattaaagaaccgatcgtatcgtcgttgttggcagagatagaagcaacctgcttgattttttctgaagaatctccaacctcctgagattgagatttaaggttttcaacaacagcagttaccgctttgtcgattcctcttttaagatccatagggttagcaccagccgctacgttcttaagaccttctcttacgatagcctgtgccaatacagtagcggtagtagtaccgtctcctgcgatatcgttggttttggaagctacttcttttaccatctgagctcccatgttttctaccttatcttcaagttcgatttcttttgctacagaaacaccgtccttagttacgtgtggagcaccgaaagatttttcgattactacgtttctccctttaggacctaaagttacttttactgcattagctaatgcatcaacccctctctttagagcgtctcttgattcaatatcgaattttatttcttttgccatgtttgtttagcttttggcgacttgctttttgcttttagcttttgcaattcgcgtgtttaactttaatttttaatttccattgagcctgttccacaaagtgacaagctttttctttaatgttgtcaactcttccaaaagattgtgataatcattttcataaatgtatcctaaatctttggcgagaattaattggttttcggcttcattggatgatcccagagcaatattgatgaaattgacaaattctttatctgaatttctgccgcttccttctgagatattatatccaatagatgcaaatgatcttctgatttgagaggtgagcccaaaaatttcctctttaggaaaacttctggttgaagtataaattttcagtgtcaactgatgacttaattgccatacttcaaactttttaaaatctctcatacattaattttcatgtagaaaaaagccatttgccagaagccaatagcaagaagcttacccaatgattcccaataagtcagcttctcttacgattaagtaatcttttccttctaacttcaattcagaacctgaatatttaccataaagtactttgtcacctacctgaaccgttgtaggctcgtcttttttaccaggacctactgctactacagtaccttcttgcggcttttcctttgcagtatccgggataataatacctgaagctgttttagtttctgctgcgattggctctaccagaactctgtctgccaatggtttaaagtttactgacataatatatttaattttttaattatttctgtcttctaattctctaaatgtatgccatgagacgctgatggctgaaatggcagatttttattttccgaatgtgaaaatttggcagaaaaattattttttacgggccggaattccgaaaagatagctggttaatacaggtaatacaaacaaaagaacggtaacggcagaaactaaaatttccatggtatggctgcctaaaaattgagcgaatgccgtagcagggtagaagtgctcatacagagataggcttagtttaattcctaaaacagcaatcacaataaaagcagcggtttccaggaatgggaatacctgcatcagacgtacaaaccactgcgcaataaatctcatggctaaaattcctatgaatacacccaatgtaatcagaagtaaattgtctgaaaaagcgactgccgcaaaaacgttatctatggaaaaagcaagatccatcacttctacaatggcaactgtagcccagaatggccccaacaatccaattgaatttttatacagccaattggattctttgttggggttttcttccggactttcatcatcacttgtgttttttatttttttgatcaaccagtcaacagaaatataaattaagtacaaccctcccagcggtttcagccaccacacggaaatcagcacagaagcaaaaataagagccagtccgcggaacaaataagccccgaggattccgtatttcaaagctttttttctttgattttcgggaagatccatgacgatggtagccaatacggctgcattatctacggagagaaggctttcgataaggataagattaccgataatggctatcgattttgccgggttttgtaatatgtcattgaaaaggtgtgtaaaatcaggaaacatcattttttaaagaaatagtattttggttaagttttgaaataatggcagccgaaacggtaatgcctatgaagttggtaacagatctggcttcattcataaagcggtctatgctgtataacagtgcaagatctgtggccggaatttttccgaaccggctcaaggtgaacatcagggcaaggaagcctgatccgggaacacccgaagctgtttttgatgcaattgaaatggtgataaaaagccagaaataatcttttggtgtaagcggaatattatacagctggaccaggaaaatacacgagattgaaagatagatgcaggctcctgccagattaaaattatatcccaacggaataataaggcgaagaatttttctgtcatatccctgtgattccattttatcaaagatcataggaaatgcagtcttcgaagaggaagtggctactaccagaatgatttcttctttgatgctgatcagaaaatcccaaaggttaattttaaaataagctgttataacccctaatattccgaaaataaaaaatacactggtaagatatactgtggcaacaatcttacttaacggcagcaaggtattaattccgtagactgaaattccgtaagcgatattacagaaaataacaactggaagaaaaatgtaaacatacttgataagtttgaagaacagatttcttccgacgtctatggctttaaggatattattctttttctttgaaagaccaatcaggactcccgcagatattgatattaaaaggaaaagtacataattgctgatatgtaaaggatttgtaacccttgttaaaaatctttccggaagtgctttatgggaagaaataataattcctgtattggcacccggttttaaaagaagcccggaaccgattcccaataagatactgatagaggtgatgattaaaaaatacagcaccatctggcttacaattttaaaagcatttttggtgctgaaaatgtagcttaccccatacatcaccgcaatgaaaataacgggaacgatcaaaacctcaagaagcatgaagaagtagctgctcactgtttccagatgcttactgacttccggaaaataatagccggttagtgctccgcagataattgctgtgaacacataaagcgtaaggtttcttaaataggagtctgtaaatgttttttgcttaaaaggtttcatcacttactttttataggataagattacgaaattcaaagatataatcttatataataccaagaatcaatgcactcaccaacatgatgatggaggagcccagggcccatttcaatgtatattttaagtgatcagaaaactccacacctgccagtgataccagcaggtaggtagagggtaccagcggactgagaagatgtgagccctgcccgataagactggctcttcccaagatttcaggcgcaattcccaattcatgtccggtcgcaacaatgataggcagtatcccgaaataataagcatcattggacaggaaaaaagtaaacggaatactgaacaaagcggttacgatattcatataacctccccagcttttgggaactatttctatcatactgtttcccattgcctgcataataccagaaccattaaggattcccgtgaaaattccggctccgaaaatcattcccgctacggacaatgcatttcctgcatgtttagaaattattttctgctggtctttcaatttcggataattgatgatagaggcaatacagaaagcaatcataaaggcaattcccaatggaacaatatccaggatcatcaccactaaaagagtaacggtaagggccagattgatcaggatcagtttcgggcggcggagtgccggatcagcttccccaataatatcattgctgttgtagcttgtaaatttaccatgttttgcaattcttattttttctcttctgcctaaaatataggccacaaatataacccacaggatgcctatcgccataatgggaatcatcggaacaaagatttcggtatgtcccagcttcagagagctcattacccttgctgtagggcctccccagggaaggatattcatgatctgcccggcaagcataatgatgcaggtaagaatcagagggttcataccctgttttttgtacagcggaagcatggcggccactacaattaaataagtggatgagccatctccatccaatgaaacgagtgcagtaagaacagcggttcctattgttgtcttaacgggattgtccccaactgcttttaaaattatgttgacaagaggctcaaaaagccccgtgtctatcattaaactgaaatacaagatcgcaaagatcagcataacaccggtcagtgctatttctttgacaccatttttcatcatatctccaagctgtggaccaaaccccgcaatgagagcaatggctacaggaacaatgaccaatgctgtaagcggagtcatttttttgttcatgatgagaatcatgaagatgaaaatcattaaaaatccgagaaatgtaagcatagttatatagattggtgggtgttattgttgatctttttttctccagtcaaaagaatttcggaaaccgatgtaggcgtagttgtctgttctgtggtctcccagctggttaataaatgcaaattcaaatgcggaggctttgctgatttttattccaagtcctgctgtaatcctgttgctgtcgaagatgttttccttggtggcattaacacggacttcattttttaaaataccataatattgtcctgttttccccaaaggaattctcatggaaagaaggtaccttaaccggactttaaactcatccggattgttcagaaaacgttcttctacacgaaatcgatgattaatcaatgtccgaccaatgtgcccggtcagggtaacctgttgaaaaggccttgtttcataccgggttactttttctcttttggaattataagaattcaggacaagaaacattgctcctgctccgggttctacaccgggagctacttcgtactctaaatacgcgttcacaaggaataatcttccgtctccgcccagatcaaatgatctgtattgggaaagtgccgttaaattggttttatcagtaagttttgaattcatgatatactgataccacatattgtagttgtcaatactttgcccttttacccaataattgttgataattattaacaaaaaaacaagtgttaattttatagtaaacttcatataatatttgattaatattctagcttctcaaatatatttattagcataagcggcttatgaatttttcaatcaatgacagtttttctcagcaaactgcattttgagacaaaaagatatttatatttgatgcgtttcaaaataaggtatgggctatgtttttaatcattaattttatttttatattattgattatcaggattttatttaacggtaaaattctggatagcctcatgaagtaccgttggaaatttttactgaggtttcagcatatttttttcctttttatcttcattctgatgacttatttcaccgaaaactacttcctggactcaacccagctggtgataagtatttttttgaatacaattttcaatgtggggatttattatctggtatactattatctggttcccaggttttatttatccaataaatatccggagtttatactctatgctttgatctgctttttggtgtccagccttttcaggattctttgggaacctgccgttttccagatggatttcagcggagagggctatcatataggttttctgtataatgtatacatctcacaggggattgtgattcttgtggggtcttttctgggaattacaaaagacaagtttttaatagaacaggatgtaatcagcctcggagaagagaaggaccagctttatcttgatttgctgaaatctaaactgaatccccattttttgctgaatacccttaataatatatatgcgaatagttttacccattcggagaagacttcggattctattttacagctgagcaggcttctcaagtacattatttatgatagcggaaaagaaaaagtaactgtttcccaggaattttcttcactgaaagcgctagcagctttgtaccagcttaaatataataaccagcttgatattgtaatggatattgaagatcaggaagagtttgatatcgttgaaattccttctgccgtatttcttactttatttgaaaatgctttaaaacattctgccataggggaagatcctaagagctttataaaactgttctgtaaaattgagcgctctgaactgtattttgaaattattaattctgtagggaaggatagaagtaatccggttgaatcagattatcacggattgggtaatgaagcaattattcatatattggaaaaattttatgcagatcagtatgagttttactccggaccgaaatacagtgatcaatataaaattgccttaaacattattataaatggctaatctgactatcgtaaatgtagatgatgaatatcctgcattacagcttgtaaaacaatattgcgctcagcttgaagatgttcagctgctggcttcatttcagaaaccggaagaagcgctggctttcctgaaagcaaataaagtagatctggttgttttcgatatcaatatgccgggaatcaatggtgtggaacttttgcagcaacttcctgatccgccactgtgtattttccttacactggaaactaaatacgcggtgaaagcatttgagctggatgttgttcattatctcatcaaacctgtggattttgagacttttaaaaaagcggtcaataaagcaagggattttgttcagtttaaaagttcagccaataaccggcagcaggaagattttattatgttcaaatccaattatgtcatgaataaagtctttcttaaagacattctctggatacagggtttcggggaatatattgtattgatgacgcccctgaaaaaatatatgattctggagagaatgtccaattttgaagaaaaatttcagcattttgggtttatcagaatccataaatcttatattgtattgtcagatcacatcagttcttataattccagccatgttttccttaaaaatggtgaagagcttccgctagggcgtacttataaaaagaatattaaagcacatttaagttaaaaaagaaagccggaaatttccggctttaaattgttatcaaatgactggattacggacaagactggccagggccgatccataggatacattgtcctttgtaattgtactcgcagcaaaaacgtcctgctgctccgccattgatagatttctgagcatctctgcttaatactttggcatttttcatagttaaaatattttggtttgtacatcctgagcatttaatgtcaatcaggattttgacactggtgtaaaagaagtaagtcaaagatactatttttccttataacgtgatatatttttgctgataatttttataaataaaattttgattatcagttattaacggtttttgttaggaatgtcagagattgagaatataaatagaaaagccggaagcttccggcttttcaaaattgttatcagttgatagaactaaggacagttttgtcctgctccgatccataaagtacattttccgttttcgtcgcgttcgcagcatacgagtctggcagcaaggccgccatggattgttttctgagcatctctgcttaataatctggcatttttcataagtaatattttgtttttttatcctgaacatttattgtcaatcaggacttttgacattttgtgttgatgataaatcaaatataaatatttttaagtcagggtgttatgtttttttagacgcaagcaagatattgatatctttcaatactttatcggattgtttccaaagacatctttcttcctgccatatccatatcctgcttttcgattttccttgttatggtatcaatataataagttgtggtagcacttctgttgctgatgtcatcatttgtttttaccatccagaccggttttccgttgtattctgctttttgagtatcaagaatgtaagccttcattattccttttttctcagatttaggattatagtcaaaaatggaaatttctgcagtatagttttcctttaaaggaagatatcttataagcattgcataactgctgctgtcaaaataattggttgcaggaatttcgatgatctcttttttccggaattttttatccaggtaatagccggtgactttatctttcccggatttaaggaccatatctctgttcacattgtaagaagaatggtaaatgggttcaaagtccgatatttttacaagggtagaatcggtccacttggcatccggagcctgtttcatctttaccgttgttctgatcaggagatccgattggttcagctttttgatttctgtaataatggttccgatttctatttttgtatctgctttttctgcataccagacggcttcagaagtctcatctttgatcagcttcggattaatcccggagtttttcggattcagcaggttttgggcaaaaaaattagcactgcttagtattaaaaggaaaagaatggttctcatgatctttttaataataagtagtgctatatctgttaaaagttacaacaggttggtttttaactctttcctgctgcctgcatcggattgacctttccgttggagcttcctcttacaggtgctccgtcctgtttttgtttgaagagctggaatttagaagtttcagtacctgatccggcgctgctccagaagttattgttcgtatcaatatcagcagtctctctcatcgggtcaagctgaattgattttacttttttatcaaaataatacgtcttggaaactttttgctcattcagtctccatatctgcgcagcagatttatcatataatttggaaccgtcctcaaaagtgaactcaagaataataggcattaccaaacctcctttgttgacaaaatcaatctggtatcctgtaatatttttaaatttctctttatccttcgcatccaaaggaagacttgcttctgttttagtagtgtattccttattattatctaccttttcctggcctctgtcatatctgtaatagaaatcctgagcatccttatcagtatccacgtagaacttaatattcctgtcttctctgtttctgatttttgaaagatcttcaaaactgtttaccaacggcttttctacctgatattttacttcagcagcaacctttggattggtctcaagatcaggaattgctaccgttactttatcaatggcaatatctacaggatctgttccgtagaaccaccctctccagaaccagtcaaggtcttcaccactggcatcttccatcgtacggaataaatctgcaggttcagggtgcttgaaagcccatcttttggcatacgtcttaaatgctttatcaaaaagctctcttcccatgatggtttcacgaagaatattaagtcctgtagcaggctttgaatatgcattcgggccgtactgaacaatattttcagagttgctcatgataggctccagctggtctttcggcagtttcatgtaatctacgatagtccatgccggtcctcttttggaagggaatttattatcccatttttcttctgtaagatattctgtgaaggtattcagaccttcatccatccatgcccattgtctttcatcagaattgatgatcatcgggaagaagttgtgccccacttcatggatgattactccgatcattccgtttttggttccttcggaataggtaccgtctttttcagttcttccgaaattgaaacagatcatcggatattccattccattggcagcttctacggattgtgctacaggatatggataaggaatggtaaattccgaataggttttaattgtgtgggcaactgcttttgtggaaaactttctgtaaagaccataagattctttcggatagaaactcattgccataactttattgttgttttcaggaatcgttacacgcattccgtcccatacaaactttctggaagaagtccatgcaaaatcacgaacatctttggcttcaaaaaaccatgtttttctttgtttggaatgatttttctctgcttttttagcttcatccaacgttacgatttctacaggctcagaggcattttcagcttttctgtatcttgaaagctgatcagaagttaatacctgatcataatttttacattctcctgttccgccaacaatgtgatcagcaggtacgttaattgaaactttaaagtctccgaaaaccaatgcaaattcacctcttccggtaaactgatggttctgccatccctggaaatcactgtatacgcacattctcggataccattgtgccattgtgtacaggtcgttgccgtcctcagggaagttttcataaccaccgcggcctcccatcttcattctgttggaaatattgtagttccagtctactttaaaaacgaatttttctccctttttcaaaaccttaggaaggtcaatacgcatcatggttttattcacggtatatttcaaaggagttcctgaggcatccgttactttttcaagagtaacgccataaccgttatccttcacaggaagctctgttactttaagctgctggtcagtcgttgaagggcgaagaacagatgatgtatcatagcctgcatttctgatgtttgaatgttcgttttcatccagctgcagccagatataatccagatcgtcaggagaattgttgtaataggtcacagtttctgaacctttcagatttcttttatcctcatccagataagcgttgatattgtaatctgctctgttctgccagtatccgtgtccgggagctcctgaagctgtcctgtaaatgttgggcgttggcagaatagttcccagctgctcaaacttattaccgtgattgctgcccgggttattctgaatattttgtgcggtgaaacctgtatatgcaaatacagaaagtgaaagtatggcaacttttagtttcataaccgaaaatgatttattaatgatcaaagataacaataagctgttgaaataatgaaaatatttaacttttaaaaaggaatcctttccaaagtcatttttaaggataaagcgaataccccggaagagacaaacagaatccagtcttttttattcaccttgaaaagattaagaagaatgaacaggatcatcaaaatgacaaatactattacaatttgtcccaactccaatccgatattgaacccaagcagaggtaaagcaatactctggcttttagcaatcattactcttgctgtgttggcaaatcccattccatgaacaagaccaaagatgagtgcgagatagtagttggcccgcattaaggtctgtttctgatttttcataataatattatccaaagaagtcagaacaatagtaagaggaattaaaaactcaacccattctgaaggaactctgaacacatccaggacacttaaagccaatgtaatggaatgcccgatcgtgaatgcggtgacaagaatcaggatttttttccagtcactgtaagaataaacagcaataagtgccagcacgaaaagctgatgatccagagcatccagagaaataatatgctcccatccaaggtttaaataaaaaaggaaatcctgcattttgattaaaaatttttacaaaagtaaacatttcgtatggaggaacgaatcttcttatgagggctgcagcagcctttttacactttacacacgaattaaaagaaaccggctttccgggttcggtttttattaaagaataaaaaggaacagagttagtaaataatggcttcttttgaaggcaccgtctctataactgttgctttttttatatttgctgtaaattaaagttcatgccgggtaagtttttttggagttttcttttattattaacagttgtatttcagagttttgtaagtgatgctgctgtgcatccttatcatgtgggttctgttgaaattaattataattcaaaatccagaacatttgaagtgaccggaagattctttctggatgacatggaaaacggattgggcaaaaaatatggcggagcttttcattttaacgatgaaaaatataaggcaaaactaaatgaagccctgcctaaatactgttcagaatatttcaaattaaaagcggataataaatttttgaaagtaaattacatcggctatgaagaagatcaggagtctgtaaatgtatatcttgagtctgaacctgtagctattcctaaaaaagtagaaactgcagtgagttttctgtataacctttttgatgatcagatcaacattgtacatattattgtgaatgggcaaaggagcagtgaaaaacttacctatcctaaccgctatctctataaacagttctaagaatatatatttagtatattgtaatttcacgcaaagatttcagcgtgtgatattatatttttgaggaagcaaaggaggaatcaactttgttgatttttctaagcggcaccaaatccatgcagcttgttcagcgactttgtcgccttcttagctcacttaataataacaaaacttaatttagcctttgcgttttaaacaataagacaaatttacagtttattagttttccagctgaagcaacgtattgattccttttgcgtgagccaggaggtcaggaaaaaagtcatcataacattgctgaagatgatctttattttttaagaaagcttcaaatacgggtatgtctttatccaggtattttgctttattcagcacattctgaatactgaatttaattccccagtcttcacggtaattatagagccagtcgtcctgctccattttaacaagcatccttttaaagttttcgggaagccattgctcatgcgcattcaaaacactgtaaacatggagggaatgagccttccattctgccagtgaatgaagggaaaggtctttcgccacaaaatgatccatagaaacatccacaaatgcaccggcatatagtcttaccaaaggagcaaaaacttttttggcttcatgaatagcagggtgggaatctgtaaatgtatcaattgccctatgcagggtaataccatcctgaatatttttcgggaaagaaaaacgatctctgttgcggatgaaatcttcgagaaactgtcccacgatctgcccgtcggtaaaagaaagaaaggaatgcgccagataattcataacttaaaggtatgaattaaatgtgaatgtttggtactggtgaatagtgaatagtgaatagtgaatagtgaatagtgaatccgcttcgcttgtgaatttttatccgcattccaattgactattgaattgcgaagcaatattgacattcataatgtaactacattaaatccacttctctggtaaatttttattcacatttcaattgactattgacttgcaaagcaaaattgaccattaacaatctttagtgaatccgcttcgctcgtaaatttttattcccaattcaattgaccattgacttgcggagcaaaattagccattcactaaaaaagcctctcatgaaaatcttcaatcttgctcacttcttcaatcttaattccgaattttcttttcgggattttattaagattggaaacgaatattttttcataacccaatttttccgcctcggtaattctttgttcaatttgtgctacaggacgtatttcaccacttaaaccgatttctccggcaaagcagtaatgctcagaaatggcaatatcttcattggaagaaagaacagaggcaataacggccagatccagtgccggatcgtctgttttgatccctccggtgatattcaggaaaacgtctttagcacccaattggaatcctgctcttttttccagtacagctaaaagcatattcagcctttttgaatcaaaaccggtagagcttctttgaggagtaccgtaaacggctgtgcttaccagagcctggatttcaagaagcataggtctgtttccttccagggttaccgcaacggagtttcctgaaagttcctcaaatttcttggtgatcagaatttcggaaggatttttaatctcttttaatccctgtgagatcatttcataaatcccgatttctgaagtggaaccaaaacggtttttattcgctcgtaacaatctgaaaaggtgattccggtcgccgtcaaaattcagaacgacatccaccatgtgttccagaacctttggtccggcaatctgcccgtctttggtgatgtggcctacaaggaataccggagtattgttttctttggcatatttgatgatctcattggagcactcccggatttgagataccgttcccggagagctttctattaattgtgactgtaatgtctgaatagaatcaatgatcataaaatccggttccagtttttttgcctcatgaagaattttctccagtgaagtttcagtaaaaaggaaacagttcggattttgaatatccgtaagcctgtccgctctcattttaatctgagaagcactttcttccccggaaacatagaagatttttttcttcattttcaaagcaagctgaagcagcagggtagactttccgattcccggctcaccgccaatcaaggtaacggaacccaaaacgattccgcctcccaatacacgattcagctcttcggaaggagtttttattcttggttcctcactcgtttccacttcaacaatattaattacatgttgtttggtttttgagaaaggaggtgttttatgggaaggtttttccaccacttcttccactaaggtattccactctccgcagtttttacattgtcccatccattgagggtactgggttccgcagttttgacagaagtatgctgttttcagttttgccatactgcgaagttataaaaaagcatttttctttcagaataatctgtttgaatttatattaaaaactaatgtgctgaggtagaaatatctttcatatcttagcttcattcaataaaatattaatgtaaaatattattacaatgaaaaaagtatttttatctttcgtatttacgcttttaagtattgttgcctttgcacagggaagctggcaggtagaccagatgcattcttctgttaattttaatattaaacatatgggaatcagctttgtgcaggggaggttcgacaaatttgacggaaaagcggccacaagtggtgctaatctggataatgccgatttgaacttttctatcagtgttccttccattaatacaggagtggatatgagagacagacatcttatcagtgaagagtttttcgatgttgccaaatatcctacgattgaatttaaaagttcttccgtaacaaaagataaaaacaacaactatatcgttaagggaaaactgacaataaaaggagtggaaaaagaaatcagcgcacctgtgacattcggtggcgttacgaaaaataaagacggaaaagaagtaatgggaattcaggcgaagtttacggttaaccgcctggattacggaatcaaatatgatccgaaaggagctggtattgcaaaagatgtcgaagtagcagcttactttgaattggtgaagcagtaattttccaacgatacataatatatataaaggttttccgctcaaatggaaagccttttttattgccaaataaatttttacgcaggttttatagtcgtttgagctgtgtttttatattttcaaaatgtaaataattgctttgtatttctttttcccctaactttgcacaaacctaatctaatgagtaaaaagaatacaaagtacatctttgtgacaggaggtgtaacttcatctttgggaaagggaatcgtttctgcttctctgggacttctactaaaatcacgcggctttaatgtaacgatccaaaaattagatccttatatcaatattgacccgggaactttgaatccttatgaacacggagagtgttatgtaactgaagatggtgcggagacggatctggatttaggccactacgagcgctaccttgacgctcctacatcccaaaacaacaacgttactacaggaaaaatttaccagactgtcattgaaaaagaaagaaaaggagatttccttggaaaaacagttcaggtaattcctcatattactaacgaaatcaaacgtagaattaaaatcctttcaaaacagaactacgatatcatcattactgagatcggtggaactgtgggggatatcgaatctttaccatacattgaaactgttcgtcagcttaaatgggagttgggagaaagtaattctatggtgattcaccttactttactgccttacctggcttcaagtggggaattaaaaacaaaaccatcccagcattccgttcgtcagttaatggaaagcggtatcatggcagatgtattggtgtgcagaacagaacataaaattcctaaagatcagagagcaaaactggctcagttctgtaacgttcctttagacaatgtaatcgaatgtaaggatcttgaaacgatctatgaggttccaatgtatcttcagaagcagaatttcgatgatgtagttttgaaagcgctggatctgaaaagtgataaagatgctgatcttaaagactggaagagtttccttaaaaaattccagaatcctaagaaaacagttgaaattgccttggttggaaaatatgtttccctgcaggattcatacatttcaattgctgaagctttcaaacatgctggagcagaccttgaaactgaagtaaaagtaagatgggtatacagtggagacatcactgaagagaatatcaaagaaaccctgaaaggagtgaatggtatccttgtcgctccaggtttcggagacagaggaattgaaggaaaagttcttaccgcaaaatatgcaagagaaaataaaattccaatgctgggaatctgtttagggatgcagatcatgacagttgaatttgccagaaatgttttaggatatacaaaagcgaattctatggaatttgataccgctactccggatcctgttatttcgttaatggaagaacagaaaaatgttgtagataaaggtggtacaatgcgtctcggagcatggaaatgtgctttgaaaaacggttctaagctatatgatatctacggaagcaagaatatttctgaaagacaccgtcaccgttatgaattcaacagtgattatcttcaggaatttgagaaaaatggtttccttgctacaggtaccaaccctgaaaccggtttggttgaggcacttgaacttcctgatcacccgttctatgtaggagttcagtatcacccggaatataagagtacggtagcaacaccgcatcctttattcagagctttcatcaaggcttgcgaaaagaaataaggtaaatatttatcataaacgtctatacataaactcaggctgattattgtcagcttgagtttattatatagtaacaacgtaaagcatagagttttgataaaaaaacagtatttttgtcagctcaatttacgtacaccagtatgtatattttaaacgtaaaattttaatataaaataaaatgcaacaaaacaacggaatcgataagaagcagatgattagtttcgcggttttatgccttgttctattcggctttatgttctatttccagaacaaacaagcaaaagaagcggagctgaaagctcaggagcagaaaacggaacaagcaaaaaatgccgtaaagcaaactcaggcaaccaatatcaatccaaatgtaactcctaatgccattcagacagcaagtcttggaaataatgaactgaaacttgaattttcaagcttaggaggacaggtttctaaagtagagcttttaaaatacaaagcctacaaccataaaacagacaatgcggatcagcctctttatctgatcactaaaaataattcaaactacggctttcagtttaaagataaaacagggaagaccgttaatactaaagatttagttttctcgcctactgttaatggaaatgctgtaacgctgacagcggattataatggtgctgtaattcagtttatttatacgttacttccaaaatatactttagactttaaagtaagaactcagggactttctaaaattacttctgacaataaagcagattttatctgggattataatgtaagaaacttagaaaaaggtagagcccaggaacaatctcactcagaattttcgtatgctttcaataattataaagattatgattatgatggaagaaccacaatggaagaggaaaaagaaactcttaactggattggcgtaaagcagcagtttttctcttctgtgattgaggctaaaaacggatttactcaaagtaaaggaaaccaggaaaatgttgaagaaggagaatatctgaagaaattcaactatgaaggttttgttcagatgacaggaagtgaactgaatcaggatttcacatggtatttcatgccattggatttaccattacttaaatcttatgataagaactttgatgaaattcttccattaggctggtcgttcatcggagcgatgaaccgttatttcttcatgtggttgtatagcattatcgctgcgtgggggttatctgcaggttgggtaatttttgtaatgacgattattgtaaaattgattctttcgccaatcatgtataagcagcataagctgagtgcgatgatgaaagtaatccgtccggaaattgatgaagtaaatgcgaagttcaaggatgctgatccaatgaagaaacagcaggctacaatggaagtttacagaaaagccggagtgaatcagatggcgggatgtttacctgcattggttcagattcctattttctatgcattattccgtttcttcccgaactttattgatcttagaggacaggggttctggtttgcaaaagatttaacggcttatgatgatttgatcaagcttccgtttaaagttcctttccttggagaccatttgagtatttttgcattagcttgtacgattgttattttgatttatacggtaatgacctcaggaaatatgcagcagcctcaacaggaaggaatgccaaatatgaaggtgttaatgtatatcttcccgattacattcctgttcttccttaatacttcggcttcaggtctttcttggtattattttgtatcgaatgcgattaacatcttaattatcctggtgattaaatatgtgattctggatgagaagaaaatccatgctcagattcagtctaacaaggaaaagccaaaagcagaaggtaagttccagaagagaatgagagagatgatggagaaggctcaggagcagcagaaagctcaggaacagcagagaaataaaaagaaataattcttaattataatatgtaaaagagcagcaattttaattgctgctcttttttatgtgtgtttttatttagaatcattttaaatttccaatcagactgtgagaatttaataattggaaatcagctgttttcagtcatatttcaatctgaaggattgtctgtgatatatcgttggaccgtgctttataagggcttcctggtgtttttttgtagcatagccaaaattagtgtcccagccgtattcaggatgctcttcgtgaagctgtatcatgagtttatctctgtagtttttagcaataatagatgccgcagcgatagataaaactttagaatctcctttgataatgcactgatgtggaatgtaattatagggatgaaatttgtttccatcaaccaaaataagttccggagttatagtcagtttatccaaagcacgatgcatggcatgaatgcttgcattaagaatattatgttcatcaataaaggaagctggaagctctgcaatagcgtaattttttacattgtccttgatataactatccaattccatgcgggttttgaatgttagctttttagaatcattaactaaattttgttcaaaaccttcatctaaaattaccgcagcagctaccaccggaccgcttaaacatcctcttcctacttcatcacatcctgcttcgatgtaaaggtttgaccagttttttattagctccatgaattgtttctatactgcaaaaatataaaattttgaaggaagttattttatgtggtttttattgtttttatagttattgcgagtataatttactgtttttaaatctttgtgttgaagttatgaattaattttgtttttcatattgatgaaataatatgttattttttggtgagtcgttagttttgataactcttgagctagtttttttttaccaattataaaactttaacgttttttttggttgttttgtgaaagtttcacatatttgtaatctgtaaaaataattgaatttgatatgaagaaactaacgacgagtctacttgtattagtattgtcttcatctgttgcaattgcaaatgctcagcagaagaaaaacgatacagctacacagacaaaggagattgaaggtgtagtggtaactgcactaggtattaaaagagaaaagaaagctcttggatatgcctctcaagaaattaaaggagatcttatttctgatgcgggacaaacaaacgctgtaagtgcactatcaggaaatgttgctggggtacaagttacagcaccgtcttctatgggaggttctacaagaattactatgagagggattagctcagttacgggcgaaaaccgtcctttaattgttgttgatggagttcctttagataactcaaacgttaatagtgtagatactcagagaggagctggaggaagagattatggagatgctacctttgatatcaatccggatgatattgaaagtgtaactgttttgaaaggaggaccagcggctgctttgtatgggtatagagcaggtaatggtgctatcatttacactacaaaatcagctaaaagaggtaggactgaggttcagtttaatagtggagtatcttttgaatcaatctacatcagacctacattacaaaatcaatatggaggtggcttagaatctactttgcctacagcaacaattaatggaaagacgtataatattacagactttggtacagatgaaagctggggtcctaaatatgatccaaatttatattatttaggttggaattcttttgatcctgagtttccaaatgagtatatgaaattgaaaaaatgggtagctcctacaaaagatgttgatgacttctttagagtaggtaccacatacacaaacaacttctctgtttctaaatcttttgaagatacaaatgtaagattatcttatacgaatactaaaatcaatggtattgttccaaactcagaaattaagaaagataattttagtttaaatgttacatctaaattatcagaaaaattaaaggcggatgccgtttttaactatgttcatacagcaggtttcaatagacctgaacaaggatatggagataattctgttgcacagaagttttaccaatggggacaaagacagcttgattttgctgagctaaaggaatataagttacctaatggtatgcaaaggtcttggaatagaacatcttgggataatggtacaccaaacttctcagataacccatattggactatctatgaaaatacatctgacgatacaagacatagattttttggaaatgctggattaacatataatttatctaaaaaagtttatgttgcaggtaaagtgtatggagatacatattcacaaacaataacttcaagagtagctattggttctgcagcattacctgaatataatattcaaaaaagaaataactctgaatttaattacgaaggtagaattcactacaatgataattttggtgattttagtttaaatacttttgctggattcaatataatgaatcgtaagtgggatgtattaaatggtaattctgttggagggttaattatcccaggattatataacttatcaaacagtgttgagccagcgcaatcttctaatgcatcttatcatttaggtgtaagaagtttatttgcctcagtttcattgggatataaggactttttattcgtagaagctactggtagaaatgattggttttctatgttaaatgatgaccagttctatccttctgtaacaggaagtttcgttttctcaaaagtattaaaggctgattggttatcttttggtaaattaagagctggttggtcaagaatcgctggaggttcagatccttatatcagaggaacttatgcaactattggaactccattcggaggaagtccaatctattcaatgcctgcgacaaaaggggagccaatgattaaacctgaattgaaaacaacaaaagagattggtttagaagctagcttctttaaaaatagattaggttttgatgtaacctattatgatgtgaaaactacagatctaatcattccattaccaattgatccttccacagggtatggatttaagaggattaatgcaggagaaatgactaataaggggattgaggctatggtaaatgttactcctattaaaagtagcaacttttcatgggacattacttggaactttacaaaaaataaaaacaaacttgttgagttacaaggaaatcttgagaattacatcttgactaatgctccatttagagtacaacttgcagctcaggttggctactcatatggtgtaatcttaggaactgattttgtatatgatgcaaatggaaataaagtagttgatgagaatggtttctacaaagcttctgaaattaagccattaggatctgtacttccggattataatatgggattcagaaactcatttaaatataagaattttggtttatcattccttattgatattcagaaaggtggtaaatacttctcgactacccatatgtggggaatgtattctgggatgctagaagaaacagcacttggaggaaatagagaagctggtgttgttcttccaggagttaaagaagatggaactccaaacgatataagattagatgctccaacatggggaggaacttactatagtactgtagatgcacagaatgtttttgatgcaagttatattaaattaagagaccttaccatatcttatgatttaccaaaatcaatcattggtaatgctcttcaaggagtaagaatatctgcttttggtagaaatctttttgcttggaatcttgctttcaaaggtgttgatcctgaaaatacggcgtatggatctggtaacattcagggattagaaggaggttcattgccttctacaagaatgtacggaattaatgtaaactttaaattttaaatcacaatgaaaaagatattttcaatattaacattggcaggtttatctctagtacttaacagttgcgcagataaatttgacgaaatagacactaatccaaactctactgaaaacccattaccgacgggattattcaataatgctaataaagagtatattgattataccagagatggttgggtatcaggtaggatgatgttgccatgggttcagtattctgcccaaaggcaatatacggaagaagatagatatcaatacagacttactactggaacacagttatggactagatcatattatgtagcacaggattataaaaaaataattgagcttaacacagatcctgctactgccgctcaaatggcaaattatggtgctaatgtaaatcaaattgcagcagcaagaattatgttgtcttatgtatttttgaatttggcggatgcatttggtgatattccttattggtcttatggaaataaagatgctgattttcaggccctaaatgtagatgctaatctacaaccaaaatttgctagccagcaaaaagtatatgctgacattatgaaggagcttaaagaagctgctcaaatgattgatctaacgaaagatgttttaacaagtggagatcaattatttggtaatgatcctgaaaaattaaagaagtttgccaattcattaagattaagagtagctacaagggtaaaaggagttgtttctggagcagaagctcatattacagacgcaattgcttctggtgtgatgacatccaatgatgatacagttggattaacatatgaaaataatttaattaatccttctcccttcttcttgacttatcaaacaagatctgattttgcaatttctaagacttttgtacaactattaaaaggtcaagtaggaaacttcggtgaagatccaagaatttttaaatatgcttctccaacaacagtgaaaattggtaatattagaaaccaaaatatggttgaagctaccagtgcgagccaaatttctggtatgccatatggtgttcctagtactttagctgctagtcaggcagcttcatcaagtttctttggtgcaagtgtgttaaagcctgcttatactgaagtttttatggagtatgcagaagttgaattcttattggcggaagctaatggttggtcacaaagtcattatgagaaaggtgtgagagcatctatggaaagatggaatgttcctgaagctaagattactgcatttatagcagctcttccagtggcaaacaaagctaatgtattgacacagaaatatgtttcattatttatgcagcctaatgaggcttgggctgaatatagaagaaatggatatccaaatcatttattattgcctgggcaaactgctaatcttaatgtaccttcagcaagtggacaaactacctatacatttacttcacttattgctggattaacagatttaccaacaagaattttttatccaacaactgtacaaactttaaatacggctaactatgaagctgcatctaatgctattggtggagacaaaatggacaccaagttaatttgggataaaaactaacaagatattaataacattcatattataccgccttcgggcggtttttttatttaataatatcattgtttgataattaaatggggtaatatgaataattaaattgaattatttttattaatattttataattatagtaatttttttatgtatgtgatttttttaacttattttttttgttaattattgtattttattgctaattgatgataaatctttattttttttaacatttttagttgaattattgaatataatcgacaaatttgtacggatataaaaataattgatatgaagaaactaacaacaagtcttcttgttttggtattgacttcctctatggctatagtaagtgcccaggagaagaaagatacaattaaagcaaaagaaattgaaggagtggtagtaactgcacttggtattaaaagagaaaaaaaatctttggggtatgcatcgcaggaaattaaggcaagtatgttgtcagatggaacaacaaatacaggaaatattgctgcgcagttatcaggtaaagtcgctggtcttaatgttactacaaataataactttggaggatcttctaatttggtaataagaggagtgaagtcactggcaggcggtaatccgttaatcgttattgatggatcacccgttaataatgccagtacccgggaaaactcaattgattatggtaatgctctttctgatatcaatcaggaggatattgaatctattaacgtactaaaaggagctgcagcatctgctctatatggtgaaagaggattaaacggcgttattgtaattactacgaaaaatggaaaaggtaaagatgacggttcgtggggagttacgttttcctctgcgatacaagtagggtttattgataagtctacttttcctgagtatcagacaaggtatggagccggctattctcagaaatttggaacccaggcttctgatggtttgaataatgcaaactttggagcagatgcttcctggggcccgaaatttgatcctaatttactggtgtatcagtgggattcatttaatcctttgtccccaaattaccaaaaagctactccttgggtagcagctaaaaatggaccgattaaatttttcgaaaatccagcctcatatatcaatagtgtaacgttagaaaaaggacaaaaagggaaaaacatcagttttacttatgaaaatatgatgtctgatggattaatgcctaactcgcacctcaataaaaataatttttccttaaaaattaattatgatctaaccccaaagttgcattcttctttttattctacaatgacattacaggatacaaagggtaggagtattacagggtattcaaacaatattgcgaccggtttcaggcaatggtggcaaaccaatgtcgatattaacgatctgcaaaatttatattttgcaaatgtagatccgcatgtagctaatgcatccaataattatggtaatgttacatggaacagaaagtctgcagcaaatggagcacctgcatattggaacaacccatatttccaggcttatcagaattattcttcagacaaaagatatagaaatttcacttatggtcaggtcacatatgacctgctggataatatttctgttaccggaaaagtttcttatgacaggtcaaatcttatggctgagacaaggttggctgttggatctttaccacaggcttttggattgtcaaataactcaataggttctggatatggaagacgtgacatactgcagacagagaccaattatgacttaatggtgaattataaattcgatattacggataatattaatctttcgggagttgtaggaggaaatatacgtagaaattattataattcaatctatgcttcaacagaaggaggattgatagtacctggaatttatgctttatcaaactctaaaaaggcacctctagcaccggatgaaatagaatacacaaaacagactaattcatggtacgcaacggcatcatttgatttctataaaaaattctatttagatgcgacatttagggtagaggaaacatcaacattactaaaaggtaacaatgtttttaattatccatcaatcacaggggcattgattatgtctgaaattctagatactaaaacatggatgaatttttggaaaatcagagccaactatgctcaggttggaggatctgctgattcttatctgctatataataattacaaatccgccggaattttatccaatcaaggaatttataactctattttaaatcaatcttttccaggtcttcaacctcaaaaggctaatgaatttgaggtggggactgaagcacatttcttaaaagatagaataacagttgatttcgcttattataaaacaagaactactcctcagattcttaatccacttcctacgtctgcagctataggatatacaggtaaagtattcaatgcaggtagaattgataatagtggagttgaagtacagctaggtttggtaccaataaagacaaataattttacttggaatattgatgcaaactggtctaagaatcagaataaagtagtagaactatatcctggaattaataattatctcctgaatagttttcagggaggagtttctctaaatgctagagtaggtgaagcttggggaacattgattggtgctgattatacttatttaaatggacaaaaagttattgatcctaacacaggaaaatatttgcaaaacccaaatcaggtgataggtaatactactccagactggattggaggaattagaaatagcttcagctataaaggcttctctttaagtttcttgattgatatgcgtaaaggaggggatatattctcaacagatatgtattatggattgtcatccggtctgtataaagaaactgctgaaggagacttcagagataaacctattattgtaccaggtgttcttcctgatggaactccaaataatattgcaatatcacctattgataacagtggttctaccggatacaaaacacagcctgcaagtgcatttgtttatgatggatcttttattaagctaagagaggcaagtattggctacatgcttccaaaatctttattggcaggtaccaagatttatgatgctaagatttcaattgtagggagaaatctttggataattcataaaaatttaccatatgctgatcctgaagccatggtaggaggaggagttagctcttacggatggtcaatcggttcaatgcctacgacaagagatctgggtattaatgttacatttaaattctaaattactttaaaaatgaaaaatattataaaaataagtttggtgtctgcatgtattggattagctttaagttcatgtcaaagtgatttaacttctctgaatgatgaccctaaacatccgtcggttcttccatctgataacttactggctactgcattatatcagtcatcttattatatggataaccctagtgtaaatttcaataattacagattctttacacaacaatgggcagaaacacagtatccggacgaaactcaatataatttggtaacccgtaatcagcctcgtaatcattttaacagaatgtatgtttacagtattaacaatctgaaacaagcaaaagtgaatctgatgaatgaggtagagacggatgacatacgcaccaacaaattggcaaccttagaaattgaagaaatttttatttgggaaaatattgtggatacttatggggatgttccttattctgaagctttcaaacctgatgagattttaactcctaaatatgatgatgctaagactatttatcttgacttgatcaaaagaatcgatgctgttactgctactataaaacctgcagcggcaggttatagtgatttggtttacggaggtaatatgactaagtggaagaagtttgcaaattctattaaattaagattaggaatgaatttagcagatgttgatcctgcattgtcaaaaaccaccgttgaatctgcaattgccagtggtgttatttcttctgacgatgacgcttacaaatttaaatatgatggaaatactttttccaatccggtatttgataatttagtagcctcaaatagaaatgatttcttacctagtgaattagtaattaatactatgagcaccctttctgacccaagaatggatgtttggtttaccaaagtagaaggagtatataagggaggagtctttggagaattaaatgatccatatactaaattctctcaattaagttcttatttcagaagtgctactacagcatccaatctttttagttatgcggaagtagccttcttaaaagcagaggctgctgcaagaggttattcagcaggaggtacagctgtggatctttatgctgcagctgtaaaggaatctatgagagagaatggaataagcgatgccactgcagatgcatatgtgcttgcacacccttataatccggcaaactggaagcagtctataggtgtccaagcttggattgctatgtttaataaaggttttgctagctggaactttacaagacgtttggattatcctattcttgtgaatcctccaaaatctaatttatcttcagtgccttacagaatgccttattctgatcaggaatatgtattgaacggagctaatgtaaaagccgctggtgataaaattggtggagataaggctacaacaaagcttttctgggataagaattaacacatattttattaacattcatattataccgccttcgggcggtttttttatttccgtatatttgtacttcaaaattttgacatgaaatgcgggctattacatgtggcctatgaaaaataagtatgaacacatgaatattaaagatattatagagcaaaaactttcggaagttattttaaatgtatatcagttaaaagacattaaactggaagttcaggaaaataaaacggaatttgagggcgattttacaattgtcactttcccgttggtaaaacaattgaagaaaaatcctgaaagcattggggttgaattaggagaagctttgacagaacagactgaactttttgaaagcttcaatgtagtaaaaggattccttaatgttaaggttaaaaatcaattgtttgtggataatttcagatccgtaagtgaaaatttttctacaatagaaaagaaaaacgctacggtaatggtagaatattcttcaccgaatactaacaagccattacacttgggacatatcagaaataatttattaggattctcagttgctcagattttaaaagaggccggatatgatgtaatcaaaactcagattattaatgacagaggaattcatatctgtaaatccatgctggcatgggaaaaattcgggaacggagaaacacctaaaacaaccaatactaaaggcgataaatttgttggaaactattacgtagaatttgacaaaaactataaaaaagaaattgcagagctagtagagcagggtgtagaagaggagcaggctaaaaaagaggctccggtaatgaaagaagctcagaaaatgcttctcgattgggaaaacggagatgaaaaagtaagagcgctttgggcagaaatgaattcatgggtttataaaggattcaatgaaacgtataagagattaggcgttgactttgatcaggttcagtatgaaagcaacacatatattttagggaaagatcttattcaggaaggactggataaaggagtgctgtaccagaaagaagatggttctgtgtggtgtgatcttaccgatgaaggtcttgatcagaagttattgcttcgttcagacggtacttctgtttacatgactcaggaccttggaacagctgttgagcgctttaaagacaacgatattcaaaagttgatttatactgttggaaatgaacaggattatcacttccaggttttatttaaaattatgaaaaagcttggatattcatgggctgatcagttattccacctttcttatggtatggttgaacttccggaaggaaaaatgaaatcccgtgaaggaaccgttgtggatgcagacgacctgatggcagaaatgcatgaaacagcaaaattaaaagctatagaacaaggaaaacttgaaggtctctcagaagaagtaaaagtagcttcttatgaaatcattggaatgggagcactcaaatatttcatgctgaaagtggatcctaagaaaaagatgttgttcaatccggcagaaagtattgaatttaatggaaatacaggtccgtttattcaatatacctacgctcgtacgcagtctttgctggcaaaagcagattaccagtataaagaaatcttggatgtaactttaaaccagtttgaaaaagaactgatcatgcttttggctagctacaaaacaattgttgaaaaagcagcagaagcattgagcccagcgttggttgccaattatgtttatgatctggctaaatcttataattcgttctaccaaagtaatattattctgaaactggaagatgaaaatttaaaacaattccgtttaaacctttcagatcttacagcaaaaacagttaaaaaatcattagctcttctcggtatcggaaccgtaaacagaatgtaaaaataaaatcctcctgaaagctcaggaggatttttatatcatttaatcggttttcgtactaagcaattcggatcacttatttcaaaatccccgaatctcgaattctgcattttacgtcttatcatcgggctcactatgcatctgcctcaaactatctgcatacaacttagccggagtccatcgcgcatgtttggaaagcgtgactttatatccctttttataagtgtaaaccttggtaaattctgcaccaaagaagatcagcatacaggagtaattgatccacatcatgatgagaataactgttccggctgcaccaaaggctgaggtaggttttacctggttaaaataaaggcttaataggaattttccgagggtaaataaaacggttgtcagaaatgcgcctttccatacaggtttccagctaatcaaaacatcagggagcactttaaacattaaagcaaatagaagcatcaccagaccaaaacccaccgcaaaattgacaagttctaccaacatataggtttcaaaaccaaaatattgggtgataattgtattaaacaagctgatcagagaagataaaatcatggtgatcattaagaggaatcccagaataaggatcattcctaaagaattcgctctgtccagtaagaatttaaccagtgcttttttgggagcagcttctacttcccaaagtgtattcaatgaatgctgaagctggaaaaaaagcgttgtagaaccgaaaaccaatgatccgactcctaccgctttcataaaaatattttttttgtcaatcaaagcacccgccagcattccttcgatactttttgccacatccggtcccataataccactgatctgggtactgatctgtccgcggatggcttcttcaccgaagaaatttcctagcacccatataataatgatcaataatcccgggattgaaaagatagcataataagcaagacttgctgaatctttagatgcagaagaattgttccattctgtaaatgtgtctttcagaacctcccagaaaaattttgcagttttgatcatattaaaaaggatatccgatggcaatatttaaaacaagattatcttttctccagcttggatctccgaagttaattttatcgaaggcccatctgtctcctttctgatagtaaggaactctcagtggcattgcaagatccagccttaagatcaggatagaaaaatccagtctcagacctactccggctcccaccgcaatttcatttaaaaaatcttttgaaaacttagctcccggtctcgtggaatcgtcatgaagcagccatatatttccggcatccacaaaaaaagctgcatttaaaaacttataaagattagcccgatattccgcatttaattccagcttaacatctcctgattggtcaaaataagaaccttccggtatggttctcggatcaaagctccccggtcccaatgttcttgcacggaaagctctgatactgttactccctcctgagaaaaattgcttggagaaaggtataaactctgaatttccgtatggataagcgattcctccaatgaatctcgttgctaatgaagacttttcagtgaacttatgatagaacctgaaatcattttcaatttttacatactggctgaaaggaatcccaaatattttcctttccttatctttttttacatcggcacccgtaaccaatcctgtaatatttcctgccagatcaagtgtccccttataataaatggtattggtcttaggcagcatagtgttggtataggtgtaagagtaggttggaccgaaaataagctgttttgcaacaactcgctgcatagcaggattgctggcagacttaatctcgtattcttctgtaacatttgctggagaaaccaaagtaatatcaatcactttaagatcatgttctttccttgcattttctttccataaatatccgaatgacccggtgaaattattaagcgtgtaatactgggttctgttttggaattcatatcccaatgtgatattggttctgggaacaaactcactggaagaatgaaaacggaaaggtgccacaattctcggaatagaaagctgtacattcgttcctgcacggaaaatattattcgcattctgagcgcctcccatctggaaatcaaaagccccgtagatcgcagctttaaattgttccgcacccctgaagaaatttcggtgggtccagttaaggtttaattcactacccgcatagttggcagaattggttcttcccaatgcttccagacgaagggactgaattggtctcggggttaataaataataagcatcaaatttgtgacttaaagaatcagatacgataaactcattctttacaaacttgaaaacacccagactgatcagccggttcagggtaaggttatgattggaacggttatacagatctccctgtttgaaatataaagctctgtcaaaaatctttggtttgaatttatgctgtggatcaattacatatatatcatcgaaagcatattttgaaagagaatctttattcatagggatgctgtacttaccgtcttttacatcctgaatattgtagttgggaaatacaatcaccttatcaatactgaattgctgagttgctaaatccggagtattgtctttcagttttacgttaagttcaaccttatggtttttgcttaccgtactgtctgcctgtacaataatattatccggatggaaataataaaagcctctttcctttaatctgttatcaattctttctctttctgctttaatgacatcaaggtcaaaaggtctgccgtttttgagaagggttttatcggcaaaactctgaatttcatgattgaccaatgtagaatctttctgaaacttcactccatcaataaggtatcgtgaacctggtctcacggtatatataacctgagcctttttattttttgaaaccgtatcataggtagctttagcattaaaatatcctttgttttcagagtaattttcaataatatctttattgaattctctgtctacatcacctaataaaactggtttttcacccactttatatttcagccagtaattaaaacctttgtcttttttaggctctttggctatgttatagaaatacagctttgggcgcattcctaaaaatgtagaattgggtttgggagttagattcgcttccagtgcagactgcaattcttttttttcctttttcgaaatcgtatcgttttcaatctttacttcagctcctgtgtagagcatctggccctctttcaaaaacctggtattgctgcacgaaatcaccgttgatgccattccggaaaccaacagatacttacaatatatatggaacttattactcattatttaaattctaccacttggttattttgattctttttcggttttttctctttggatttctggaaaatctcccggaatttgtcataatccaacgtaataataaatccgactccggtttctatgatctgcccctgaagagctacctggtattcatccttacgataagcacgcagcatatatcttccatccttggaaagactgtaatctacagaaacattccctgcaatattggtcatgttttcattctgacgggcctggccttccagtccgaagttacttcccaccgttactttcagtcggtcattcagtaactttttactgatatccacattcagatcggttctcgtatttttctccccgctggaataatcttctgaagaatcaagaccaaaattaagatcgactcctttaatcagacctgccgcaagattattcaattgctgagaaaggattttgctcacactctgtcttgccatggtctccgcagacattcctgctccgctttcaaacggattttctcctataaaacggttcagaagcaataaggcaaatacctgcttattcagttctgattcctgggttctgacctgaacgagtttctggtcaataatatcttttacattggtggacacggcattatttttttcatccgtggtaatatcgaaagtgagctgaggtttcaatagttcacctttcattttcaataacgcattgaaaggaaccctttgtttaaactgattgattgtggaggcactttctccactgatctgctgttctacaaggtcaataggcggagcttctgttttgtaaacggctgtaatatccatctgagccattgtaggttcaccggtccaggtaatagtacttcctttctggatgtcaaatttacgtttcaggaagctcacagaaagatcatagcttcccttgtccacttcatacactcctaccagtgtggtttttcctgacggatctattcctccggttaattctgcctcgccctggagctgtacaaaatcaccattggctttatcaataattaatgaaagttttgcttctttgctgacctcaatattaacacttacatccattcctttgatacggctctgtgcattaagtgtgtctgctttaattgttttattcaaaactacctgatcctggtctacaaactctacaatgccgtctctttcctgtaaagaggggctggattgtggaagaacaaaagtgaaatccgtattgtcagctacgcttaaccttccgtctacttttggaagatcaagatttccacggatatgaagacctgcatcaatggcaagaataccatacataatcgcatcattggatttttcagaattaaccactttaaagtctttggcattaacattcaggttaaaggcaaaatctctgtacgtctgggtaagaatctgcccatccataactagtgcgttaccgtctttatcttttattttgaatttgtcaaactcaattccacggctggtaaaatctatttcatcgctcagatgtctgaaatcacttcctgttttggcaatttccagtccggcatcattgaattttacttttcctaaaatattcggtttatcactggtccctgtaatctttaagtttcctgaaagatagccttccgtattggtaatcgcgttcatggagaatccctgaatactcttcatctgaagctggttgatcgccatattcagatcgaaagtactggatgaggtattgtaatctcccaggatttttacatcattgttatttccggaaagagcgatatcggcatttaaaatattcggtgaagcattgttcacttttactgcaagatttccaacaggacttccatagacaattaaatctgaaatattcaagtcagaagtgaaggtcatttttttagtcacatcacgaagctgagcggttccgttaatagttcctcttgcaagtaccgtatcttttttaataagttccgtaatggtttcaatcttaaaatctttcaacgaaatatttaaaggactgctggggttgttgttttccgactgaacagcaatttcactgctcccgttagataaaataaagttatccgccagaattcctttgctgctgatctgtattttattgttttcagcaacattccagtcagtataattcagttttagaccattggggttaagcgatatttcggtaatatcattcaaggattttgcatttcctgcaatcagaaaccgggtggcatccttttcatcttttgtggtgacattgtatcggattgtgttattggcaacatctccatcaatattgattttatttaaagaaaagcttgagctttttaaggccgcaacgttcaggctgtactgcagcgcctgattttcattcgtaacttttaaagctcctttttcaatagaattttcaccatacaataatcgcggaatctgtccgtcaatttcaattttctgagaatcggcatcatagtttccagccaaatttatggtttcaaaatctttcagatccggaacaaattttctgatcaggtcgtcatttttgattttggccgtaaaggtaaaatgctgccccggatcaattttctggcttttatcaggtttctggaactgataatactgattgatagtttgcgttaaagctccaaaaatctgagtgagcttatattttcctttcaattctgcgtcagcaatctgggaattgaaaataatctgcgtggaatcctgagtagatgatgctttcagattgacttcctgtacaggatacacttctttggtatctgaaaaagcaaaatctttaaggtttagatatccgttcagattatttggatccagactggtgaaatcaccatcaatttttccggcaatgatcattggtttttcatagaaaccaagtttattgacatccagtttgatgacttctccattcacttttaccgttggatttttttcgttataaacgcctgaagcagtcagttgtaaacttgcatttggatctttggagtccaaaataacatgataagcccctttgcgaatctttccggtaagattcatgttttgataacggtaccctttgtagacagcagaagctacgtgtccttttaaatctgcattggcgtttttaaagtcaaaactttctcctttcgctgcaatttgagcagtcacagggccaatatctttattctgaataatttttcctacctgtattccctgaagattggcttttatatcatacagttcgtgattctttttttgcatgtctacctgtgcgataatggctgcatttccgagagtagagtagagattcagatcggtatttacgacctttgtggtgccttttgcatttcctttgatgctaaagtgggaaggaagcgaaatattggatggaattgtatttttagggacaagattgaatatcgttttggcactggaagaaaattcggcgattctcagatcataatataactgattcggattcatcgcattccttatttttccggaggccattaccctcagctgatccagcccggaaactttaagatcctgaatcaaaagatcattgacgctcccttttatattagcattgacattaaggatagcattcggatatttattaaaaggtactgtatttcttaaagtcggagccagattcagaatatctgaaaatccgattttggaatctttgatattggctgaaattttcacagcacctgggtttgaactcagttgatcaatagagttataatttaaaataacctcatcgcgcaatattgttttcggagtttgcagataaaggtctttgaggtaagcctctttttcagcatatacaaaatccgtattgaacttctggatatccagacctctgccttctttaatctctgcagaatttaccgttccggcaaaagtattattctccattttaaagcttctcacttccacattcatttttgaaaaattaaggtggttgaagtcaattccctgtttggttggagcaatggcagtattattataggttgcttttacatcattcaacacgagctttcctaaaagaagtttcatggccttatcctgatcggaagctttggaaacctcaggttcttttgtgtttttcggattggcatttttagcgggaagataaaggttggcattaatatctgccccggaaaggaaaatattcgctacgttgaaaacgttgttttcgagatccagtttattaacctttgtgcttagctctttaaagataacttttgcaaatgttttggtattttcatcaccgtaatcaatattgaaatgggtaagcttaatgcctctcaatccaatattcatcggctttttttcattgagggaatctacttttttctctacctttttggcaacttcttctacaaggtcctgctttagctttaattttaatccgtcaagattaatatcattgacagcatagttgtttttgttaaggtcaaaagtttttacccttgtatcgaacgatttaaaataaagctgaatatcgttcttcgactgctggtcgttgaaggtaacgccaacatcttttaaattgattttatcgagagaaataataaaaggtttggaaggactttcctctttatcactggtcgcaaaagcatcgataatataatcaaaattgaatttgccatccggtttccgtaccacattggcgcgggctccttccatattgacggatgtaatatctgctgtagaattgagaagtttcaacatgtgtaaacctacatccagttttttcactgccagaagggtatcaacgtcctgtcctttgagatagaggttttccataacaaggctattaggaaatccaatgtagactctttcaaggcttaccggagttttgatttttttctccaggtaaacaataagtttgtctttgatgaaattttgaacggcaggaagtcttaagcttaatatcaacagggtaagaagaaccaatattgaaataaaggttattgcaatacgccttaagagttttgtggtgttgattttcagtttcaaatgcgatgtggtttctaacaaagataataatactattttatttggtctttgttgtggtacccttttgcgtatgcaaaaatcctgccttgaccgtctttttatggaatttttagtttgtagttgtcaagtgaatagttgagtaggacgaaccaaggcaagaattgttattgtaaaaaacgccccctttttatcatttttttaatgttgaaaaggttagttagcaaaaatgaaaattcaaatgttagtgtattaagggggcgtggcatggtttataagatagataataaatttttttattcatttccgttttcccattttacctcttctccctgaggagctgctccgccttgtgcggttgtaataggagcagtttcctgattgatatggtaaatgtaagcggcaattttttcagcatctcttccggtaatggttccttccttgatgaaaggtctcatggtaggattgttgggagaaccgttttcaagcatccagaaaacatttttaaacaagcttttttctttaatattaatccagtgagtatcggtaaggttgggaccaatgccgccttttcctccgtctccgtggcaggtaacacaattcgttttgaaaagttcctgtccttctgcaatattatcagcactgtatttggcagattccagattgatctgcggggcacttttttcatactcttcaatggaagctaacatggtttttgcctccttggtatattctacatcaggatgggcgtaatctgtaaaagagaaagctacaagatataccgcgcagaagatgcatccgaaccagaacagaccgatccaccattttggaagagagttgtcaagctctgtgattccatcgaaaccatgatcgataaggatatctttttcttctgtagcggtttgctttttgaaggctgaattccataacttctgataataaggaatctttttttgctccagatattgttttttctcttcctctgataatctgctgaaactttcattctccaccagatctccaatggagttcatgatcagcagaaggataacagcgattaatatcagtgcccagaaaaaaggagaagaaaaatatcctgaatctccggcgaacatttcaaaggccatgatcgttaaacctatcgttgttgcgatatatactgaaattggggttctcgttttcattgcaatacaattttaaatgttactctacgcttgcggtttgtacctgtgttgttttgatgtctgtacctaatctctgcaggtatgcaatcatggctacaatttctctctgctcaagtggtacataggcagatccttttgctgctttttcctttgtcatctgatctttcacgtcggtagcttcagagtagattctttttacaattgcttttgactggttgtctgcccactgattggcagaatcgatctgagcttttgtatagggaacatcaaaagcatttttcatcagcttcattttatccaccatttgtgttttatcaagtttattggtaattaaccatgggaaacgtggcatgatagaacctgcagatgtaatccttgggttatacatatgtttgaagtgccatgaatccgggtttctgcctccttctctgtgaagatccggccctgttcttttcgatccccataaaaatggcctgtcatatatgaattctcctgctttggaatattgcccgttttttccttcaaatcttaccacttcatcacggaatggtctgatcatctgagagtggcaggcgttacatccttcccggatatataaatctctgccctcaagttccagtggagtataaggtttcactgcagtaatggtaggtacactttgcttaagggatagtgtcggaacaatttccaccagtccgccaatcgctactgtaatgaaagctaatattgaaaggagagtaggtgttctttccagccaaaggtgtacgccttcgccttcttttcttgcgcttccgatattggccagtgcaggtgcttccgccggaacttctttctggaatgagcctgccttaattgttttaatcacattaacaaccatcagaatagctcctgaaatatagaataaccctcctaagaatctcattttataataaggaataacagcggttacggtatccagccagtttttccataacagtgttccgtccgggttgaactgtttccacatcaatccctgtgtgaaccctgatatatacataggtacggcatagaaaataattcccaatgttcccagccagaaatgccagttcgctaattttacagaccagagttttgttctccacatgatcgggatcaggtaataaacaattccgaatgccatgaaaccattccacccaagggcaccaatatgtacgtgaccaattacccagtcagtatagtgaccaattttatttaatgattttgttgctagcagaggtccttcgaaagtagccataccatagcaggtaacggcaactacaaagaatttcagaataggattttctcttactttgtcccatgcccctcttaaagtaagaagaccattcagcattcctccccatgatggtgcaataagcataatggagaatccggttcctacggcttgagcccatgccggcaaagctgtatattgaaggtggtgaggcccggcccaaaggtatacaaagatcagcgaccagaagtgaataatggataatttgtatgagaataccggtcgctgagctgcttttggcataaaataatacatcagacctaatacaggagtggttaatacgaatgctacagcattatgcccgtaccaccattgtactaatgcatcttttactcctgcatatacagaataggatttccagcttgtgaaagataacggaacttcaaggttattgaagatgtggagcatggctacagcaatccaggttgccatatagaaccatattgctacatatagatgtcttactcttcttttagcgatagttccgaacatgttgattccgaaaatgatccatgagaatgcaattaggatgtcaataggccattcatgctcggcatattctttagacgtattgattcccataaggaatgtaatcactacacttacaatcatcagctgccatgaccagaaatgaatccaggaaagggtatcactgtacattctggttttaagaagcctctgcatactgtagtaagcaccacagaaaaaggagttacatacgaaggcaaaaattacagcactggtatgaagcattctgattcttccgaatcccatagctccctgtgtattgatcagtccctgaatattacccgaagccaggcttttaatagttgtatcatccgtaccgaataaaaattcaggcaattcaggataaaaaagcatcaatgcagctgtaagccccagcagaaatcctacaagtccgaatgcgatagtcgcatagaggaatgctctgacaatggtattgtcataattaaatttttgcgtctccataaattccaataatgtttaccgaagtgatatttcctttgaaaaaggtttatttttaacctttttatatgttaaaagtaaatatcatgtaacgtgtataatgttttgccaaaggtatttattaactttgttgaaggctaatagataatcttctaaaatataccgaaaactactaaaacagaaacgatgaaagtatgtggacaaaatatcagaaaaatacgtaggagtaaagatcttacgcaggagtatatggcctttgaaatgggaatttcccaaaaggcttattccgatattgaaaattccaaagtgaagatcaatctggaaatactgactaaaatatctgatattttagagatcaggccatccgatatctgcagtatttctcataagtgcggaactgatgcgtttgaagataaataccaaagccttctggaatatatgaaaaagaataacatatcaattcccaaagaatttctataagctgtaatattatcttttaaaatataaaacaatgatctccccggacagagggagatcatattttttgcgaacaaaaaagactgtgtttctagcgtgcctgatgaccatggcattgatgagggaacaaatatttggtttttcaaatttattataatcaatgtggtattaataaataattatgtagaaaaaaattcacacaattgtggataaatatttacaataaatttaattttgtataatatatttgccttaaatataatgctggccctctgaatgaagcatctctactttatttcacttctattttttttatgtgtcaacggccaaggctatacgacccaatggtataatatggacaatggtctgcctcaaaacagcatcaaagacattgtaaaggacagatatggttttatctggctgtccatggaaggcagaatcatgagatacgacgggagtaactttgtacagtataataatttcaagcttaaaaatttaagttttggagatttctatggcagtataaaaaaagacagcatctctgtttttaacacttctgacaaaaatgttcttttaatttcacgtcgaagaccggatattatagctgccaataatacatttgagagtagagaagttttgaaaaataagatctgtaaaagaattgtaagaaatactctcacgaccagatatatatcttattatattaattcctattatgttcagttggatgaaggaacctattactttgaagacaacaaaattgtttatgttgataaaataagtaagaaaagaactatcattaccgttggtttttcccatgaccggttgaaaaaaatgtttgttcacggcgaatctgtattcattagtgatccggcccggaagaaaataatcaggttatacaaaggaacattatcagagatagaagctgattctatttatacagatcaggaaacgagaatgtactggcagcaaatttccggacaggtttttattattaaccgtggtaagatatacagaagtgaattctcagcgggtaagctaaaactcacttttttattggagtatagggacattgataaagacatctccggggctatgttttatgatgaggtggcaagaaaactctatatcggaagttctgttaatggattgaagattctgagcctgtcagatttctcggtttccagaaaaaatctgccctatcaggatgaggtttgctatgcggcaatttcttatggggacaattctgtgctgacacaggaaggaataaaatattcccgcaatacttcagaaagggtgttttctgctccccaatcctatgataagaggtacatattggaggataatgtaggaaatcttatatatcgcgaaaataattccattcatataaggtataaaaatgccggattttcaaaatatgattccatttcttttcaaggtaaagagattgacgggctttataaagatggaaatctgtacagtgcatccatcgtagataaaaatcagttttatctctatttgtttgaccacgataattttaagaaaactgaaaaaattattccatgtgaaaataatatagatgctgttttcagatatgataaagacctcctctatctgggaagcagcggaggaatttatgtatactctttttcccggaataaagtgataaagcagataggtaaaggccttcctgtaaaacaaatcatcagaacaaaagatggaaatatctggttcacgacttacagcagaggaatttatctgatgaaagatcagaaagcagtcagagttccttccgataaaaataattttctgacgaatgctcattatctgttggaagatcagcattccaatttatggatatcttctgataacgggttgttcatgattaataaagatgatctcctgcagtacatgaagacatcccggggtgcggtcacttattaccggtatactaaaaaacaggggcttttgaataatgaattcaatggaagtgcaaacccttgtgctcatgtgctgaaggacggacaatttgtatttccgtctatggaaggatttgtattttttaatcccgcaaatatcagcgtttattatccgggcaggaaagatatttatttggaaagagcaaggataaaaggaaaaatgatccagctgaaggataaactctttctggaatgcggatataaaaatgcggaactttatatagatattccttattattctgatcttgacaatatctatcttcaggccaggctttcagggagtgaagacagtcgatggattaacatcaaaagtgatcggatattccggttagccaatatagaacccggaacttacaatcttatcattcggtttttatcttccgaaaccgggaaattcgtatataaaacacttccggtagaagttgaagcttatttttaccaaaccgtgttctttaaaatcctggttgcaggaattattattttcgttattctggtgatcgtgcagatccggactaattttttaaggctgaaaaataaagtattgaaaaataccctggaccataaagataagcaactgctggaaacccataataaacttaaaaaccaatccgattatcagaaaaagctggtagaaagtatcagtcatgatattacaactccggtaaaatttattgcacttctctcgcaggagctcaaccagtctgaagatccgaaaacacagaaaaaatattttgacagcatttacaaaacctcagagcagctttataaatttacattaagccttaaagaatatacggaactgtataaacaggaaaatacagagaatgaagaatattctatctatgatcttattgaaaccaaaaggttattgtttgaagaaattgcagcccgtaaaaaaacatttatctacaacttctgtgatcatcagctgaagagtaaacttaataaaaatattctcctcgcagttttccacaatatcattgataatgcagtgaaaaacacttcagacggagaaatcatcattacatcagcctctgcagaatcccatatcgaaatcaatattgctgataccggaaccgggatgtctgatgaacagatgacctattattccggattgtttaagaaaaacgagaacgaacatatgatctttaaaaattatggtttagggcttcatatggttgttcagctgataagaaagataaattctgaaataacgtttcataaaaacactccgaaaggaaccctcattaaaatccttattaaaatatgacaaaaaaaatactcattgcagatgaccatcatgtggtaagaatcgggacagctttgatcctggagaaaaattttaatgatatagaagtagattttgcagaaacttatgacgaagcaaaacagaaaattgaatccggaacattcgatctgcttattcttgatattgaacttcccggaagtattctcaaatcaatggtcaaagaaataaaaagcatttcaccggaaacatttattttgatctttacttcctataaagaaaatattgcgctgcaatatattgaagaaggagcaaatggctttctcaataaacagagtgaccctgaacattttgtcaaagctgttgaagttatatttaaagacggatattattatacttctgagatgatgaatgagattttaaaagggaaccaaaggaaaaaagccattgaaaatctttcagagagagaactgcaggtttttaatctccttgcaaaaggaaatgggaaccttgaaattgcaaacacccttaacatcgaagaatctaccgtaggaacctacaaaagaagagtctaccagaaattaaagatttccaaccttgttgagctgctggaaatttacagcgagattcattagagcaattttcttaaagtcataatatcactacagttttgtggaaaaatacgtacagtatctgttccttatttactcatttttcgcagtaggttagtgcttcaataaattttaaaaacaatttcaatgaaaaagatttatgttatgattttagggatttttgcgaacttagccatcgcgcaggttggggtgaatactccaaatccccagggaatgtttcatttagacggaaagaaaaacaatgaggcatcaggtcctgtgagtcccgctaaccaggcagatgatgtagtaatgacgtctgatggccgcataggcatcgggaataataatccggcggcaagtttagatataaagaccgcaggaaccttagctgttccggtatcaggaataaaaattgcggatggcgcacaaaatgataattatgtcctgacttctgatgccaatggcaacggtttatggaaacctgtaaggcttaccgttgtaagaggcaccaatggacctggagtagatattccttttacatttactaacgcattcagttatacaggatcttatatcgatttgcctcctggaaaatggctggtaactgtgcagcagcttattattccaacaggagctgtgttaatcagtgatcaatggatgtggctgagaacaagcttttcagatcagcccaatattgtacctggagacgtggctgatatttcaggagatatttctcaggctccggttttggtaagcgggcttattcaagggccgactgctccaacgcttacaagattttctattattcagggaagtctggtgatcaacaattcatccggtgctgtaaaaagatataaatatattgcaggaaataatgtaattggtggtgcacagacaactgctacctattttcagggatttggaggaaacttttccgaaaatattatttatgcagtcccaacaaattaaacgacaattatcaggattaagctcttaagagagaaagatcaatgattttatatagtgttcagataaaccttggcaaattgctgaggttttttcttgttggttctactgtcaattcccaatttcgcccatggaatgtgaatttctctgaaaagtttttatatatttagcgaccgaataattcattcaatgagcaacgaaaataaaacaggacaaaacgagaatttagttagaggattaacaaaccgacatatacaattaattgccctcggaggtgctatcggaaccgggttattcctgggaatcgggccggctgcagtactggctggaccatccgtaattttaggctatgctttggcaggtatcatcgctttttttattatgcgtcagcttggtgaaatggtagttcaggaacccgtatcgggaagttttagctacttcgcgtacaaatattggggaaattttccaggatttgcttcaggatggaactattggattctctatattctggtgagtatggccgaacttacggctatcggacattatattcatttctggtggccggagattccgctctgggtttccagcttattcttttttgtagtcatcaatgcacttaatttagcttctgtaaaggtatatggagaaacagagttctggttttccatcatcaaggtagtggctattattgcgatgattatttttggtgtatatcttttaataagtggtactggaggagaaaaagcgagcattaccaatttatggaatgacggaggattctttccgaaaggattatttaataaaacagaaagcggatattcaggattatttgcagcaatggcgatgattatgttctctttcggaggactggagcttattggtattactgctgctgaggcgaaaaacccggagaaaacaattccgcaggcaaccaatcaggtgatctacagaattcttattttctatgttggagctttagtaattctgttttcattaagcccttggagagatattacagaaggatccagcccgttcgtaatggtatttcaaaatctgaacggtcttgagttcagcctttttgggaaagtgattcagttcaatactttgattgccaatgttcttaacctgattgttttaacagctgctttgtcagtgtacaacagcagtgtttacagtaacagcagaatgcttttcggattagctcaacaggggaatgccccgaaatttttgaaaaagctgaataaaaatgctgtgccgatcaacgcaattattgtgtcgtcatgctttgcaggaatctgtatcatcatcaataaattagtccctgaaaaagcttttgaatatttaatggcgctggttgtatccactttgattatcaactggctgatgatatgctacacccaccttaagtttaaaaaaacaataagcgcagaaggaatccattcaaaattcccatctattttttacccggtatctaactatatctgcattgcatttctggttttgattttaggattaatgagtattacaggtatggaaattcaggtgattctgattccggtctggctgggctttttatttgtgatgtataaattatacaaaccgaattaggagttaaaacaatatttgaaaaggtgaaaatcatttgattttcacctttttgtttgtggatagtagtgaaattaaacttttaagagaacttcagataagaacaattcgggaggatatcatagtttttccaacttattttttgtacattagtaacaggttatatttcaaattaaggtgaaaatttacatctgatgttgaaattcctgcggacgaaccgaacaccgcatcacaaagtaggcagaaccaaaaaagacacctatggccaatttatttcaaacccttaccaacactgtaaaacattggtatatcccgttaatcttcggaattctgttcctgatctttggtttttatgttttcagtgtaccgcttgcaacgtatgtgacactttctatctttttcagtgtttcattcttattttcaggcattactgaaatattcttttccttacagaacagcaaatccctgcagggttggggctggtttcttgtgagtggattattaacaacggcaataggaatttatcttatcgcaaaccctcagatttctatggcagtacttccgtttgtcatcggatttacattgttgttccgttcttttcagctattaggttttgcctttgacctgaaaagcatgagaataatgagctggggaaatgtagctcttgccagcgcgggagggattatattttctctattgctgatattcaatccggtatttactggaatttccttggtaactcttaccggtgtttccttcatattcatgggaattgcttccattatgctggctctggatttaagaaagataaaaaagattccgggcaaggtaagtcaggaattaagagaccggatcaggtcgatacaggaagagattgatgaacttaaaaaatagtaacgtattatttcaatataaagaccttgtgaaaggtcttccagattatcgatcttaagaactacaggagctacgggagtaaaacaaaccataatgggtataaatcctaattttaatagtaataatgatgtgtttattatttctcatattcctggtggaagtgattggtcaatggacttaaccctgggtaatataggtgtcgttaccaatactcctaccaatactttagatgttgcaggcagtaccagagtaagaaccatggatgtggcagcaggtgctacccttattacgccggtatattcagatgccaatggtgtcctgaataaagctgttgacaatatttatggaacggttattaataacacaattaccataacatcaggtgctacaaataccttgattgcaggtcttgccaataatgcagtatataaagctgtgatcaacgttagtaatagttgtgggcgcattgttattgcagaatattatgtcactaataatgctattagcaattccttctcaatcaatggaattgatggaattttaaacacagataccactgctaaagctcctaattttactgaagtgaacagatttacaacaaccgttgtttggtcaggaatcccaaattgtgctgcaggtgggactaatattgcatttaattatacattaacaatgccttccgccggaacaatagatcttaccaacaatggtgatgcaagcttacagtataaagtgatacttacaagattattttagttttatagaattcaaaaaaatattataaacaaaggctgctttcatcatagagggcagtctttttaatcattatataagacaaatacctaaagttttgatgaagttggttgctgtccagatgtatacattaaaaattggatagatatacatattctgctttccaaaattgctgtaatgtataccccagatagaatagataaattgaagttggacaaaaaacaaaaaccacccttaaaaaggatggtttgtagacccacagggattcgaaccccagatgactgaaccaaaatcagtagtgttaccgctacaccatgggtctctgtttgttttagtggtgcaaatttacagcttttttctttacttacaagaaatttttgaaattttttttaaatttactgtagaatttatttacggaaattatgctgatagacttcaataatctcaatattaacaaattatcattcgatacagaatttgaaaaaaaagtgaaaatatttcttgaagaatggttctcagaaaaaaccggagtaaatgtccagacttcaggctctacgggaattccaaagatttttgaaattgagaaaaggaaaatggtcaattcagcagtgatgacctgtaattttttaggattaaaagaaggggatacggcattgctttgcttgcctgtggagtacatttccggtaaaatgatgattgtccgttctatagaaagaaaactgaagttaaaaattactgatccttctttaaaactgacagaaaatctggaagaagaaattgatttttgtgccatgacaccacttcaggtagaaaattccctggacaaacttcatctgattaaaaatctgattatcggaggtgctgctgtttcagaaagcctgaaaagcaagatccttaagatgaaccttagtaattccaaccgtatttttgaaacctatggaatgtccgaaaccctttcccatattggtttaaaacaattgatgccggagcaggaagaatacttcactgtttttgaaaatgtaacgatttctctggacgacagaggctgcctgaaaatttttgcacctagtgtaaatgctgaagagctggaaactaatgatttagttgaaatcaggagtggaaatcagtttaaattccttggaagaattgataatgtgattaactccggaggggcaaaaattttccctgaaacccttgaagctttagtgaaaaaggatattccgaacgaagcaatatttatgggactgccggatgagagtttgggacagaaattgatattgattattgaaggtgaggaatctgatgaggtgaaaagtaagatttcagaaattccgtttgaaaaaagcttccataagccaaaagaaattattttcatcaaagaaatcccgagaacacccaacgggaaagtaaacagaatggagctgtataaaagtataaatatttagccaaggttattgacatcggatctaaaacgtaaagaaatgaaagacttttcaaaagaactcagtttcaagacgtcccgaagtagtggggcaggagggcagaatgtaaacaaagtagaaactgctgtgaccgtactttggaaagtgaatgcatcagaattttttaatgaagatgagaaaatattaattcagggtaaactgaaaaacaggatcaatgcagatggttttttatttctcaccgtttctgaaagcagaacccagctgatgaataaaaataaagccattgaaaaaataactgaaatcgtcaataaagccctcatcattcccaaaaaaagaacggctaccaaaccttcaaaagctcaaaaacagaaaagactggacagtaagaaaaagctttcagacaaaaaagaaaacagacgtttcaggttttaatgtgtttttccagagaaaactctatttttgccggaaattttaaaaccatgataaaaaaattaatcacacttggagtattctccatttccatgatctcttttgcacagaaattttctatcagaccttccgtaggatatgcctggagaacagcaaaaacaatttccggacttagcaaagaagaaaaagactacgttaaagaccttaaaaacgggttaaattttgatattgctgcgcattatgctgtgaaagatggccttgcgtttggcttgaaatattctaattacagtgcatcaagtgacggatatcttcttggttatgtgaacggaatgcctgtgtctgttcctgtgaccacaaaagataatatcacattctttggagtttccggccttatttcaaatgataattcatccacaagacataaaatatttgcagatcttgcgctgggggtgatatcttacaccacaaaaacaggagatgtaaaaggaacagggagtacttttggtgcagaaatcgattttggctatcaatatgagatcagcaaaaacttccttatagggccaaaggttggcttaagtggcggtacgctgagtaaaatgaagtacaacggagttacttataaatttgatgacgatcagaaagaaggtttgcatagggtttctttgagtgcagctgccacattccgtttttaagtgttatatttgtagtaattacaacatctcattaataatggcagcaacaatttctttatcagcagaaagcagacaatcaggattgttgctgtcgttactttatcttcacacagattcttttctgaaaagttctaaggactttatcaattaagccctgtcaggatccaaggcagggaatcatttcggattttatttattattttttgcggttttctatagaagaaggctgtcttatgtctgtattctacattggattatcggggaataactgcattttaattttttaaaaatgaaaaaatatgtccaatcatattattgtaaccaccggaatttatgatgctataaaagatacactgagaagaaaaaaagtgggcatcgaagaagaaaaaagattgactgaagaactcagaaaggcaaaacaggttctgagaagggaccttcctgctgatattgtaacagtggacagaaaagtaacgttgaaagaccatactctgaattttgagcatgaatacatttttgtgccttcggtaaaagaaaaacttaaaaagaataaatattccatcctctcagatattgctcttgccgtagtaggatataaagtaggagatgttatcagctggcctttcagggacggagagaggaaaatcgaaatcctgaaagtggaaccctgggaaggataatccttactgaatatttttaagttgaatgataataaagcgtggctcattttgggtcatgtttttttataaatagaaacttctaatgttgaagtagaggcactagttttttacacactctaaatttacttttatcagagataaaatctttgcaccttcaagcataaatcatgttggagaaactagcgtccttgcgtttccgaacaacaactatttaagcatttcatttaacaaatgataaaaaaagatgtctgtattacactttcttcaagtgctttgactgcattccgtttttaagttttatctttgcaaaaattttaaaaatgagcaaaccgataactgaattcatagaaaagtattacctgcacttcaacgcagctgcattggtagatgcttctaaaggatatgttgcacatcttaaagatggcggaaaaatgatgattactttggcaggtgcaatgtctactgctgaattgggtaaaattcttgcagaaatgatccgtcagggaaaagtagattttatctcttgtacaggggctaaccttgaagaagatttaatgaaccttgtagcacactctcactatgaaagagttcctcattacagagatttgactgctcaggacgaatgggatcttttggaaagaggcctgaacagagttacagatacatgtattcctgaagaagaagcattcagaagattgcagaagcacatcgtggagatctggaaagatgcggaagctaaaggtgaaagatatttcccgcatgaatttatgtacaaaatgatcctttcaggagtattggagcagtattatgaaattcctagagaaaactcatggatgattgctgcggcagaagcaaacttaccaatcgtggttccgggatgggaagattctacaatgggtaacatcttcgcttcttactgtatcaaaggagagcttaaacctactacaatgaaatcaggaatcgaatatatgacttaccttgctgactggtacactaaaaattcaggaggaaaaggagttggattcttccagattggtggaggtatcgctggagatttccctatctgtgtagtaccaatgctgtatcaggatatggaaatgcatgatattcctttctggtcttatttctgccagatttctgattctacaacatcttacggttcatactcaggagcagttccaaatgagaaaatcacctggggtaaacttgatatcactacacctaaatttatcgttgaaagtgatgcaacaatctgtgcaccattgatgttctcttatatcttagaaaacgcttaagaataaaattctcataagagattaccatacagcgcttcaatttattttggagcgctttttattttaggatttgaaagtagatttgaaaaactaaaactatttaaaccattaagaaaatgaagagcttaagaataattaagtttcatttttgatgaaaaataaagctcatagctaaaaaaacaactttagctatttcttaatactcttaaaacttaaattaccttaatggttcaagctcataataatgtacagttttatcacataaaagattgagctttatatttccagttttccacaggcatctgtgaaatccgtgtcatctgtgggaaaacctatcaattattcaaaaaaatcaatccaaagaattcaccagcacaaaataacgatacgccagaattcccttttccatcttagtaagatgattagggtctttatgactcagcttaggaagaacttttttgttgatggcattcagcagcctgaaaaatgattttttcatatctttatcttttaatgaaacatcattgttattgatacaagttcaaaaatgatgcaaaaaagaaattgatatggacgaaattttcaaacaacaggtatatgaagtggcaagactgattcccaaaggaagagtatctacctatggtgccatagcaaaggctgttggctatcctaaccattccagacatgtaggaaaagcaatgggaggatgtccgaaagacgttcctgcacaccgtgtcatttcaagttcaggagtattatctgttccggaatttcagcctaaattggaagcagaaggaatcattgttgaaaatctcagaataaaaaatttcaaaaaactgttctgggatccgttagctgaattgtaaattttaagtttcggaaacaaagattttttaacgcaaagtttctatctataagctgtactatttttaagggagcaaagaagggaatcaatttcattgatttttttaagcgaacgtattaccccaaagcttcatcagcgacaaagtcgcatctctttgccacctgaaataaaacattcaaatcattaaatactttgcgtcgaaaaactcatacatcaatattacatatcacaaaaaaatgccactccataattgaatatgagtgacaccaatatttttaaagttttaaaccgtgttatttttttccgtccggaagatctttcaattcttttttaagcctttcgttttcttcttttaataaagcaatatagttttgtaggtttttaatgatgtctccagggatattatcataattattctgattagtgattactcctgcagaagatgatctgtcattaaatacaggatggtcattattaatcactactgtaggctcatcctcttcataaatatcctcaactggtacatccagaaaacgggcaagtttatcccactcatctcttacaattcttacatcgccgctttcttttctgctgtagttggatacatctgttgcgataaaatcagctacctgttgttgagtataacctttttgctttctgatgagacgtaatttttctttttgcatgacctacattttatacaaaaatggcaaaaaaggagaagctatacaataaaaaggagaaaaaaatatgtgctgaagaataagattaaagataaaatgaaaataaacttaaaacagaagtgttatctgatttaattgttgaaaattttctttcagatcacttctgattgatcaaaggctatgtgacaaaagaaaagatgtaaaccttcagggttttcataagctgtttataatttttatacaaaaagactgcttcaaaattgaaacagtctcttgtcttatttttcaagctgcttatagcttctctgtataaaatctgtcaggtcttttcctttcagtaagttttgtgaaagcttggcaagatccagtgcgtatttgatcaggttctctttctcttcagcgttctccgtttttaaaatctgattggaaagttcactgtttgagttcaccacaagattgtacatctccgggaagcctcccattccgaacatgccgccgccacctgttgcctgcatttccttcattcttcttatgaattcaggctgggtgattgtgaatggcgcatcactgctgtcaagatcttcaagctgaacggtgaattttgaatctttgatagcttcttccacattctttttcaaagcttctttttcagtttcgttcagttttgaaatgataggttcatcttttttgatcaggttgttcacatgatcagcatctactcttgcaaatgagatgttttccttcgaagtttccagcttctggatcacgtgcgaaatgataggagaatctaatagaagaacttcatatcctttatctttcgcagattggatgtagctgtgctgttcatcagcattggtagcatacagaacaaccagtttgttgtctttatccgtttgtacaggcttgattttttcaaccaattcgtcccaaaggaaatacttaccgtctgttgtaggatataatgtgaatttgtctgctttttcagcaaatttttcttctgtaacaattccgtactcgataactactttaatatcattccattttttctcataatcctcacggttttcgttgattagagaaaccattttatcggctacttttttcgtgatgtaagaagaaatctttttcacggcaccatctgcctgaagataagaacgggaaacgtttaatggaatatccggagaatcaataactcctctcagaagcatcaggaagtcaggaacgattccttttacttcatccgttacgaatacctggttttggtatagctgaattttatctttatcgatatttaaattgttgctcaatttcgggaagaatagaattccggtaaggttgaaaggataatcaacattcagatggatattgaataacggttcctcaaactgcattggatacagctcgtggtaaaacttcatataatcctcattggtcagttcacttggagcaattgtccatgccggtaccggattgttgatgatattgtctacctcttctgtttcagctactgcatcttcaggagcatcttccggcaaaggaagcgtatgcgtttttgttccgaatttaataggaacaggcatgaatttgttatactttaataacagctcacggatttttccttcttctaaaaattctactgaatcttcagcgatgtgcagaatgatttccgtacctctgtctgttttgtcagtagtttcttccaatgtgaattccgggcttccgtcacagatccagcgtactgccggctcatctttataagattttgtaagaatttccactttttctgccaccatgaaagcagagtagaagccaagaccgaaatgcccgataattccggcatccttcgcagaatctttatatttttccaagaactcttcagctccggaaaaagcaacctggttgatgtatttctcaacttcttcacccgtcatcccaataccctggtcgatgatgtgtaaagttttctggtctttatcaattttaacctcaagttttggatttccgtattccacttttgcctcaccaatacttgtaagatgctttaattttaaagtagcatcagtggcattggagatcaattctctcaggaatatttcgtggtcactgtaaagaaattttttaataagcgggaaaatgttttccacagatacattaatatttcctttagtcatcatatttagattttaatttttaaaattctttctcaaaaaaaataccatgcagaagaatgtgacagaatgacatttttttaacctgaaacaagcccgttatgtgaatttgtcgaagaaatatcttatttttagttcttaaaatattttaaaatgaagttgaaatgtacagtctttatgctgctcattatgaccttttgggtatatgggcagaagaagcctttagaccactctgtttacgacagctggcaaaatatcggggcaagaaaaatctcaaatgatggaaaatggatcgcctattctgtggatgctcaggaaggaaattcaaccctttctttatattccgttaaaaataaaacctcaaagaagtttgaaagagcggcaaaagtggattttaccaatgattcccgatttgctgtttttcaaatccgtccgcagtataaagatataaaagcggtaaaagataaaaagcttaaaaaaagcaagttaacaaaagacagccttgcaatagttgattttttaaatgataagacagagaagattcctaatgtaaaatcatttaaaattccggaaaaagcaggttcttatgtagcttatcttctggaaaatctaaaggataaatcctcggatgatgcttctgaaaaagaagatagtgatgaaagtaaggatgaagataaaaatgtaaaaccattgcaactggtagtgcggaatcttttagacggaaaaagcacaacctatgataatgtaatccgttatgagtttagtaaaaatgggaaacagctggtttttataaccaaaaagccggacgaaaagaaagagaaaaaagaaggaaaggattcagatgaaaaggctgcggacaaaaaagatactgataagtcaaaaccaaagaaatatgcattacaaaccgtacaggtcgttgatctgcaaaaaggaactgtcgctacaatttctgaaatggagggagacttttcacaattgtcttttgatgaagaaggaaatcagctggcttatgtaggaacttcatctgcacaaaatgatctggtgaaactataccagctgtattactttaattttaaaggaaataaaaaagaaattataaccaatgaaaatgcacagatgaagaaaaattgggtaatttctgaaaacagattgcctttgttcagtaaaaacggaaaacagctgtattttggtgttgctccaaaacctgttgcaaaagatacggcaatgattgcaaatgatcatgccgttgtagatatctggaattataaagatgattatctgcaaaccgtacagttaaaggaattgaaaaatgacctgaagaaatcctatgctgcagtaatgcagatagaaaaaccagatttcttcaccaacatcgatggagaagatctggatactttacgtctcgtaaacgaaggaaatgcagaatttgcgctgggaattaccagtatcaataaccgtatttcttcacagtgggaaggctctacaaagaaaacctatttcctgatcgataataaaacaggagacagaaccgaaattattaaaaatcttaatggagcagcggctgtatctcctcttggaaaatttgtagtgatttttgacagggaaaaagggcagtggttaagctataatgtgaaaacaaaacaaacccttccgctcagtacaggtttacctgtttcttttgtagatgaggaatttgatatgccggactttccaaattcttatggcattgcatcctggacagataaagatgaatctgtgattataagagaccgctatgacctttgggaatttttcctgaacggctcaaaaaagccaagaaatatcacaaacggattcggacgtaaacataaaataacatttgatacgtatgaactggataatgatattaaaagcctgaaccgcaaatctcctatctatttatcagcatttgataatacatccaaggccaatgggatcttcaaaacaaccattcagtcaggttctgatcctgtgaaaattcagatggaaaatgtctggggatacagaagtcttcaaaaagcaaaaaatgcagaagagtatattttagtaaaagaatcatatacagaatctccaaacctttttgctacatcagatttttcggaacagcaaaaactgagcaataccaatccgcagcaagccaaatataactggggtacggatgaactggtacactggacaaccccgaaagggcacacttctacaggaattttatacaagccagaaaacttcgatccgaataaaaaataccctatgatcgtctatttctatgaaaaactttctgataacctgaaccgttatgtagctccggctcccacaccttcaagattgaatatttcttattttgtgagcaacggatatctggttttcactcctgatatttcttacacagatggtttcccgggagaatctgccatggaatatattaattccggagttgaaaaactaaagcaaaattcctgggtagacggtactaagatcggaattcaggggcaaagctggggaggctatcaggtagcttatcttattgcacataccaatatgtatgcagctgcgtggagtggagcacccgttgtcaacatgacttctgcatacggaggaatcagatggacttccggaatgaacagacagttccagtatgaaaaatcgcaaagcagattgggaaagaatttatgggaagctccggatctttatattaagaactcaccgctctttaccattgataaagtacagactccggtagttattatgagtaatgataaagatggcgcggtgccctggtatcagggaattgaaatgttcaccgcattacgccgtctcggaaagccggtatggcttctgaattataatggtgatgatcacaatctgatgaaacgccagaacagaaaagatattcaaatcagggaacagcagttttttgattattatctgaaaggagctaaagctccggtctggatgacaaaagggattccggccacccagaaaggaaaagactggggatttgagcttacagatgataaacctgattaaaaagtttcggcggagccaaaggctccgccgaaactttttaatccttcccggaaaaaaataatacagaaggataaactgacacaatggcattttttttatgatgagcctgttgagcacttttattatatttaccgccaattataaataacagtatgggaatctttgatttttttaaaaagaaaaataacaatcaggaaaatggaagtactttggttcaggaaatggaaatgccagaggaaaaaatagttgaggaagtggtggaagaagttgtggaaacaatacaggaaaccccttcacaaccggcagaagaaccgaaagtaaatgaagaatatgaaaaaatcaagatttataatgattatatcgtttattctatagcgcttcagctaagaggagagtatactcctatttctgcttttgaaaaagaaaatggtgaggtagaaggctttgcctatatggtgacagaagatgcttatgcactttctccgcagcaggcaatttcacaaatggaagagaagtttgaaaacgaacttcaggaaggtaagatcagatcttatatgatcctgtatcattctcagtttgataacaatggtaatcacaatccggcaacacaggacggagaattcaaggcaatttcacttgcttatcattttgcaggttctgataaagcaaaaacaggacttccttatattttcgaaaatcaaaatataacttataaaggttttgcagagttttcacatgaggaaaataatgaaatcatgaaccatcagctgatagatggcaaggattatttcccgaatacagaaggaattgcagcacctgaaatgaccaatgaagcagggattatcatcagaaaatccaatgttcataatcttgttaatacatggagcggagtttttgggcatcagaatttccagactaaggattacggccagtatcttagcacagttttaatgcagtctaccgtttctgatccggctggagaagctaaaaataaaaccgaatttgaagatgtaagattcaaaaccattgttacagatgaattgagtaccataattccggaagtaaaaacggattataccctggattttgaaacaagatcaatcagagaatgggaaaatgcattgaatctgcaggcaatcgtagcgggtccggcaagggatacttttggagtgtggtttttcgctactgattatgctgagaacagaaatatctacatggcacagccacatcagaaggtaaatatcagtggtattattttcatccttgatgtccataccaacacagatttacctgacggtactaaaatgagtgaagatttcacaacctatgctccaagtcaggatcttcctaactatgcatgttttgattttattggtcaggttgtagattgtaaggaaactgaattgcttgaagacggaagcgttaaaggatatatcctgaaactgaagttgatcacaaatgaggaaaatgaggatttcttcaccattgatgcctttgtaaataaagaaaacatgagatttgaaactccggcaaaaggtatgaaagtcaccggtgcacttcagctacagggaaaaattgctgaataattttttttaatataaaaattcaagaggttgttctgcggaataacctcttttttaataattagttgatgatttaaacgcaaagaaataagtgattcgaaagctgattgtaaggaaacaaagtgtttcgattttgtcgctgatggagctttgtgtgaatgatgcgtttgcttagtaagaatcaattttattgattccatcctttgccccctcaaaattgtaccgcctataaataaaactttgcgttaaaaaaaatgacaacaaaaaaggcaatccgaagactgccttttctatattttctgaaaaattatttgtttttcatttcttccttgatcttagcttctaattcttcagcaagatccggattatctcttaaaacatcttttacagcatcacgtccctgaccaagtttagtctcttcatagctgaaccatgatccgcttttcttcacgattcccatgtctacagcagtatcaagaatttctcctactttagaaactccttctccgtacatgatatcgaattctgcctgcttgaaaggaggtgcgactttgtttttcacaatcttcactttcacgcggctaccgatagcctcatcaccttgtttgataggtgcgcttgcttttctgatatcaattcttacagaagcgtagaatttaagagcgttacctccggtagtcgtttcaggatttccgaacattacaccgatcttttctctcaactggttgatgaaaataacggtacatttcgttcttgaaatagtagcggtaagctttcttaatgcctgagacattaatcttgcatgaagacccattttggaatctcccatttcaccttcaatttcagcctttggtgtaagagcggcaacagagtcaatcacaacgatatcaatagctccggaacggataaggttatccgcaatctccagtgcctgctcaccattgtccggttgggaaataatcaggttttcaagatcgattcctaattttgcagcataagttctgtcaaaagcgtgctctgcatcaatgaatgcagcaatacctcctgccttttgagcttcagcaatagcgtgaagggtcagcgttgttttacctgaagattcaggaccatatatttcaatgattcttccttttggatatccgcctactcctaaggcaatatccaatcctaaagaaccggaaggaattacttctattgtagtgtctacggcatcatcacccagagtcattacagttccttttccgtatgttttatctaatttgtcaagcactaaagcgagtgcttttttcttatcatcaatgttactcatcgctattaaaataatttctcaaaaatacataatttaaatgtcaaaagctaatattatttgtctctgaaagctgtttttagagttaaaaaatgataaaattttactactgatctcattcataacgaagcagatgcgaaatgtggtatggacgtaataaaatattaacaggaaagaggctggcagctatcaaagcctgtaaatgtattgaacttaattgtattacttttattaattgaaatttatcatccaatagaaacttgcatcttccgggcatcctgacttattatcctaatgaaaatttgaattcttagtgatgttcagataatcttccagcactttcatctgatctttgtttcctctttttattctggccttgcggcttaccagtttgtcatacattgtattgaaaagtattttcgattttggaaacagggttttgtaaggaacatcagggatttgtaatcttttacagacttcatcatccagcagaaaccaggtacagcatatgtgaaggtatcttaagttctttctttgaaattcaaactttaagataggattttccagggattcatctaataaagaatgggcaagaagcacagaatctttgtctgaaggaggctgaactgaggtccataaataaaaatactcggtagcttgttttttatcatcaggtagaagctgttccggtattcccaaaagataccctacatatttccagagatgaaaaattccctgttcctcttcagcagaaaaacgatttcccagctttttaagactatgaagaaataccagactgaatccaatgtacgttgccatcatatcccacgaattaatgggctctccccagttttcagaatcccagtctttataatactttttaatggaaagtctggcataagaatggatcagacgggttttgatcgcaaattcatatccttttgcatgaacttccaatgcattatagcgggtagcgtttacccagaaatccaatgtttctgaaagacgtttcactgcaccttttttcagtgcttcagtaacaataagaggtttgttgaggtaggcataatcatagccgccgatcagacaataatccctcaacgaaatcagggagtccaggttgctcctcatgcagagttcagcaccgcttttgagtaaattgtaatcaagccagtcaggaactttctgagtttggctgaacagtttttttacactttcaggaatatcatcagtctctgaaaccccatctctgatgtagtgttcaatttccctggaagcctcgtggaattttttagtgaagtaaacatcttttaccacctcgtcaccgatctcatccgtatgatggaaatagggagcaaatttttcaaagtttttaaaactcacttcagctcctgaaaattctattagctgctttccattgccattttcccaaaaattcctgaaatgaggagcatctttaaaacggggttgtatcatgtttcattcctttacctataaaagtacaagttttatgctgaaatgttttggtgagatttatcaggatttaatgaacttaataataatttgagctcatttctacattttatcaatatctgtcaggaccatgataaccaaatagctcgtatatataaaaacccaaaatcacagcataaattacagataatatggtaatgatgaatactgcaatattatttctgctctgtttagtgagaaattttataaaaccgtaagagattgctcccagacctataataaaaatgtaaaagatgtgaccggaatatatgatttgcaacccccataatatgcctccaatagttcctccgataagccctcctaaaatacttccgatgatggtactgggtttgatttctaaatccctttttgttgcttctatttctgtagaagtaatttctatgatctgttgtatttcatctgaggctaatatttctgaattcaaagtatgattgatgtcattttttgtcattccgtttaaatacaattccgcagcatcattctttatttttgatttttccaattccttcgcaatagttttgtcatatcgggtagtcagcgattgtattccacctttcttttctatgacaatatctaaggcttgtttggcgtcatttgtatatctgtttttatttgaatatacttccattaattctacatcagaatattgagaatttctttcaataagttcattgagcatggtataaattttggccgttaatttaaataaaaaaaccttcccatcgggaaggttttatattactcattgtttatcgctcattattgattataaagaagcagcgtgtacaagcatatctactaacttgttagagtaacccatttcgttgtcataccaggaaacaagtttcacgaagttaggagaaagcatgataccagcatctttgtcgaagatagaagttctcttatctcctacgaagtcctgagatactactgcatcttcagtatatcctatgatacctttcaattcaccttcagaagcagctttgattactgaacagatttcttcataagaagcagctttttcaattctcactgttaaatctactacagaaacgtcaacagttggtactctgaaagacatacctgttaattttccgtttagtgaagggattacttttcctaccgctttagcagcacctgtagaagaagggatgatattgttcagagcagctctaccacctctccagtctttcattgaaggaccgtcaacagttttctgagtagctgttgtagcgtgtacagtggtcattaaaccttctacgattccgaagttatcgtggattactttagctaaaggagctaaacagtttgtagtacaagaagcgtttgataagattttgatatcatcagtaagttccttgtggtttacccccattacgaacattggagtatcatctttagaaggagcagaaaggattactttcttagcacctgcagcaaggtgttttgcagcgctgtctttatcaaggaataaaccagtagattctactacgtaatcagcaccgatttcattccattttaggttgcttggatctttctcagcagttactctgattcttttcccgtttacaacaagatcatttccttctacagaaacttcacctgggaaaataccgtgtacagagtcatattttaacatgtaagccatgtattctgcattgattaggtcattgattcctacaacttcaatgttgtctctttcagtcattgctctgaaaacaagacgtccaattctaccaaaaccgttgatacctactttgattgttgacataatagtttgtttttattagattataaaaattagattgctaaaatttttgaaatcagtaaaaggtctttattgatttcattatgttttttaatggcttcttcaatcggggtatacgtcagatcattagaacgcatccctgccattacattggtttgtccttccattagccctgttacagctccataccccagacggcttgccagaactctgtctgcacagcttggagaacctcctctctgcatatgtcccagaatagctacacgaatgtcataatcagggaatgtctgttttgttttttcggcaagttcatatacgttggctaatttttcaccttccgctaccacaacaatgcttgatgcttttcctgttttttcagcatctctgaatttcgcgaaaagctcatcaatactatcttttttctcaggaattaaaatatccagagctcctgttgccaatccactgtttaacgcaataaaaccggcatcacgacccattacttccacaaagaaaactctgttgtgggaagtggctgtatcacggattttgtcaatggcatccattgcagtattcaaagcagtgtcgtatccgatggtgttatcagttccgaaaatatcattgtcgatagttcccgggataccgattaccctgatcccgaattcttcattaaagattttcgcacctgtgaaagttccgtctccaccaatacaaaccaatccgtctattccaagctttacgcagttgtcataagctttctgacggccttctttagttctgaactcagcagatctggcagactttagaatcgttccaccctggttgattatattttttacggaacgggctcccattttcaggaaatcattgttgataaggccgttgtaaccttctctcaccccgtagcattcgatattatagtaattggcggttcttactaccgctcttaatgccgcattcatacccggagagtcacctcctgacgtaagaactgcaatttttttaacaacactctctttcatcaagaaaaaaatttcgaacacaaatttacaaaaacaagttcagattatcgtagtaactttccaatagttttgaatataaattattaaaagcttctgaagtttataggtttaaaaaaatatcttgccgtttttgtttcagcagcatggatgtcaagatcataccagggcgtaaaatatgggttaaaaggatttgaaatcacatgaacggattgtgccggcgtgaaaccttcacttaataagtacaatcttttttctttctgattcttacagactcctgaaataaaaacaatatgccccggactccctggtgtaatcagaatatctcccgttttaagatcagaattttttgttaccggttttgtctctttatgtaatgaaattgttcctgcataattgaaaatcacatccagatagtttctgaagctttgataagaatcatcaggagctgcaacttttctgaagctgactgaatttccactgacaaaagctctcattccgtttttataatcattccagcttaaaaggtcaccgcttgtaaaatgaaatttaatttcgtcaaatttttttgcattataaagatattcagccctcatgcggataacagcatcagcgcattgctgaagatctttatttcctgtatcaatgtcaaaaacggcttcatgcaggtgctgggtagaaattggtgttccatcatattttaaaatctggcttccataaggcttcagtttaaaattttcaataaagtatccgaaggaatcaggtttttctttaacccattcataaccttcaggaggagaaaatctttcacggatggtatttttattcttattgatttttaacgcattttctgctattaaatgctcattcttatccggttcaggcagtaaacggtctgagaatttttcttttgtgcaaccagtgcaaatgaaaataactgtaattcctgtaataacttttttcatgcgttcttagttaacacaaatatcaccttttttatgtgtccccaataaagattttgaaatcacattaaacgtgttatacttctttacgatcagattcatcccgatatgtacaggatagtgtcggcaactggttgaatgatgccagtaaatcacaacccgaatttgtagtggaaatatgtgatgaatggctccgggaaagtccgacaaaagaaacgcagtatatcgttaaaaaggctttaagaacgataaaaaaataaaagttatccacaaaattgacatgtgaaacttctgttgcgttttacagattgcagattgatagacgtttacataccattttttatctccctttttctttgggagtggctttattaactcattttttacacaaaagtaaggttgaaattattttcaatgttaacggtatgttaactgtaaaaagttatccacaatatgagttttcgattaatggggattctatctgtcaataaattaacaggttaaataattagcttgtaaaaaaagcttgaaatgctgtcttttttagccaaaataaaaagttatccacaatatggaattttagttaccatttttcagtcaggtatttccaatatcttttcgggacgtgctgaatatggagtttcatattttttcgttcaacaatattggttttggtaaaatatcgctgccagagtacctggtaacttttttcttcatcatggaatttttgctgataatgatttaaatcaattttttcatcagggtagaaaaactcagaatcgttgaggtcatatagaaggccgtagtttctccgaaggtcatagatcatccatttctggtcctgatagcggttatgaaaatgttttctgattaaaggaagaacattgaaatcaggatctattttggagaaaaaaacaccatcctgcattttttcaaaacgtacaaaggctgtcattctgtgtctttccctgtctaatgatttacagatctttgaaatttttaaaatatcagaatcgccgaagttttcaagaatattttgtccgggatactggatggactgttttacagctgataaaattaaattttccagctcgggatcttcagataaaaatacttttaagagttgatgaattccgggctttccaatgttttgctccagtttgttgagaactctttcggatttctccggctgcgtaatgacttcatgaatttctgcaaaaatattctcctgatgaaaattttctctgcttacgatctctacatctttataacggtattcaaaaacttcaaatactgcagtaaaaagtccatcaaaacttccatcgtagagtagggttgtcatatattgaattaaaatttaaaatttagttggtttcccattctgaaaaaataaaatgaagtgaagaatcaggtttattgaagagactcttccttcgtcagaatgacaataatgccgttacatttttgtataagaaatttgtgatcatttgtgaaaaacattagtgtcatttgtgtttattgaaactgttcaaaaacattaaaaccattaagaatgatttaagaaataaagtaaagttaagataaatcattctgatttttaagcttaaagcgaagctcatcttaatactctcagcaccttaatagaatcttaatgtttcaaaaaataaacatttaaacagatcattaaaacaaggttagctgttgcgaaaactgattatggaatttggaagagcttccaccaatcagcagctttctgaagtttttgtccgttaagtatttcaggtaagcattgccagcagtaaaatcaataaaatattttgcacggttgacagctgctcccagttttttcaaatgatccatcgttaaaatctgaaaacgtctggcacttataattttctgagctgtttttacgccaattccgggaatccttaaaatcgtccggtattcggcagtttgaagattcaccgggaactgatctaagtttcgcaatgcccagcttaatttcgggtccatttccagatcgagaaaaggaacattcggatctaaaatttcttccgctttaaaaccataaaatctcatcagccagtccgactgataaagcctgttttcgcgaagcataggtacttctgtggttaaagagggcagcctttgatcttccagtaccggaacatacccggaataatacactcttttcagattaaaatttttataaaagtggtccgctaccttaatgatctgcagatcattttcattggttgctcccacaatcatttgtgtagactgtccggccggagcaaacttcggaactttcttaaggattttcttttcatctttatattgaatgattcctttctgaatataccgcatcgggctgatcatatcctgtctgttcttttcaggcgccaataatttcaatccgctttccgtaggaatttcaatattaacagataaacggtcagcatacaacgccgcttcctgcatcagatcatcacttgctcccggaatagatttcagatgaatataaccgttgaaattttcttccagacgaagctttttagccactcttacaagacgctccatcgttgtatctgcattcttaaaaattcctgagctcagaaataaaccttcaatataattcctgcggtaaaaattgatggtaagatctactacttcttctacggtaaaagcagctcttttgatatcattcgaacttctggaaacacagtaagcacaatcgtagatgcaatggttggtcaacagaattttaagcagggaaacacatcttccgtcttccgtataggtgtggcaaatcccgcttgcagaactgtcgcccaaagccccttttttattctttctcgtgcctccgcttgatgagcaggaaacgtcatatttcgctgcatcagcaaggatttcgagcttttctttaaggcggtcaaaattcattcttttggtggtttgatattatttgtatcaatataattttaaatattgttcaaatttagttccaaaattgataaaagtcaaccttttttcatagaagttatcaacaaaaaagagcctcaaaatcattatatttacggctcattaaagtttatatcatgaatcataaaccaatcgaaggtttttccaagcttccaaagcaggggaaaatcgactggctcgtaaacgaatatcttgaaggtaaccaggaatatcaaaatatattacaacaatactggaatgatgatgcagatcttcagaaacttcacgaggaattttctgaaaataccatctccaatttctatatgccttacggaatagctccgaactttttaatcgatggaaaactgttggcacttccaatggctgttgaagaaagttcagtagtagcggccgcttccaaagcagcgaaattctggatcgataaaggtggttttaaaacaaccattatcaatactgaaaaactggggcatacccattttatttttaatgtagaacctcataaactgttacacttttttaatttcagtttaaagaaaaaactatttgaagccactgaagatatcactgccaatatgagaaaacgcggcggcggtattttaaatatcagcctggtggataaaacagcagaaatgcccaactattaccagctgaaagcaagctttgatacggtagattctatgggggccaactttatcaactcatgtcttgagcagttcgggaaaacattgagacaggaagtagctaccagtgaagattttactcaggaagaaaagaattcactgcagattgtgatgaatatcctttccaatttcacccctgactgtatcgtgagagctgaggtttcatgtaaaatggaagatttaaaagatgacagcggcatttctcctgaagaatttgcttctaaattcaagcaggctgtgaccattgcagaaattgaaccttaccgtgccacgactcacaataaaggaatcatgaacggagtagatgccgtggtgatcgctacaggaaatgatttcagggcaacggaagcctgtgcgcatacctatgctgcaagagacggacaatacagatcccttactcactgtacaacggataacggagtattcagattctggatcgatttaccaatttctgttggggtagtaggagggcttacaaatcttcacccgctggtaaaattctccttagcacttcttggaaaaccttcagcacaggaattgatgagcattctggcagtttcggggcttgcacagaacttcggtgcattacgttctctggtaaccacaggaatccagaaaggacatatgaaaatgcatttattgaatattctgaaccaattgggggctaccgaagaggaaaaacagcactttgtgacgtattttaaagacaagacagtaagccatcatgaagtgatcaacgagtttaacagaatgagaggaaactaatgttacagatcattttgcctattatattccttctctttggtttttttctgaagaaaacaaataacgaaggtttcaggagttccaagagatttgccaatatgtttatcattctgggaatttctaccctggttgccaagtttattttaatgtatataaaatcaaaatagtgaaaaagagcattgtatttttcttattgatttccggtttaagtttttcacagcagaaaagtttaaagatcaatgatctgcagccaaaatctgaaaactatgtgtttcctgtgataaactatccgggaaatccaatagcagccaataagatcaatacatttcttcaggtcagtgagctggaatatgtgccgggttctggtggaaacccttttaaactggcttctacagcgaccaattcttactccaactacctttatttctatgattgggagaaattggaaactcctgaaaatattttaacgataggtattcatggtgaagcttcgggagcttacccggaagagtttgcggactggaagaactttgatctgagaacaggaaactttattaatgctgcagatttatttcaacccggttcagtaaaaattgtagatgggattattcagaaacgagtacaaaaaagaatttctgattttcttgtcaaattgaaagctgaaaaaaatcctgaagaagaaactgaagatcagattgcactttacgaagattgctttacagagcatactttgggaagtgtcaaatatttctttggaaaagataaactgacttttgtagccggaagatgttctaatcatgctatgagagcactggatgaactcggcagccatgagatagaattcacttacaaagaattggaaaaatactggagttcttatgcaaaaaatttaattttcggttctgaaaaaacagagataaccagtcttaataataaactgtatcatggtaagattgacggaaagtattccatcaccgttttgatcgatcaggtatatgatgacggctctttttctgcaaaatactggtatgataaaaataaaaagctgattgagtggaatgggaagataaaaggcaatcatatctctatcatagaaaacgattattacagcgaagatgcccatcaatgggttttcaaagcattagtagaggctgatttgcaaggaaagaaaatcatcggaacgtggcaggattataaaacaaaaaaatatttaaccttacaattagaagagttataaaatgaaaacaatcacattagtttttggagcagtttacggaatggtatctgtgatcctgggtgcattcggagcacatgctttaaagaaaatattggctgtggaaagactggaaagttttgaaacaggagtaagatatcagatgtatgccgcttttttcctgctgatcatcgggtatatcttaaaatttgaaacctctgctgaaaaatggacgtccatcttgatgattgcaggaacatctttattctcagtaagtatctatttcctgagcatgcaggattatctgggaatgaatcttaaattcttgggacctatcactccgcttggaggtctgatgatgatcttaagctggggaatgctgatcttatattttgtcaaaaacagaatttaagattgagaataaaaaaagaagacagttcatacaaccattcaatctcttctgtctgagaaattagcggaagaataagagaaaaaggaaggatatgttaaaaatcaagtctgtcactctttaaattttaagtcaataaacttgaacttccgtgtctttttagtaaatttgtcaacctttaaatttttaaataaaataataaaaataatatgaatcttcacgagtatcaatcaaaagagattttatcaaagtacggagtggctatccaacgtggtttcgttgcaaacaacgtagacgaagctgtagctgctgcagaaaaactaactgctgaaactggcgctcaagggtgggtagtgaaagctcagatccacgcaggtggtcgtggtaaaggtggtggtgtaaagttctctccaaacatggataaacttaaagaaaacgctcagaacatcatcggaatgcagctggtaactccacaaacttctgctgaaggtaaaaaagtaaattctgttttgattgcagaggatgtatattatccaggtgaaacagaaactaaagaattttatgtttctattcttttagatagagctgaaggaaaaaatacaattgtatattctactgaagggggtatggatattgagcacgttgctgaagtaactcctcacctgatccacaaagaaatcattgatcctgctttaggtcttcaagggttccaggctagaaaaattgctttcaacctaggtcttgaaggaaatgctttcaaagaattcgtaaaattcatcggttcactttacaatgcttacacaggtattgatgcatctcttttcgaaatcaaccctgtgttgaaaacttctgataacaaaattatcgctgtagatgctaaagtaactttagatgacaactcattattccgtcacaaagacttagctgaattaagagatacaagagaagaagatccaatggatgtagaagctggtgaagcgggtcttaacttcgttaaattggatggtaacgttgcttgtatggtaaacggagctggtcttgcaatggcaacgatggatatcatcaaattatcaggtggtaacccagctaacttccttgacgttggaggtactgcagatgctcagagagtacagactgctttcggaatcatcttaagagatccgaatgtaaaagctattttgatcaacatcttcggaggtatcgtaagatgtgacagagttgctcaaggagttgtagacgcttacaaagctatgggaagccttccggttccattgatcgtaagattacagggaactaacgctgtagaagctaaaaaattaattgacgagtctggtcttccggttcactctgcaattactttagaagaagctgcaaataaagtaaaagaagttttagcataagctgaaatttttaaataaaatagaaaaccgttccaattttggaacggttttttaatgcgtatgagaaacaatattcatgaaaaacttatatattccggaaccatgttctgaagattgggaatctatgtctccacacgaaaaaggcaggttttgctctgcctgtaataaatgtgttattgattttacacaaaaagaacctcaggagattctgcaaattataacggagaagaaagaaaaacaggtctgtggaagattttataatcatcagttgaaaatgcctgatcagtctgaaaaattgaaggaaagcttctttaggtacatcccctcttattttcagaataataaaatagtactcacactattttctttagttttatttttaaccgggtgcacaaaacctaaagaagaggtttgtatgacgacaggatttgtagatgtaatagaagaagattctacggttaccaacaaaaattatgttatgggggaggctatgatagacaatgatacaattgctaaaattcctaaaaaagatagcgctgtagttcacaatcacagtacaaaataatttgttataagtacgatgagtggttgatgattctttgccacaaataaacaatttttttatatataaattcttgcggcattaccgacaaatattgcttcatttgatacggcttaaacctgttaggtttcttggtaatccccataaaaaaacacccggtttttaaggtgtttttatttttaattgttttgttacttatcctgatggctttcgggaaaattggtttctccacttgtaatactgatactggttggcgttaccagctgaattttgtctgtatcaaaacgttctttaatatttaagtaagctttgcttctcacctgtgcaagattggctccaaccttgatccagaatttcacctgaaggttgaatgaaccctgcttcagatcggtgaaaataacttctgcagtatccaacttatctacattgtcaaggttttttatcacatccaaaattcctttttgggctttactgatatcttcgtctgcaggaatctcaaaatttaaaataatcctgcgctgcggagaagctgtaatattgtaaaacggagcattgaaaacaacctggttgggaatataagctttcttcccgtcatcggtaagaattttcgtagttagaaaaccgatttcctgaaccgttccggaatgggttccgatggtaatataatctcctactttaaatgctttatcaattcctatcagcattcctgagaaaatacttgaaacaagatctttcagtgcaaccccggcaataaccccggctactcccaaacttcctataaatttccataagaagctactgaagcccataatttcaagagaaataaaagtacccatcagcataatcagaaatctgaaaatactgatcagtgtaaccaatgaactctctttctggcttttcggaaaaaatttatgaaataattttactgctcctttgcttaaatatttactgctgataaggaaaaaggtaaataccagaattccgacaatcagctttggggttagctcggcaaaggtgatataccaattttccaatactttatacacaacatctacatacctgagtccggttttctccatgagtaaaattttagttaaatatataaattttcatcaaaaaatttgccagttccaaaaagtctactaaatttgtagactataaaaacggaatattatgtcaatcaaattaggagatacagcccccaactttcaggcagaatcatcagtcggtgatattaatttttataactatctgggagattcctggggaattctattttcgcaccctgcagattatacgccggtatgcactacagaactgggatatacagcaaagctgaagtctgaatttgatgccagaaatacgaaggtgattgctctgagtgtagatggggtagaagatcatcaaaattgggtaaaagatattaatgaaactcagaatacccatgtgcagtttcctattattgcagacaaagacagaaaggtttcggagctgtatgattttatccatcctaatgcttcggctacagctactgtacgctcgcttctgattattgatccttccaaaaaagtgagactgattattacctatccggcctctacaggaagaaattttgaagaaatccttagagtgctggattctttacaattggtagataattatcgggtggcaacacctgtaaactgggaaaatggagaggatgttattattcctcccaccatctcaacagaagaagcacggaaaatattccccaaaggtgtaacggaaataaaaccgtatttacgttacacgccacagcccaatacatgatttatttgattttttatagtttagttttaatttgtacgaaaagcgccccagaaataaaatttccggggcgctttcatttttttataagtatttcagtgattacttaacgtcgttgataatctgcttagctttagatgttggaagataaatctggaaacctaaaccaaaagtaattttgttagtatatccaccgcttccgaaacctgcgtttgcatcgtattttactaaaccttccaatccaatgtttggagtgatgaagtaagaatacccaggtccgaatccgaagttaaggccgttagaagaagaacctccttttgaaatagatgttccaccaataccaacgttaccttcgaagaaccatcttccgtggtgaagcaaattatttactccctgctctcccgggttaagatagtaacgtcctaaagcacctacgttatacgtgaaagtagttggtgcatctttagcgcctttgaaacctaaatccacatatcctcccaatgcaatgttatcctcaataaaataagctcctttcggttgaatattaaaatcataacctcctcctttgtttaaaccgaagttggcacctgcaaggttaccccctaccatccaattacctttctgaatctgagcgtttgcagttgctgttaaacctgctacggctaatatccctgttaaaataagtcttttcataatttattattttaataattaaatgtttattattcacgaattatagaaaaaacaataaatgtgccatactcttaattttacgtaatttttctaaataaacgttaagattgtcagagagatatattttatcattttaacatattagttgaagatatgataatgataaagataatgaaataaggtttttaaaatgaaaatgataagaataggtggcaggtcattaattgcataaacgtattaattaaataaatagaagaatgattgaaataataagtccggcaatggtaaatctgataccgcgtttgaaggcctttgtcttgggattaaacatccagaaacttgagatcacgaaaaagaaaagtgaaactccgaagaatacactcaggggtgatatggcatctttagattgagatttgtgaagagaaaccattttgtctaatacgaatggtaattcttttttggtgtacttcgcttttccggttgcactgtcataagttccctgtttaaaataaaggatacttccttctgttttttcaacctcaaggcctttcatcttaagttcctttttcagttctttttcagaaaggttggcagcgatgtttttttcatatttcttttcgctcttcaagaaatcagtatctctgtataccagaaggattccgcttattgagtataccgccataattcccgcaaggaaataccccagatagcggtgtgtaaccctcataaaacttcttgtgtctttaatcttatccatatcttgttttgtttttattttaaaatttcaaagtggaaactgcaacaatgcaatttccactttcatgaaagaattatataaattctagagtctgtatgtcaatgtaaaatagtagtttcttggagtgatcggattcactgagtaattttcgtgaacattgtaatttacgacatcaaacaggttcccgactttcccctggatagagaattttttccaaccataccctacacttatatcaactgttgtgaatccgttaatatcaatcattcttgtctgctgggtttgcccttttacatcattccagccagcttgtctttttcctgtatagaacgctgtcgctcctactttcagaccttttgcaaaatctgtaaaggtataaaatacggaagcatttgcagtaagagcaggagttcttaccaatttttggtcttcaacaaatccgttatcgggagtttttgtatatacagtattattataagaaatacctcctatcagagaaagatattttgtaggatttcctgtgatatccaattccacacctctacttcttatattaccggcatatactttatataatgcaagtttattctctgcaagatagggtgatgtataagcatccctgttgtttatttggtaagcagttaagttaactgcgattgcgttgttccataaatttttcttaatccccacttcgtactgatcaattgttgatgcctttaaagaatgatcgttttcgtcaaaacctgtattaggtgagaatgaattggtatatgttgcaaaaacagataaattatcattaggattatagattacccctactttgggtgatatagcgtgagcttgcaagccactgtttattgtagggacttctgttcccttcagaaaatcctttacttctgtatcttcattttttacatatgaccatcttacccctgccaatactttaaattctttggtaacactgattaaatcctgtgcataaagaccaaatctctttgtagctattctatttcttgatgctctgtaggtttccggcatagttccatcattggaccatgtagatggatcatttaaatacaatgttccatagttagcacttgtaggattggtaaaattgtaaatgtaagtatctgccaggccatagtctccgtctgttccaaataaaactttatgaatgatatttccggttttaaattctccgtttaagttaacctgtaatgaagtatagttttgttcagtataatttcttcctaaagttctaccccatgaaggattaaaatttccttttcctgattcatactgccattggattctttctgttgaaaaataatcttttgtataattctgataggaagccactgcatttaaactccatttactgttcaattgatgatttaaaacaacatctgtagtggcttgttggttggtttggtattgccagttagcacccaaaaagcttctacggtcaacttcagtagctaatctggatactcctgtggttttatcagtaacacttccaatcccaaaatctggagtaaaattatgatataagtaatctccttctacaattaattgtgtgttttcactcaaattaaaaacaaaagacgggttgaaataatgctttttagattctaccatatctctgaaactttcagcatactcataagtcccattaactctgaaagctacatttttacttaaagggccatagatgtcaaacataggtttataagaattccagcttcctccgtttaatccgacagatccaccaaattcaaatcttggtttttttgttataaggttaacaatcccgcccggtcctacgttaccatacagcatagcatttgctccttttaaaacttcaactctctctagcccgcttacttcaggaaaaacaccactgtttacttttgctccgtttttgaagatgttatcatttccgaatataaagcctctccctccaaagctatcctgagatcctcctcttgcagatgtcaaataaataccatttacatttttaataacatcactcaactgttttgcctgctgctgctcaatgatttcatgggtaacaatagcaatcggctgaggattttccattaccgtcagatttgacttggtcgataaggtccttgcctggttaggatttccggttttatgaagattgatatcctcaatggtttgagttctgatagtgtctgcttcagcgtttttcaactgtgaacttgccgaaacagcgataaatagaagacctaaagaaagtaattgtcttttcattttatttttatgtagaacagttttaaataaggcgcaaatgtaagtatttgtttagaatagataaaaataattttatgatttaaatcatattttttgtatggctcatgacaatggattatttctatacctcctttagatcggggaatagagaattttttatgaatatatttgttaaaaattataatatgcaattggtaaaagcagggctttgtgcctttggaatgagtggaaaagttttccatgcaccgtttttaaaggagcatccgggattttttatttctgcggtagtagaaagaagtaaggaagagtcgaaggagaagtatccggaagcaacaatttaccgttctgttgaagagatgcttcagcaggcagatatagaactggtgatcatcaatactcccgttcagactcattatgagtatgccaaaaaagcattggaagcgggtaaaaacattatcgtggaaaagccttttacagtaaatgtttctgaagcggaagaactggtaaagctggctgaagaaaaaggattgttcctgagtgtatatcaaaacagaagatttgaccgtgattttttacaggttcaaaaagtgctggatgaagggaaattgggaaatatcaaagaggttgagatccgttttgacagattccgtaccactcccagcggaaagcagcataaagaaagccctgatcagctgggagccggatcgcttcatgatctgggagcacatcttgtagatcaggctgtacagtattttggatatcctgaaaaattgtttgcagatgtattttctatgaaaggaaaagaatttgcaaatgattattttgagatccttttattctataaaaatgatctcagaataagactgaaatcttcggttttcagcaaagaagggcactatgcttacactgttcatggagatagaggaacttttctgcaggaaagaaccgataaccaggaaaatgaactggtagcaggcgctgttcctgaatatggaaaagtatggacacagcctttgaatgctccggatggaattttaaactacctgaatggtgattctgcaacagaaagaattcttacctcaagtgaagccggaaattatatggattactatcagaagatctatgaacatattgtcttcgggtatgctttaccatctccgggcaaagaagttattcagaatatgaaaatcattgatgcttctctggaaagtgcaaaagaagaaagaataatcaaattataaatgatgcgttatgaattatgaatgaattcaaaatttcaggttcaaggtttaaagtttcaggttgatcgtagttgtgattagaaattttcaactcatttacactcaaaccctaaaacactcaaacgctccgactcattcataattcataatttttaaatcataattattaaagtagctcctgtagctccagccatctcatttcatggttctccagtttttctgaaacggtttccagctctgaagaaagtttggctatcttctcataatctgcttcattgttgagctgatccaaaattttagcacgctgttcttccagttcaggcatttctttttcaatggtttccagttctctctgttctttgaaagttaattttcgttttgtatttgaaggtccggtactttccactgtggaaacaggttctttaacaggttcaggcttcgtagctgtatttttttccaatgcttcttcacggcttctggcttctctgtattctgagaagtttcctacaaaatccctgattttaccgtttccttcaaatgccagaacatgatctacaattctgtccatgaaatatctgtcgtgggaaacaataatcaaagatccctgaaactgctgaaggaagttttccagaaccgttaatgtcggaaggtcaagatcattcgtaggctcatcaaaaatcaaaaagttcggattctgatacaaaatatacatcaggtgaagtcttcttttttcacctcctgaaagctttgaaatcggagaatattgagtttggtcatcaaataagaacaatctcaggaactgtgaggcagataagcttttaccattagctaaaggataaaactcagcaatttccttgatgaaatcaatcacgcgctcatcctctttataggtaagtcctttttgtgaaaaataaccgaaagaaattgtctctcctgtttcaatttctcctttatcagctttttcataaccttgaataatattaagcaatgtagattttccggcaccgtttttcccaacaattcctactttttctccgcgttgaaactgatagctgaaatcttttaaaagaactttaggaccaaagcttttatcaatatgcttgagttcaagaattttatttcctaaacgtttcatttcaaaatccagttccagcccatcttttctggtgtcagttttggctaccttttcagtttcgtagaatgcatcaattcggctttttgattttgtagttcgggctttgggctgtctacgcatccattccagttcctttctgtaaaggttgttggctttatcaatcgtagcattaaggttttcttcccgaatcattttgttctcaagataagtggcatacgagccgttgtgaacataaagattctgatcttccatttcccatataatatcacagacgctgtccaggaaataccggtcgtgcgttacaagcaataaggttatttttgctttgttcaggtaattttcaagccattctaccatgtccacatcaaggtggttggtaggttcgtccatgataagaagggtatgcctgtgctcagctcttgtctctgttaagagtttagccaacgctacgcgtttgatctgtcctccggaaagagttcccattttcgcctcaagatctgtgattttaagctgtgaaagaatctgcttcatttcattctccagatcccaggctttatgaacttccatatcagccaaagccttttcaataaaatcattatctgtggaatggagtgactgatgataattcttaagtgccagaataggctctgaatcaagagtcatcataaattcctcaatgctgagattaggatcataatcgatttcctggtcaaataataccacctggatatctttattaatgatcgcagttccgctgtctgcaatttctttacccattaatattttcagaagcgtagattttccacttccgtttttggcaacaatagctattttatctccttcattgatgtgaaaagaaatgtttttaaacaaaaccttgatgccataagatttggtaagattttcagcagaaacgtaattcattgggaattaatggtttgattttaatttggaattgaaccgcaaaaatacgaaaatgtacctgaaattttctgcaacctcttttataaatcaatatttataattttttaataaacctgagggaagtactgaaaaaactattcagtaaatttgattggctgcaatgtaaatagttcttaaaaaaataataatacaaaatctgattaaagtaatgaaaaaagtaattgtcgacatggatggggtaatggcagatgtgtatcatcagttggtgcaatttgaaaaaagagataccggaagggaagttaatatcagtgatttagtgggaaagccggaaatagaagcctttccaaacggaaaaaaacacgttaatgaagtaggttttttcagaactttaccggtaatgaaaggcagccgtgaagcaatggaatatctgaacagtaaatatgaactttatattgtgtcagccggaatggaatttcccaacagcttaagagaaaagtacgactggctcgcggaacattttccattcattacatgggaacagattgttctttgtggaagcaagaaagtggtctccggagatgtcatgattgacgattatcctaaaaacttagatcatttttccggtcagagattaattttcacccagcctcataatgagttgatcgaaaatgatacttacaaaagggttcactcctgggaagaaattataaatattctctaactctaagtattaaatcatataaattctgggaatttttaaaataattttaactaaagacgggataaatttaataaagtattgggagctcggaatgttcaaaataaataagtttgcgtcaaacttttaacatgaaaatattccatactctattttttcttattcctgccattgcccttaaagcacaggttatttccggaaccgttattgcaaaaaatgaaaatcagccgattccctatgtgaaagttgggatagaaaagagttcaaccggtacaatctctgatgaaaaaggaaatttttcaattgatctttccagtattgatccccggcagaccatcaaaatagaggtgcctggctatgatctttatcaggaaaccgttcagagttttaaacaacatcatcagcaaaaaatatttttaacagaaaaaactaaaaatattaaagaggttaccattaaaccgaaaaaactggttgataaaaattggggagttaatacaaagacgaaaagtgttatttattccgtaaatcccgaatttgataagaaaagttttctcggagaaacagctttagaattcaatgctaaaaaaagatcaaaaattaaaaatatcaacctgaatatcgccagttacgtttccgcgcagcctgtattgatgagatatagtatttatagtgaaaaaaacggttttccggataagaatattcttgaagaggaaattacagttgagctcactgaagatatgatcaaagacggaacatatactctggatgtgaatgatcgtaatatctgggtgcagggaaaattctttattggtatacagtttttaaaagcatttgacggcaggatcaaaataagcgcagctttgttcagaacaggatttataagagagttttatggtgactggcagaaaatgaccattgccgcaccagccattaatattgatgtgaaaatggataaaaacgacagcaataatcagaatgaaaatgattaatgctgatgtacctgagcagctgaaaaatcgatctgtcgattcaatatacatttttcatgctaatccagtgtcagtcttttcaacgaccatgaactgccattgtaaatatcgagatccacttttgcattgatgccgtgtacaattccgttttctgtaaattgccagaagtcccactggtcatcgggagaaggggagggaacatcattataattggccagccataagggatagccgtcaaattcacctttcagaaaatctttatagtaatgatagtacgtgtagatgataggtttttcaccataggcatcttctataattttgcaccacaccttcaggtcttcaaccaactttttgttggttttacgttttgggattttttcaatatcaagaatcggaggaaggtctccgctttcaagttttacattctctaaaaaattattggcctggatcacgggatcttcatcagctctgtaaaaatggtaagctccacggataagatcgtgttttttagcgctttcccagaactcatcaaaatgcttgtcggcacttcggtttcccatggttgcacgcatcaccacaaactccaatggaattgtcttgtttccgatgcttaggctgtcccatttgatatcctccctgttctgatagtgggaaacgtcaaagccataggttttatcaaggttactggctatgattctctggattcttgccgcttccttttcactgttatgaagttttttatgcttaaatttattaaagtacagggcataataataagtaacggtctgttttaaataaaaaccggttcctatcaatgctaaaattaatattgccaatatcacccacctccggaaaaaatacttcttccgtcgggatttgtggactcgtttggcagtttttttggtgtactttctcggtgtcataaagttttgcaaaactaacttttttcactgctaaatgctaaataaaatcagtaaatttgtgtattatggaaacacgcgaaaaaatcatcattataggaggaggatttgcggggctgcagcttgcaaaaacattgaataacaagaataaaaaggtcattgttcttgaccggatgaaccaccatatgtttcagccgcttttttatcaggtagcctcaggaaggatagaaccttccaacatttcttttcccttcagaaagatttttcagcagtccagaaacacacagttccgtatgacagaggtgaaagaaattgatcctgctaaccataaggtgattactgacgaagcagaatttacttacgataaactcatcattgcaacgggctgtaaaactaattttttcggtaacaaagaactggaaggtaaagctttcggaatgaaaaatacccaggaagccatcagcatcagaaaccatgtcctgatgacctttgaaaaactgattattgaaaaaagccgaagcgacgatggtaactggaatatcgttattgtgggaagcgggccgacgggggtagaattggcaggtgcttttgctgaaatgaaaaaagatatccttccaagagattatccttatatgaattttgatcatctgaagatcatcctggtaagctctacagaaaagccacttgcagtaatgagcagtgaggcgcaggaaaaatctgaaaaataccttaaagaccttggggtaacttttctgagcggagaagtggtaacagattatgacggtgacaaagtacatctcagaagtggtaaggaaattccatccaataatgtgatctgggcagcaggagttacgggaaatgttgtaggaggttttccggaggaaaaattaataaggaacagatatattgtagaccgatataacaaaataaaaggttacgataacatttacgctatcggggacattgcctatatggaaaccccaaaatatccccaagggcatcctcaggtagcgaatgtagccattaatcaggcaaaaaatttaggtaaaaatttattaaagaaaaatcagcaggaatggaaagaatatgagtatgatgataagggctctctggcgactattggaaagcacagagctgttgtcgatctgccgtttattaaatttcagggatttctggcgtggtatttctggatgtttctccatttaatgctaattttgagcgttcgaaataagctggccatattctttaactggatgtggagctatatcaacaaagattcttctttaagattaattattataccgactaagaaaaacggaacattacaatgagaattgacataataagcgtacttccggaattgatggaaagtcctttcaaaacttctattttgaaaagagctatggataagggactggtggaagtacattttcatcatttgagagactgggctaccaataaacacagacagattgatgatgagccttacggaggcggagcgggaatggtcatgatggttgagccattggataaatgtatttctgagcttaaatctcaaagaagttatgacgaagtaatttatctgacaccggatggcgttactttaaaccaaaagattgccaatacgctttccattaaggagaatctaatctttctctgcggacattataaaggaatagatcaaagagtacgggatctccatatcactaaagagatttccattggagactatgtgcttaccggaggagaacttgctgcctgtgtacttgcagattcggtgatcagattgcttcctggagttttaaatgatgaacaaagtgctttaacagacagttttcaggatgaccttctttcaccgccaatttatacccggcctgagagctataaaggtctggatgttcccaaaatcctcttaagcggaaatttcgggaagattgaagagtggcgccacgatgaggctgtaagaattaccagagaaaaacgtcctgatttactgtaagcgatcgtcagaattatccaatttttaattatgaatttaattccatttgttaattataaatggaataatatttgttattaatttaataagtgcgaaaaatattaatatttctaattttaaattgaaattttatttctattattccggattttatatattgtctcaattttgattaatgtataaaaactcatcaatagttgaaaaattaatttattatagctgatttcattggtattttttactatatttggactgttttttattggaaattgatttgctcgcttcgaaataaatcaaagaaaatttgaaaaaaaataataaatttacattgcaaaagaaaaagaacataataattaaaagtttagaaattagtgtagatggagctgttctctttttataatgttgaaaatttatttttacccgatcctaaacctgtccataaattagatcctacccggtcaggattaaggaattgggatgaaaagagatatagaaataagcttttcaaaatctcccacgtatttcagctgatgaaggaggataatggtgttctgccatttatgataggattgtctgaagtttccggaaggaaagttttggaagatcttgtggagatggagccctttaattcggaatatggaattgtacattataattctatggacgaaagaaaagtggatgtagccatgttatatgataaaaataaagtagaggtaatagattcagaaaccattactttcttttttgaaatagtaaataaaaacacagaaaattacgacacgacaagagacgtacttttttcaaaaattaaatataaaggggaaattattaatgtatttatcgcgcatcttccctctaaacgcgaaaaagatattaataagcctaaaagagcctttatattaaatgaaatccggcaacggattatgaaaatagtggatgctgataaagagcatgtcatattgtgtggtgattttaacgaaaacccggatgatgaaaatttagtacagattctctatgacaatgagcatgagaaggttttagtgaacccttttcaacaattgttttctacaagaaattattctacttttcattataaatctggattgctgtatgatcagatcattatgtcaagatctcttcttgataataagacgctggcttttcaggatgctcatatatttaattctgaaaaaatccgcagccggaccaggaattttgaaggacggcctttccgtacttatgccggtacacggtatttgggcggatacagtgatcactttccggtttttgtaaaatttaaaaatttacagtaaaaaacataaataataaaaaaagtagaaaatgaaaaattcgagcaacacaagctatcatttggattctattgacaaggaaattatctacatgctgatggataatgctaaaacttctttagcccacatttcaaaaaatgtcggaatttccaccactgcagtgcatcaaagaatcaaaaaactcgaacatgcaggagttattgaaaattcaatttcgttccttaatcctaagaaaattggatataaggtgatttcctacattggtgtatttttggatcagccaagccattatccggaagtggtaaagtctttgcatgatatcaacgaagtagtggaggcccactatactacagggaattataccatattcctgaaagttctttgtaaagacaatgatcatctaatgcagatccttagcaaacttcaaaagctgaagggagtaacaagaacagaaacttttatatctttggaacaaggtatttacagacaattgaaagtataacgacatgaacatagcccaatatttggattctacttacctgaaaacaccagaacaatcaggtatatcccacgaggaaacacttcaaaaagataaacaacttgcgcaggaagccatagataatggaatctttgccgtgatgattcgtccggattatgtatctgagatcaagaaatatattcaggaaagaaattcaaatgttgcagtaggaactgtaataggctttcatgaaggtacttattctattgaagagaagcttgcagaagcttcaaaagcaatagaagatggagccgatgaactggattttgtgattaattacactgcatatctgcagggaaatataacactggtaaaagaggaatttgtacaatgtactaaactatgtctagagcatcataaaattgcaaaatggattatagaaatcgcagctttgactgatgcacaaattgcagatcttactaaaaatatttctacctgggcagaagagaacttctctgaaaacgaactgtcgaaaatttttgtaaagtcatcaacaggtttctatcagactgctgaaggaaaacctaacggagcgacctttgaaggagtagaaattatgctcaataacgccggtaagcttcctgtaaaagcagcaggaggagtaagaactcctgaagatgctgagaaaatgatcaatatgggagtaaagagaatcggaacctcttcagcattggcactaattaaaaatgaaacttcatcagaaggatattaatacaaatccaaataaaataaaaaccatcagttttgctgatggttttttattttttatagctgtgcctgatattcttcgtagaattgttgggtttctttgatcagactgtccatttcttccatggtgaaaacttcaaggaatttttttctgaactccttaaaatgaggaatacctctgaaatagttgctgtaatgttgtctcatttctaccaagcctaatctttctcccttccattcagcactccattctgcgtgttgacgaaccgctaataatctgtctgaaattgtcggttcaggtaagtgttccccggttttaaagaaatgcttgatttcgttaaatatccatggatatccgatagctgcacgcccgatcatgataccgtcgcatgcatacttttgtttatattctaatgctttttcagcagagtctatatcaccatttccgaagatcggaatctcaatattcggattttgtttgattcttgaaatatgctcccagtcagcttcacccttatacatctgggcacgtgttctggcatgtatcgtaagagctttgattcctgtttcctgcagacgttctgccacttcatcaatattaatgctggtgctgtcccatcctaaacgggtctttaccgttaccggaagatgagtagagcttaccacggcttttgtaagacgcaccatcaggtcgatatctttcaaaacaccggctcctgcacctttgcacactactttttttacaggacatccgaaattaatatctacaagatccggatttaccgtttcgacaattcttgcagacatggccatagcttcttcatctccaccgaaaatctgtattccaaccggtctttcataatcgaaaatatcaagctttttacggctcttgatagcatcacgaattaagccttcagaagaaataaattccgaatacattaaatctgcgccatgcatcttacacaaacgtctgaacggaggatcacttacgtcttccatcggagccagcaaaagtggaaattccggcagttctatgttgcctatttttatcatggtgcaaatttacgaaattcttaaaaaacaaaatttttataagtaagatgtggtactatgttttgcttgtgttgttgtgtttaaggtattttatgatattttgtttaatttttattaaatatatttaactgattatcagtatttattgaattttattaataattattttttatatttagtataataaaaattaatgtcatgagaaaaattctattttgtttgatggcaattttggtttcatcaactttttattcacaagtcaatatttctgctacggcgggaacagccacaggaacttatactacgttaaagggagcatttgatgctattaacgcaggaacacaccagggtgccattacaatcagtattacagcaaatacaaccgaaacagcaactgccagtctaaatgccagcggaggagcagtaaattatacgtcagttgctataaagcctgcgacgggagttacggctacaatttcaggtgatattgccaatggacctttagtgaggattcagggaagtaatatcaccttagatggaagcaacacagcttcaggaaccacaagagaccttacccttaccaatacttctgttacagcaccacaggtattaacttttatagcagcttcagctgctgctgccaatacgaatatcacggttaaaaacctgaatattgtaaacggtatcaatacctcttccgcatttataatgtatgatggagctgcaactcctacaggaggcttctttaataatgtgaccatccagaataattctgtgaagaaagcctatataggaatgtatttatttgcagctgcagctgcaggtaacggcggtaacactctggtgacaggaaatgatgtgagtgccaccggagcagatgcagttcgtctttgtggaatttatgtgcagggagcagacggagtaactgtaagtaataacacaattggcaattttgaaactacaaatgctgagattaagaggggagtctggtttgcaactgcaaccgtaaattcttccattacttccaataccattactaatcttggttattcgggaactggcgccggcggagcttcagggataacgataacctccggtaatacaggagcttcagcagtggctaatattaatgtaagcggaaatacgatttcaaattttacttccagtggaacgggaagtctttttgccggaatttatgcaggaggtaccttgacgtcaggtatgaccatcagtaacaataaaataaacgggattaaaaataccaacgtatcaggatatggcgcccagggtatttatcttgcaacaacaagtcttactgccaatacattagttgccaataatgttgtgagcggtgtagcaggttatggatatgcaacaaccggaggagtgaatgataacggaaacggaattgttattgcttcaggaggtggatacaagctttattataatactgttgtaatgaatgtcagccagactgtagcaggaagaccatctgctttaaatattacaagcggagtaaccggtgccggaggtattgatgtgagaaataatatttttgtcaatactcaaactcaggcgggagacagatatgctatttacgccggagccgtcagcagtgttttctctaccattaactataacaatttctattctaccggtacgaatcttggctatatcggaggagcagcaaaagctacccttgcagatatccaggcaggattcggaggaaatataaactcattgaacatactacctgtatttgtatcagccactgatttccatttgtccgctacaggaaatgccactcttgacaataagggaactccggtagcagaagtaacattggatgctgatggaaatacaaggaatgcggtaacacctgatcttggaagctttgaatttacagcaactgtattggcagtgaatgaagctgcgaaaaagaatacggttaatgtgtatccaaaccctgttacagattacctttatatcaataatgacagcagaatcaaagatgttgaagtatataatgtttcaggccaaagaattcttagtgaaacaattaatgctgaaaaaggctctgtcgacatgagacgggctcctgcaggtatttacattctaaaagtgaatggagaaaaaggatcacagtccctgaaaattattaaaaaataatattgagcttattaccaataaaaataatccctgatagtgatatcggggattttttattttgaaaatcatcattactattagaagcttgcttttacctgcatacttccgatatgaatcgtacggtcaccagaatttcttccttcgtaattaaggttcaactggataaatgagttgatagcctgctgaataaatacactccatacctggttttttccaggcttcaaaccatccagcatctggtttcctacaatactgaaattgtttcctgtaaaattattgctgatgaacgagaagtttccgcggatcgaagtctttctgcgttcccattggatggttcctgtaacatcaaaagctttaagaagctcttctccgtccaatctctgtttctgacggaaggcagatgataattcagcctgaatggcgtctgtgaatttataagttgccttaggcttggtttcaaagttattcaaacggtaatctctcgttgtaaataattgtgaagagtttttaatatcatgaaccgagttttcccaatctaccctgaattctttattgaaccaatatccgatattcaggaaatgagaagtctgctcgcgttcttcattactgaaattggcattgatgagattatcgttggtaataaacctgtaatttccattccagcctgatttatcagttggattaaactgtacggaagcaagaatattctggtttttaagaatctggtcactgttcttctcaaaaggattcaggacgagaaccttatcctttttatagaatgagttttgggaatttaatgaaatattaaaattccaccgctttaaaaatccgttttctgaattaaaaacaatggctggattcacaaataatgccagctgtaatttatttttattagacggcaggtacctcacagaatttgtatatacccggatatattgtgcaaggtcggaatattcggcaatttcaaattcgtccagctgctgaacgccatctccgttgtaatcggtccatttataaacaccctgtccatcagttactttaatatattggaattctctctgtgcttcctgtccgtttccaagttcatagaaagcctgaaggcgcatcccatttctgaaaagctgctggttgtataagatgtttccaactacgaaatcattatttcgggttacttcaccttctgcacccgagtagaaaaactttcggtaatgaattaaagcatttaaagtggttctttctgttttgatgatctgactttcagccatgattcccagaatattgttcatattctgaagtctgttgtcacgtaccgagtcattatccctcatgtatacttttgtcaataatttggttctggtgctgtctccgattttcttttgcaaaaagatttccttccagctgaagctcgtgacatccataagctgggtatcgttatacttcttctcgttatgctccatgcttccaccaatggcccagctgcctttcttaccggtaaactccgttgaaactcctccacggatgaatttcgtatcctgaagggtagcattggtactcagataagataaatttcccttggtaaaaaactttcctgtaatccatccgaaatccaggtcatttttaatccctttgtaagaatcctgttcattcagataattgatacggtaatttagtgtagacttgttattccatttattcagaaagctgaaaataaatctgttttgggttctgttattgaactcctgtgtaaggttgaaatccctggagaattccacatcattaattcggtcaaggatatgaaactgcctgtctatgtattgatattcaaaactaggcgttcctttccatgtattctttttgaaacttttatttccgaaaatacgccatgcatatcctatattctgatcagaatcttttgacgaaaataaattgacatcataattactcagggaaatatcagcgcctatcttaccttcattcagtaaatattcagaatttacagaatatacctgtgatttctgaggagaaggaagttttcttaccgctctgtaatctccggcgttaggccctacatattgaaaaacacgtccgttattcgtggtttgtgctattttataatcccccagattagctccgaaataagtaaaagaaacctgataaagtgttaagcttgaatcagtagagtattcatagaaatttccggcggagtttagtttatataaaattttattgacatcatattcggtgaccactcctgaaggagcatacatcaggtcaggattatttccagcctcagcaagaatctgctcgtcttctttagaaagatttaaagaaagaggagcattcttattgtcattttccatgaaccagtttaatcctaccttgaatttttctctctgatgttccagttttcctgtaaacagatatcttgaataatttctgttggcgtagttataggaaattgtgataaaattctgttggaaaataggacggaaactggtaaaagtaacctcaccggtgttgtagttgataatataatcctggttttcaccacgcttcatcaggataccatctatgaaaacctgttcggatccggagatcagagtgataaactgttcaccgtttttacctgtcagacggtatggcccctggttaccttcaaccccctgaaaacggattctgtggaattcacttcgggcaactcctgcagaaatatctaccaaagtcttgttttctttcccgaattctgtctgaaactgaagtcccatactccttctctggtatttggcaaaataattcttagcttctataagatcaaggtggccagctcttaggatagacttttccttaatattgagctgcatatagattttgtcaaactcctctaaagtttgggtataaccatcagcctgaataggaaggttatggtctgaaatacttgctaagatggtaacgtcttttgataaccgtcctgaaatctgaaggtccatggagctctgcacagactgtccctggttgttaccaaaagtaatcccgcggataatggaaccttttgaattaagctctcctaaaaatctctttttatcattcttggcgagtacagcttcatcaataatgatcttgttatgtgttcttatgaaatccagggtatcttttgcgaagatatcctgttccagttttgcagcaagaatactgtctcttttgatgctgtcttcagggatattgggatttttccatgaaaatacctgagcatttcctgaaaatatgcctaaaaagaatacaacgaatagaatgacaaaattccgcaacttttaaaaataattcgtaaaaataattaaaaaatgttaacattaagaggttaactataattaacaaaaacttaatctctttattgtccaaaatcaaaaattagatgtagttttgttatgtaagtaaattattaacaacaaaaaatttaaatcatgaaaaaactttattcgttatttgctacagtaatgttagcaagtggaatttttgcgcaaacagtcttcagtgctacatttgatgatgtaacaggaacaggaggaaatgatggtgcttggagtggaggtattgcatcaagcggatttgctgatggatccagctcttatacaactggcggaaactggacttttactaaaatttataaaggaaacggatgccttaaggcaggtacaagtagtttaaaagggtcaattactactccaacttttaacttaacaggatcagctaccctaacattcagagcaggtgcatgggatggagctagtgaaaaaactactttaaatatatctgcaacaggtgctactctagatcaggcaagcgtaactattgtaaaaggagctttttctaactataccgtaaatattacaggcgctaccggagctgtaactcttacatttgaaggatctgcagctgccaataacagattctttattgatgatattattgtaagcacaggaacccttgctgttcttgatactaaaaacgtaaaatcagccaactttgtaaaaaactctttcgttaaaaacaacgaaattgttttcggatctgatgtaaaagacgtaaaagtgttcaatatgttcggacaacttgtaaaagaagcttctgtaaaacagaacgaagcggtaagcgttgctgaattggcaaaaggaaactatatcataacaggtacagtaaacaaccagccggtttctcagaaagttcttaaagactaatttctttcagataaaaataaaaacagccactccaataaagtggctgttttttttatgagtattctgatttttagatttttatatgatgcatatttcttaatttggtggtactgtttttgatgttttatgattacccattctaaaaataataacgatgaaaaaaatctttactctgtttggacttacattattgacttctttttcaaatgcccagattgtgatcaacgagatctatggtgggaatgcaagctctggtgctgtattgaaaaataattatattgtccttaaaaatatcggaaatacactggtttctcttacgggtgccagtattcaatacgcaccggcgataggtcctttttccgaatatcatactttgccggaccttacgctgggacctgatgaaacttatttgattcaggagtccgcgattgatggaggagtggagaatcttccgacacctgattttattgcaactacaattacaaattttgacggaactcccaataaatcttccgggctgagaatttccagtgtatcaggaaagattgctttggccggaaatatagtacaggtaacagggccttctgcttccaatgtactggattttgtgggatatggagcaaatgcagatcagtttaaaggagatgggccggctccttctcctacagctaccactgctattaaaagaagcctgttaggaaatgatgataatatggcagacttttcccttgaaggaagcgtaaaatcgggatttgtacagaatccttttatcaaagacagtaaagtagtgttcggaactgaggtaaaagacgtaaaagtatatgatacattcaggcgggtcgtaaaaaagtcaccgacgaagctggcttcatcactggatattgcagagcttccaaaaggaacttacatcgtcacaggaaccattaacgatattccgatttcacagaaaattataaaagattagtttttaataaaaagaacagcaaatattaataagctgttcttttattttatagacgtgttttctgtccattgaatgcacaaacagaatcagcaataatttactgttaataccaacctcttcttgctgcgttaataatggaaccgagattgagaatcaatgtatatctgatacgttttccataatccttgaatgaaggttcaaatcctaaagaagactgtatcgggaaatatacttccagaaaatccggaatgattcttactttaactccggtgtcccatataaatttagccggaagatctttatttttatacactcccgcatctgcatatacatggaatattttccatacactagaatccacgttggcagaagtaatccattggtttaccgatcccggcagaaaagatttaaaaccaccatcagcaagtataaactgctgtgaaagaagaccgctgctcgcactttctcctaaaagagtataagagaaagaatagttggaaaccctggatattccataattgaaaaggttattgcgggtatcgtttcttaggaaatatccggcaaacaaacgtaaactgagcttttgtttaggggcaaactcccatctgtagaagccttcagctgttattttgttgaaatcttccattccctgggcactcaggctaaaacttttttcatgaatcatctggctgtcactatagccatatccgatactccagagattgtatttgctatagtcattataaacaatcatttcagggctcaggtctctttcaaaataattataggaaattccgatacttctgctcaccgtacttctcggattctttctgaaactgatagaggaagatatggatgtttttctatacgccagatcataatcataatgaaagtatgaaccggaaacaccgaatgtcagactccggatgatgctttcagctggcagaaaagagtaggatacagctcctgatcctgttaattttcctgttccggtactgtaggttggtgtaatggagtacagaaatttctgatcaaacagagactgattttttaaattaattcccaaaaggaacttatcataagtattgttgaaacgtactcttgggctgatgtaaatttcattgtattccgggttaggaatatcttttaataatttaagtttaattttttttgcattggaaaacagtccctttgcataaagaaagttatccctgtaattggattcggggaaaatataaccgttatttaaagtaatcttatagatgttttctgatgcaggcagagataaaatggaagtacgttcattttcctcagtgtctatccagtattcctttttttctccttctctggtttctgtctgtagttttaccggaatagagatatccgtattttttacaattcttatttgcagggaatcattttcttttctgatatttttcaatttaaaatcaaccctgtttttttgtttgaaaaagcctgaaagataagcagatgatctatttttttcagaaagatctgtcagaaactcttcaggattgattttctttcccgagttttgagagatataattttttatgatttcattaaaactgtcatatcccattttatcagccgaataattgaaaagacttccggtttcaaagctactgacagccatatcattgaaattactcaaaacaggaaaatgctcatcgatcttctgatcaagattctgcagcatgatatactgataagaaagtccgtaacgatcaagaagcttcaccttggaagcatggaacagctttaaaggtttaagaccaaatattctggtctcaggaagtgtgccgagaagtttagtatcagcatagaattttttgagatactgaatttccagataagattttaaaccatttttaaaccagtgatctttttctttatctgcaattactttttcatccaaaacttttttagccatgatcccaaaataatccagatctgtattttctgtatcagtaaatagacggaacctgaatttccagaaagtaatatcattatttccgaaaaagtcttctttggctctgaatttatctgaaataaaaatacttttcggaagaaatcctatgcgttctttaatgaactttaattgcaaaggaagataaaattccaggttttgtttttcctccggtctcaggttatatccaaatttgatatctatttcctctccgtcaacattggtttttatagaaggaaaggctgttgtggaaaccaaaaattcagggtctgaatcaaggtatcccttaaatgaattcatctgaacctgtggaagattaccttctacaaaattattaacaggaatatcaaagttgatggtccagaaagtattgaaacttacctgctcttcaatatcatggtagtttcttttggaaatattgcccggatcaaaatgatccggaacaataaagaaatattttaataaagtattctgagcggaagttccgtatcccgtaaaagttttatcgggaagctgcattttgtactgcagctttaaagaaacactttcaccaggttttaatgcacttttcagaggaataaaaaggttttcatctgagagcgtattgacaggtgtcacttcattttctgaatctttaatattcagttcaagtagtttccctaattgactgctctttgcaaaatgcaaatcattattacggtcttccagttttctgtagactaaagaggtgccgcgtttattgtacgcggaaacccaattcagaagttttatggtttgcaggtcttttccggaatgattgtaataaacaatttcctggctgacttcaaggttctttttgtcaggagacagtttagcttcaatgtatatactgtctgtctgcgcagaaacctgtacaactccccataacaaaataaggcaaatgctgatctttttcaaatattcgtgataaagcccaaatataacttattttgtatatactttataggattttaaccctgaattgcttttttttccaaagaattaatatatgcgttccatccctctgtcttgtaggtgatcgcagaggcttcaggatcatcagatttgtaaattcctcttcctacgataataaaatcagtatgaagtgttttgaaaacatgttcaggagtgttatactgctgtccctttccatctccggaatctgcaagatttatacctggagtgaataataaaagttcttcaggcagtttattctgagacacgccgccaattacattaggatgagatgaagcgatttttaaagcctcttcacgatagcttgctgttgttaatgttcctttggaagacattccaataatagctaccactcccacatttttgaaacagtctaaagattcaaaacctccgataacctgagatgtgacaaaatctgcccaatctgttattttaaaaactccgcttgtaaactgaagctcctgtgtatttccgatatcagcaaattttctgtcttccatcagtaaaaactggtgcttggcagcaattgctttcaaaggaataattgttttttcatattcgaaatcagaaataatatcgatatgtgtttttaaagcaataacatgcgggcctactttttcagcaaactccaatagctcctgagttgtagtaacgtcagcagaagcaataaggtttgattttttcgctaaagctgtttccagcaacctttttgaaactgaatgctgtgcaacctgaagtttctgctcataagaagatctggtttcttcttcgaactggatatggttaccctgaaggaagtcctggattctttttacttcttcatccgacaattctccggtttcctgaagaatagtgcatacttctgaaatattgaaaagagtgtgtactctgtatcctttgctttccaataattgttttcctccctgttctctgtccagtactacaacaatatctgaaaccttaagatcttcctgttctatttcaggaatggtttccagtaaagattttcctgaagtgatgacatcttctaccaaaagacagttttgtcctttctgataaattccttcaatcagtttttttgtaccgtagcttttagcctcttttcttttaataattaatggaatatagctttccagcgacattgcagtagccataggaagagcagcataaggaactccacagattaaatcaaaattatctaacggaagcatttccaataaataattcgcaagattttttaaaattttaggatctgaagccaaaggtctcaggtctacataaaaaggactttcaataccactttttaaggtaaaccttccgaatttgatgatgcctagtttatagcactctaagaagaattcttttttactttccattattttttattagatgttgcaaatttaaggaattgaaataaggcttaaaaatttatcactcatttgtaaataaaaaaccatcccgaatgtatcaggatggtgtgaaaaatataataaactattattttatgatttcggcatcaataacttgagtgcctctgtatttttgctcggcttcccataacaaaaacttatcaacctctttgatgagcttgggaatggtaagtgacaatactgccaggtcgtccattacgccaagtaccggtatggcaaattcaggaagcaggtcgataggagagatgacgtataaaattcctagtaagggaagaataatgtctatggatttcatgggataaattccttttctccacattctgaccattctgaaaatatcagggattttttttacaaaacccttgtggttgatagcttcctttgcaagatttaattttgaatacttcattttgtgtttggatttaataaatttttcaacgctataaatttcacaaatcctgtaccaacaaattataaaatttagttaaagtattatttgataatattgtcaatgaactgatgcacagtctctgtgtcccaatcttttgtagcatcctctttaataaggattcttccatgcttatccagcaggaaagtggtaggaaacaccttaggaagaattttctcagaaatcgggctttgcgcaatatatacaggaacagtataattattttctttcaaaaattttcttacatcttcttctttatcattcatcgcaatcagtacaaaatctacatgatcttttctggagttatacaatttctgaatagaaggccactcttttctgcagggcggacaccaggttccccagaagttaaggaatatacctttgtctttaaagtttttcaggtttgtgctgggtgcattaatgcctttgagctctatatcataatcttcttcacttatatgtactgcattttcaatagttgcaacgggaaagaatgtatcctttagaaaatttcttactccgggtattaaagcaataccagcgataacgacgattaatacaagataaatgatattttttttcatatctctttttttatagcagatctaaaatttcctgaacagcatcttttcctctgtttttagcgtaatatatctgcagatcattatagaaagtgtcctttggatacgcttcaggatcagctttatatttcatcaaaagttcatatccgtattttggacgtgggccccatgaattttttacattcaggtctttatccaggataaggactttaggaatagattccgtaccattggtcagaaactgattaattaagctcttatcgctgtctctaagaaaaacccttacttcattatgcccttcaaaaaatctgaaaacagccggaacggttgcgcttgcatctccacaccatgcttcggaaatgattaaaatctttccgtcaaagtttttggcagcaagttctttcaactgatcttcatccggaacgtatttttttactgttctgtccattctttgaagacccagctcataatattgtttatagtcagcttcctgttggttggcaggatgctctaatctttcttttgcaatctgaagatattcttcaaaagaaattcctttatcccagtaatttttcattaccaaaaagatttatgttaaaaattattgatatttcttgttttgttgatcaggaacagatctgccaatacaaaagccgcaaggctttccaccacaggtaccgctcttggaacaacgcaaggatcgtgacgtccttttccttccaccactacaggatttccatccttgtcgatactgtcctgaggtctcagaattgtggccacaggtttgaaggctacccggaagtagatgtccattccgttggaaattccaccctggatccctcctgaaaggttagattttgtagtaaaatctgtattgaaggcatcattatgttccttacctgtcattttagctccgcagaagccgcttccatattcaaaacctttgcaggcattgatgttcagcattgcttttgccagttcggcctgaagttttgaaaagataggttcaccgattccgacaggaacatttttaattacacatgtaattgttcctccgatagtattcccttcttttttaatctctttgattcttgcaatcatcttttccgccgtttcagcatccggacaacggacgtcattgctttctgtctgagaaaaatctaatgcctgataaggtttttcacagaaaatatctcctacggaagaaacgtaagcgttgatctcaatatctggtaaaagctgtttggcaagagctccggcaactacccagttcatggtttctctggcagaagattttcctccgccacgatggtctctgaaaccaaatttctgatcataagtaaaatcagcatgacttggacgatatgcacctgcaatatggtcataatcctttgatttctgattttcattttcaatgataaaaccgattggagtacctgttgttttcccatcaaagattcctgaaagaaactttaccgtgtcactttcttttctttgtgtaacaattgctgactggccgggttttcttcggttcagctcatattgaaccttatcgagatctaccgttaaacctgccggaaaattattgatgataccgccataagccactccgtgactttctccaaatgttgtaagactaagaagattacctaatgtattgaacatgatacaaaattaccgttttttcttcagataataaagtttcgggattagttctgtttatatgtgtttttgatagtattgataatctttaggacttctcttttttcatcttgagacatttttttccagataaatcctttcttaacatcattcttgtctgaaagctgtggaaaaattcctgcttttgcatcatcaaaaagataagaaggtgttatagctggaattggagtatcaaaactataaggatacttatggacaacattaaaattgaaattccctactttaaaggtgttaaacttttcgtatttgtagtttaaaggtttataaagctgttctttttcaaatcctgccataaaacttccggcccggaaacctggtatatatttccggacaaattcaggaaacgataagatggaaataaaaagcaagctgagcgcagagaaaacaacgatggattttttttgatcaaaatattcgtataacatgacaaagaatatcacaaaaaaaacatccagaaaaaatctgtattgggctgaaaaagccaaaataaatatactttttatcaatattgaaatgcagatgaaggtaatgagctttcgcttttttatcactgtaaatagtatgaaaataaccaggctcagaacaaaaaggatattgatttttgatttaatcccgtcaagtgaaaaccagtttttaatataatcaacggtagaaaattgttgaatttctttataagtatattgcatatcataggttttcatgacggcaaattctgaagatatttttaacacttcaggattaggtttccaagatagtcctaaatcacctatcgctacaggaaagatggggtatccgaatgtccatagatttttaagaaagaataaaaaaagaatggaagtgcctaaaagaagctttttgaaattattcttaaaaataaaaacagagcttaagaaaaccagaactggcaaccatatcattgttggttttattgtgaaaacaaatgttgaaaaggcaaaaaggagagtggtatttttattacctgctatgagttcatttaaaataatcaatgagaaaataatacctggaaggtcagggcttggagattgtgaaaacagcagcagaaccggaagaaaacaaagatgaatccagttttttctttcaacaatatacaatacataaatgatcagtaggactgtgttaatccttaaaaagggatctgaaaaatttgaaaatccggcctgaaaaatatgccagacagacatctgtcctaaggtgaggtctacattggaaattccccttatcagtccatgttctgtgagccattttaatgtaggaatataatatccaaaatgatccaatatataaggataaaatgatccggcgaataggacaacgagacttgcaatcccaattaatcttaagtttttttttgaaaaatgataaaactccaggtagagtttatttctaaagaaaatgaataacccaaagaatatagaaactgattctacataaacattcaatggaaaaaagaaagagacaattgtccatgtaaggcttattatgagaattccggacaggattttaccggtgattccacgaaataaaatccccgataaattttctatgattttcccccagcccattaagaccgggataatgaaaattgaagaaaacagaatcagtaacataaaaaaagattgcttaaaaataagcaatctttaactttattgtgaaaatatttattaacgaggttgtacccttccgtcttttctatcctgagatctaccaatagtatatcctgtagcaccacctacaacaccaccaattacagcacccagtcctctgtttttcttagcaacaagagctccgactgcagcgccacctacagttcctatgacggttcccttagcagctttgctccatccttttttctgagtagttccctgtgaagtaccacttccgttattggcataagtaccgttactgcctcctgatccggaatttgaacttctgtctctgtatatagttcgtgtttctctgatcacttttggtcttgaattatttgcagcagcaactttggctttgctttctgatatactatctgcttttttctgagcttcatataccattttttctttttcaatagccagcttttgtttttctatttccagctgtctggcctgaaattcaagcttctgtgcttccagtgatttctcagcaacgctgtcatctttcttgcaggctgtcattaaaaaaactgataaaaaacctgctaatactatctttctcataattcaaattttaaacaataaagtcaaatgactttgattttaattctattttcaattatgaagccaaattttagttaaggaatgttaaaattaagaatggaaaagggaaataattcatggatttaattgattttgtactattgatgcagggtttaaggcttatttgtaaattttaattcactgatagtttttattaaattcatataagttgattatttttgaagaccaaattacttttaatatgaaaaaatcaatttttacagtttcagcatgtattggattgctggctgttgcaacttcgttttcctccgcggaaatagtagagaataataaaaatggtgcagaattatctgatacagcaccaaaaacgcagacttataaaatccggtatggacttctttcaaaaagcggtactaaaattctttcgggcaattatgacgtaggaagttttcttgctgaaaatatggctacaggagaagtatatgatacttattatagtggtggattccagtcggttccgcaatactatgatggccttcctgcaggaacctatactttttctgccatgcagggtcaaggtggctgggtagggtatggaacggtagttgctactgtttcggatgcgcaggtagattcggatggatatattacagtgtatattccgatcatttgggaagaatagaccttgtgaacccgaaaatatttagttaaatttacctgttcttgaaatgaagattatcaattcatttatataattactattggtttgtgttatttaattatattttgtattaaataaatactaatacgttttatttatataatatttattttcttcaggatgaagtctgattcttagagaagtattcatcattcaatttatttattgtatatgttttcagtgtttgaaaatgtaataataaagatatgttgcaatgattctacaatattctgtttggatttttctaaatagatttttttcatcatttgtgttttttaggcctcctaagggaggcttttcttttatagctttttatgattctacgcatatgtatgttgatccggaaaacgtacttttactacatgcattttcgttccatatttatcaaaatggtttcttgttccgagaagccatttattatatggtaaatatctatccaccaagaattaaatacggtatgtattggagaaaaattgtgaggtattacaaatgattaaacggtaatttcactttttgattattgtctcttttttgataattaacgaatatcctatatttaaaagaaataataattttatgattgtactcataaaattaaaaaaaagactgatttatctttgataaagaattaatagataaaataatttttatctctgatataaaattttttttcatcatttgtgttttttgaggcctccatttctgggggctttttattttaatttatacatcaaagagtactctgccatcaaaggggctatcccaaacaatatagattttgttatcagatcttcgtaatggcgcctgaacaacttcatattttccttgttctgtcagtttttctacaataagattaactccttctcctatttcaccaattgtatattccaagtgatattctttttcattggtttttgtgaaatcttctttattaaaaattttttctgccatgatgatttacttttttagatatattcatttatttaggtataaaagtgtgccaatttggtacttaaaatttttttgtggccgatcaagttattttagaaaaaaaatatgtcctgaatgtaaattttattttattaaaatgtaaattattttttttttaatacttttgcgggagcgttagatttatctgaaattattataggtaattatgaagctgtttttaaagtatcaatataattggtttaaaatactgaattgataaaaatggtgcctcgtaaagaaatgaattttttttcttaaaattgaaattcttggcacgatttttcaatatagaaatgtaactcatgtttaatttgagttttcatggttattagtttttatcctcggaatttccggggatttttttttgtcctaattatgaccttgctcataaacgtactttggtaaatcatttatctttgggtaagataattttatccaccattactttttgcattatttaccaagctcttcgggatcaatgaggagcttgttttatgaataataagggaaattcacattataaataaaaagccataaagattgaataatgcgtggaaaagtaccgttagaacaaaactgtatttaggaatgtgtttatggtaataaatataaaggttatttaaaataatacctccaaagaatgtcattacgatgtagagccagttataataatgcattgatgcgaaaatggtactcataataaggatgcaaaatgctttattgtcgagccttatccatttgcttaaaatcaaataggggagatactgaaatataaaagtttcaataaggggggcaatgaatatggcaataaagtttaattcattttttgagatattttgagacttattgtaattgacatcaaaatgtaagtaggtgtcattaatataattgaaaaagtacccattaagaactgccaagacaaaagaaatcagaaagaaaaggattaactttttcatagtagttttgttggataaaaaatcagttagttaagttattgttgagtctctatttctttaatgtaaattgaaggtgtagtgccggtttttttcttaaatgcaactgcaaatgcctgtacattattatacccaatttcttctgcaatagccggtaatttataagaccggaattttttatcttttaccagtctctccagcacataatcaatacgcaaatcattaagataagaagtgaaattctttcctttatgattgttaatagtttcggataaataggctgtattggtttttatattttttgccaggctagctaatgtaattccgttttttaaaaagagctgtttgttttcaaaaatttctagttctttaagaataaatacagtaacatcttcaggaaccattttagtggttttactttctatttctgcctgctcttgtactgggggttcgggaacttcttttttgagatctgttgattcaaaatttcttttttcaatactttgaattaattcctgagctattctacgttgttcttttgccgttttttgggctttaaaataaagatataatatcaataatagtactaccgacaatatactaatagaagcatgtaaaactgtttttctattattcaaatcattaattatatcttccttttcctgtaaaaggtttggtgtatcatattttttaggaagttctgtggacaaatattgaaactgctcatcaagctttttatctacttttaaaaatttatcaatataatacaattgtttttctttatcatcttcttctttgtaataatctatgagataagtatatacttctcgaagttcaggaaaactgatgtcagtcttttgtacattagaatctaacttagtgtatatttctacaactttttctttgttttttaagccttcataacactttcctaaattataaagtgcagtattagcattatttggattgatttttattatatcgtcatacactttggaaagttttgtaatggcagttttatattttctctgtttaaggtcatattttgctgataataaagagtataagctaatatcataattattcttatttatattggcaaatgcttgtccttcccgaatcagaatacttgcagagtccagtttattaatatcaagataacaacttataagtgctatgcgtatttgattatgctggtactcgtctgttatattatttttgttgtataagtaatatctgaatatttttgctgcctcaacatttttacctatataactattaatataagcaatattcatattggcataagctgtctgtttttcatcattttgatctttagcatatttcaggcctaggacataattatctaatgctgtttttaaattatcatacttataatatagatttcctttaatcaagtaagttctggcaggatataaattccctttaatatcttttgtaattttagctaaactgtcaatgtactttaaagcagtatgaaaatcttcattaagatgtacaaggttatagccttcagctatttcaagagtatttttttctctttttgctttttggagataatattttgctattttttcagattgctggattcttatatgatcataatggtcatagaatatactcttcaagtccttataattgagagattttaaactatcacttattttgttttgagtataaaatatattgctaattataaaaaataaaaaaagatatttgtatttcatcattttgatataagcgctcaaaagtattaatttcaacttaaaaatttgtatctatatcaatagaatatgtttttgtgatgtatgaatttataaatctatgcatctattttaaataaaatattgatttgttagatatagataattaagagtatttatctgagaagctacagtttaggattaaaactgattagggaatgatgatgaaaatctgatattacttcaaatgaagtgtgaaaaggaaataagacaattactgattatgacatatatattattgattttgtcctatgttgccattatataatgactaccaatcaataaaaaacaaaaacctctaaataaattagaggttttttctgaggtacctagcggattcgaaccgctgtagatggtgttgcagaccactgcctagccgctcggccaaagtaccatttttaccattttcaggtgtgcaaatatagtaaaatttctttattcacaaaagcttttaagcaatttctttctttccaagatcttcaatttctctttttgcttgaatttcagcctgataattttttatgttaattactcttgtttcactccatttatcgtgccagccgttttctccgaaaaaagaaagagaattgaaagggaccattcggtaaaaaatacgccctactatttgtaatggtgtgggaggatttccatctatactgatgacttttgttccggtaatatattttgcaacggtctttcccaaataatattccatgaaaaagaaataggagaaatagacaaaaaagtaagaaataataatggaaatggccacatttgtatcattatcaagatcttcttcataaatcacttctccaaaaacaatagtataaaacaatgtaaaggcgaagaagaatacgtaaaatataaactgaataaagatcctatccagaaaataattaagaaatcgtgtgccggtagacgctttatgtctatcaacaacaattaaatattttctcatgttaatgttattagtttttagtttagttttttgaaatttaaaatctgttgacgaggagttttaatgaagcattcgtatcaataacggcagtgatacctgtattgctgagtaaaattttactaggtttaagattgaaaactttaccattcatttttaagcctttataatactctttattaaaggtttcctcgatactttttttcgaagtttcttccagttcctgggttgggatgccatattcttcctcaatcatttttacaatttttccctggaacagaagagaagccgttttctgcagaatattgttggttttcagcttaaatttggtttctgataaaacaatttttctttttgtttcatcatataccggaattcctgaaataatggacgttccttttatgtagccgtctgtttgagcttcaatgattactctgttatctacaccataaactctgatgtccgttacttttactttagaatcacgtacgtcaaattctttgttcaggaaagtttttctagccatattacttgcttctgtaaaaggaatattggctgtggtttgcaagataaatttatctgcaacagcaggtgttgtattaaaattggcaacgctggttacaggggaagaggcagccggtttacttccggtgaaagtttcggaatagatatcaacaccaagcgtagcattgatctgatttccataaaatttcagaggggtaatattaactcctaccgggcttactttcagccatgtattatattcttcagagatattgaaaggctgcagaaaagtattccaggccattagggcgtattgctggaagttcagttgtgttgccatttgctgatctattgttttgcagaatttctcctgttgctcttttaagcttttttcaaccagaggggtaataggaatctgtattcttccataatcaagaacaggtttggttacccatctgaagccattgggacgggtgtttgtagtaatagtccagttatttttaaaagtaactgttgtattgaaagacattaccgtttcaaaagtggtattctgatacgtatatactcctaatgtaccaattcctttttctgcccatatttttaatggaacctcaatcagtaaattctgacttgttccacctaccaggcggataggtcttgttttccagacttttaccttaaactgatcattattattgtctgtataagagtcatcctgataaacaagatctttcacagaagtattgatcatattgctcaactccgaaagagggatggtcacaggcattgtgatactggactttatctttggaaagttgtaagccgccaactgattatcaacgcctgtctgaccaaaagcgctgatccctgctactaaaaataatattttgaaaaatttcaatttgtatgtttttttaatcaacgaaaataagaattttaattttccggtttaaaactcttttccagctcaatgcttgcccctttcatttctccctgcataggaggtgctgttttggtgatttttaatttaatataatcaacctgtggaaagctgctgcgaatttttgtaatcattcttccggctacatgttccagtaatctggattttattttcatttcgctgtgaaggatgtcattgatgtcggcatagcttatagtgtcatgcagatcatcggattctgctgctttccacagatcggtatgaagttctacgttcagaatataatacgttccgataatattttcttccggaagtacaccatggtacgcatatatttttacatcttcaagatatattttgctcattgtttcagattttatgaagcaaaaatcgtcttaattcttcaaagtctgaatttatttctacagtttttttctcctttgtcatcaactcattcaatgactccggtatttcaatccgggtatgtattgctttttccaccgcatcagggaattttaccggatgggctgtcccgaggataaatcccttttgttccggattttcttgcaggtactgtatcatggcagtataggcgacagcactgtggggttccagaatatatccatgtttctgataaacttctgtgatggtgttcatcgtttggtcatcatgaatggaatacgcagaaattttattttttaaggtttcaaatttgtgtccgaaaagctctaaaattcttacaaaattgcttgggttgcctacatccatagcattggatagggtagctacagttttttgtggttggtaattctgagttttaaaataatcaggaatgacatgattagcattacaggcagcaataaaatggctggcaggcaaccctctgaaatgagccagaagtccggcacagatatttccgaagtttccgctgggtacacagattacgggctgttccttatagtgctgaatccactgttttaaagcaattaaataataaatttgctggggaagccatctggcaacattgatagaattggcagaggtcagaaataactgactattgatttcttcgtctgaaaaagcctgtttaacaaggttctgacagtcatcaaagcttccgtttacttccagtgcagaaatattttctcctaatgctgtcaactgtttttcctgaacaggacttaccctgtttttaggataaagaatgactacgttgatttgtggaattttataaaaaccgtgggcaacggcacctcctgtatctccggaagtggctacaagaacagtgacttttttctgctcatctttcagaaaataagacagacagcggctcataaatcttgctccaatatctttaaaggcaagagtagggccatgaaacaattctaaaatggctatctgctcactgatttttaccaatgggatctcaaaactgacagtttccgctacaatttgtttgagtatttctgaaggaatttcgtttccgacaaagtctttcatacatctgtatgcaatttcttcatcggaatattgatgaagattccggataaattcttcgtcaagctgaggaatactttccgggaaaaataatcctttttcctttccctggccttttatggttgcttctttgaaatttattttttccagagaatcttttaagttatagtatttcatttttgttttatttttcttcaatgatttgaattcctgccggatttatttttgagacatatacaaaactttctatttcaatttcatcataaactgatttcatcatgtgagccattttttctgccgattcttttttttctgacagcatgaaaatggaaggcccggaaccggaaatgccgcctcccaaggcatttagttgtaaactcatctctttgatgtggtcaaatttcggaatgagaatactacggataggctctacaatgacatcattgaggcttcgtccaattaatgggatatcgtttttttcaattcctgctatcaatcctgctatatttccccattgttcaacagcactttttaaagtgatatttttctttaaaatctgccttgcatctgaagttttaacttctacctgtggatgtacagcagttacaaacagatcagggctgttcagcggaataatatcaatcgggtttgttgattttaccagggtaatccctccatagatgcagggagcaatattatctgcatgccgtacacctgaagcgagttcttctccaaacatagcaaaatgaaccatttcttcctttgttaacttgtttcctaatagtagattggccccaaaggcggctccggcggcacttgccgcacttgagccgagcccgcttccaggcttgatatgtttatggatgattacttcgaaacctgttttcagattaaaatattcctggatttttaacaggacaattcccgcaacatttccggaaggctcttcaggaagctcgaaagcatcagtatgttttatgataatgtccggagtgtccagtaatctgaattccatctcatcataaggttcatgtacggccattcccagaatatcgaatccgcacaccagattggctacagtagctggtacttttaattttatttttttcatagtattattttaaatagaacggattatatctgcaaaaactccgcttgctgttacatcagctccggcaccggctccttttacaaccaggggttgctcagaatatctcaaggttttgaaaatgacaatattatctttaccataaaggtgaaacagatcactatccggggcgatatgctgtaatccaaccttggcttttccatcttcaaactctgcaacatattttagtattttaccttcgtttttggctttattcaataagtttttaaaatgatcttcatacgttgtaagcttttcataaaaattatcaacacttccttccatgcattcttccggcagaaaactgatattttcaatttcttcaaactgaagcggatatcctgcctctcttgccagaattaaaatttttcttgccacatcttttccggaaagatcaagtctcggatcaggttctgtgtatccttccttctgagcctgtgctaccacttcagaaaatgttctgctaccgtcatactcattaaagacaaaatttaatgttccacttaatacagctttaataaattggattttatctccgcttttgatcaggtcgttaatggttcctataaccggaagtccggcacctacattggtttcaaaataaaaattgcagttgtgatttcttgcggtgtcttttaatgttttatattgtttaaaatctgaagaagccgcaattttattgcaggcaacaatattcacacttctcttcagtaaactttcataaatttccggaacatcagggcttgccgttacatcaacaaaaacagagtttctcagattcctgcggatgatttcttcagcaaattctccagccgaagctttttgcccttgctgattccatgtaaggtaattttcttcagatatcccctgatccgcaaataacatatgacgactgttggaaattcctgcaattctaagatttattaaaaaattttcctttaaataatcattctggttataaatctgctgaaccagttttgagcctacattccctgttccacagatatatagatggatttgcttgatttcagattcaaagaattcttcatgaagtacattcaccgcttttttactgtctttttctgaaatgacaatactgatatttctttctgaggatccttgtgcaatagcccttatattgatgccgttatttccgagacatccaaacatctttgcgctgactccgcttctgcttttcatattttctcctactaaagccacaatggaaagaccggtctcaatttttacaggaaaaactctattcaggttgatatcatcagcaaaagaactgttgattgaatattcagcccgtaaagcatccttttcttcaatagcgacagtaatggaatgttctgaagatccttgggtaatcagaattatatttattttttcctgacttaagcattggaataattttgccgaaatacctggaatcccaaccattccgctgccttccagggtaagcagggcaatatggttcatatttgaaattcctaccgcaacctgcctttcattctcagaagatttaagctgatgagaaattaaagttccctgagcatcaggatcaaacgtgtttttgatgatcaggtcaatatttttaaccatgacaggctgaatggaaggtggataaagcacttttgccccaaagtgtgacagttccattgcttcatgataagatatttctgaaataggcttggcattggaagcaagacggggatctgcagtcatcattccgctgacgtcagtccatatctgaagctctgctgcatgaacagaagctgcaatgatagaagctgtgtaatctgaaccgcctcttcccagtgttgtcgcattatttttttcatcgctggctataaaacccgggcctacgatgatacggttctgattttcattgagaaaactgacaatattcttttcagtacaacccaaatctactttggcgtgagtgaaattactgtctgttcggataaggtctgcggaattcatccacacacagtccagctcctgatgctgtagtcttgcggtaataatttttgaagacagaaattctccgtaagaagcaattttatctttgattctgccggtaagctcaccaagaacagagattccgctgcaaaggtcttcaatatcattaaaatgtttcttcacaaagctcagccatgaactctgttctgcaataggaaaaagttctttcactaagttaatatgtttttcctcaaggttttgaatgatctgaatatacttttcatcttttacagaagcattttcagctgctttgatcaattgatctgtaacaccatgaagcgctgatacaattacaacaactctgttttttaaagattcactttttatgattttttccaccagtaagatattctgagaatgggcgactgatgttccgccgaattttaaaactttcatcaattatttatttgaagttggataaaaagaagtagttactctttgaaaaaagagtacgggtaccggaaataatatgtgaaaatttaccccgttatggggtagttgttgtagttgtgaatgtagaaacagaagatatgcctgaaataagtgatctcagggcagaaatatcagatatgtttcttaataaattcattgtaacggaacaaatgtacaaattattttgaaacggccaactttttactactataaaatttatttccttttttagagatatatttgttgtaattgattaaaaatcttatatttaggattctaactataataaatgtaaccatgaaaaattttaaaaaagtgaatcgcaaaaatctaaaatctatcagtggaggagatgtgaatgattgttttgagtactgccctccggggccatatggaccaggtgaaccaaagtcgtgtgcagattatcacgccttaccaccatgctgtaaaggaagagtactggtcagttttgaatgttctgatccgtattgatttttaatcaataaacaataataatcttatttctaatcttaaaattaaaacgtatgaaaacaattaaaaaattatcacgtgaacaaaagaaaagcatcaccggaggattcactgatatccagattgaagcttgtggtggtgaacagtttgtatgtttccgcggaagtggacaatggggatgctggcggaaaccgggaggaacctgttatgcacccatgctgtaagtattggtatgttaaatcagttaaaaattaaaatgactatgaaaaatacaaagaaattaaacagaaaagagcttgaaagaataaatggagccggcccgtcaagatgtgcaggatgtccgcagaatgctacatttggagatggtccggggtatcagtattcctgtgctgcgtatcaggggctgccagattactgtaagatgtgtgttctggtgagcatagaatgtgtggacggaggagtatcttaaactaaatatttataagataataataaagcactgtgaagaacagtgctttatttttttaacaattgtctggaatgaaccaaaaattattttatgcttttagaaagatcaagcatggcttcaataggctttaatgcttttaatcttaattcttcgtcgataagaatttcaggaagctcatacttcatgcacagatacagtttttccatggtattacgtttcatgtaaaaacattctgaacagttgcagctttcgtcaaaaaccaatgcagggatcagttccttgtgaggagcgcgttttttcatttcgtgaagaattccttcttctgtagcgataatgaatttctggcagtcgtctttttccacataattcagcagggcagaagtagaacctataaaatgagccaactttaaaacagcttcttcactttcagggtgggcaatcagtttagcatccggattgtctgccaattgcttggcaattctttccatagaaaatgcttcgtgtactacacagcttccatcccaaaggatcatatcacgtcctgtttttttagataaatatcttcccaggtttttgtccggagcaaagataattggtctgtctttcggaagggcctcaataactgtttccgcattggagcttgttacgataatatcactttctgctttggtttctgcattacagttgatgtaagtagcaattaaagcatttgggtgctgctcacgcatttttctcagtccttctccggaacaaccgtctgccaacgaacatcctgccatcgtatcaggaagaactacttttttagtcgggttcagaattttagcggcttctgccatgaaatgtactccgcagaatacgatcatgtcagcattagtgtcttttgcctgtcttgccagctgtaaagaatctccaagaaaatcagcgatatcctgaatttctcccggctggtagtaatgggccagaataacagcattcttttcctctttaagcttaagaatggctttcaccagttcttctccctgaggaatagcaatatcttttatatccagaaatccccttacaggaattgcagatttagctttttctaatgtttcggtactcatatcaacctcaattttttattatcagaagctagaggttaggaattagaagttagattttgagagtatttgattacttccatcttctggcttctatcttccagccattaattactgataaaactttttattaaactttctatttcttttttagcggtatcaagatcttcattgatcacgatcttatcaaactcgccggcgtaggtcatttcttctgctgccttcgctacacgggtttttatagtttcggcatcatctgtatttctggaaatcaatcttcgttccagctcttcaatggaaggtggttctataaaaatagacaaggccttttcgccgaagtattttttcagtgaaatacctccttttacatctacatcaaaaataacaacttttccctgattccagattttttccacttcagattttaaagtaccgtaatatttatcagtgtatacttcttcatattctacaaaagcatcttcggaaattttctgtctaaactcatccggggtcaggaaatgataatctaccgcatgaacttcgcttcctctcggttgtcttgttgtacatgaaatagaaaattccagttctggaaatgtttccagtgaatgctttaccaatgtagtttttccgcttcctgatggtgctgaaaatataattactttatccattttttttggtttcgggttacgggttttgagtttggtgttccattcttagaaatgagaaccatgcatctcatacctcgtatctatctttacaatacgtttaacgtttgttctttaattttttcaaggtcatctttcatcatcacaaccagcttctggatttctgcgtgattggctttagatccaagggtgttgatctctctcccgatttcctgagagatgaaacccagtttttttccattgaaagactcgttgtccattacttctttataatatttcaagtgctgggcaagtcttactttttcttcagaaatatcaagtttttcagtgaaataggccatttcctgatagaaacgtgtttcgtcaatattttcaaattctttcaaagatttctgataacgttctttcacgctgacaattctttcttcctcaaaaggaatcacttccccaagatatttatcaatattctgaatattcctgtttaattcttcatgtaaaataccaccttccgttttcctgaattcttcaaatctgtctacagcattattgacaattttagccaacgcttcccattcaccttctgtaagttcatcaggtcttgaggtaatggcatcaggaagtcttaccgccattttcaggtattcaaaatcgggaccgtcagaagctatgtttttaagttcgttgatataagagtcaattaaatttttattgatttttacatcattggactcttcaaggttctcaatattaacgtagcagtctacttttccacggataattctatcgttaagaatttttctgatttcaaattctttttctttgtaacgtaaaggaatttttatattcaaatcaaagctcttgctgttcagagatttaatatcaattgtaattttttttccttcaaaaacatcttcggctctaccgaatccggtcattgataaaatcatagttttttattgttctacaaagataaacatttaagtctatactatgataccatgaaacttcaacataaaatatatgattattcaattttaaattgatttaaaccattacgttttggataaagaagttaagaatattagatgggcttcgcttttagcataatacttaaggaaaatctatggattttcttcttaattaaacttaacagcttaaatgtgttcttaatggttcaaaacaattcgtaaattttttgtatttaaaaataaaaattcaaataagcatgttttcgtaaattagcggggtgaaaaagaaaaatttaatttctgtagtaggccccaccggaattggtaagacgaggctggcaattgatttagcccaacatttcaataccgagattatttcctgtgattcccgtcagttttttaaagaaatgaaaataggaacagctgctccttcagaagaagaactggctgccgcacctcatcattttataggaaacctttctgtggaagaatattactctatcggccagtatgaagaagatgcgctgcaaaaactcaatgaactttttaccactcatgacactgtcatccttgtcggtggaagtatgatgtatgaaaaagctgtgatagaaggtctgcatgatttgccggaagccaatgctgaaaaccaggaaaagcttcagacaatgatggagcaggaaggaattgaaaagcttcaggaaattttacaggagctcgatccggaatatttcaatgtggtggatattcacaatcaccgcagacttctacgtgctatagacgtaatctggcaaaccaatacaaaatattctgaattaattgcagtgtcacaggattccagagattttaatgtgatcagaatcggaattgaagctccaagagaagaactgtatgacagaatcaaccgcagagtggatattatgatggaaaacggattgctggatgaggtgaaaagtcttgagaaattcaaaggactgacggctttacatacagtaggctatgctgagctgttcaaatattttgacggagagtgggatcttgattttgcggtttcagaaattaaaaagaacagccgcaggtatgcgaaacgccagctgacgtggtacagaaaggcggatgatattcattatttacagttgggatattctgaaaaagactttgaagatttgctgaaatggatagaggagcagtttgaaaagtaaatactgttacattattaaatgactttagaagctttgaaaatatagattcctacggaatgacaaactggacgcttagtttatccatacactatgtcattccgtaggaatctaagtttatattcattgtaataaacagaaacaatacaaaaaatgcggctctgaaaagaaccgcacttcaacaaatataatttaatttactacttccaaccgccgcctaaagctctgtataaatctacaatgctgcttaatctctgtctcttaatggaagccagattcaactctgcctgtagggaattcccctgtgctgtaatcacttccaggtaattggctgaacctcctttatataaaagctgtgcacttttaattccgtctttcagtgtagtggcctgctctgtagctttctgttcctgaacttttaaattctcattggaaaccaatgcgtcagcaacttcacccaccgcattcaatacagactgacggaacgcaagaacatttttctctctttgaattttagctacttccagatttgttttcaattgtcttttctggaaaataggctgggtaattcctcctaaaaccgatccgaataacgaagccggaatctggaaccagttatcaaatttgaaggagtttactcctccgttagctgtaatttttaatgccggatacatattggcctgagcaattcctaccatggcattggattctaataaaaccaattcctgctgacgaacgtccggtcttctgctcaccattgctgcaggaagtccggcagaaatgttttgtggtaaggaagtatcagacatttcgatcgttctattgactttattgggaagttctcccaccagaatactcaatgcattttcctggatggcaatattctgttccagctgggcaatcagaagttctgttgcctgtttttgtgcagcagcctgctgtactcccaaagaagtattatcgccgctttcccacattttttgtgtcattaatagcgtattgctggtcagttccagattggatttggcaatagccaattgtttatcaagcatcagcaggttataatatccctgtgcaatggctgctactacctgagtctgaactgcttttgacccttcataagtctgaaggtactgcattcttgaaacttcctgctggtttttgatttttccccagatatcagcttcccatgaaaggttgaaggctgcattataatcctcaacatggcttgagcctaaaaataaatttaagctttgcccgttcatgctgtttttggaaggccttgagatctgtccgcttactccgaaacctacgtcaggatattgcatatattttgcctgtttcagcttttcctgtgaagccgcaacctgctttaaggcaatttgaagatcataattatttttaattcctttttcaatcagttcctgtaaaataggatcgctgaaaaactgtttccactccaggttggcgatgctggcagtgtcggcagttgcagtatactgaaacttttccggaagcggcagctcaggctccgtgtatgccagttttgacacacacgatacagagcctatagccagcgcaaaagttagaataatattttttactcgtttcatagtttttaaacttttaattgaatacaaaacttagagaggtttctattgatgcaaaattgtctttagtaggagaaaatagttagcttttgtaaaccattaagaacaggcaggtgaatagttaatcctttagtcttaaagttttctctaagtttttgtatttcattttgtattagtgactggcagctaaaagttcttcctccatttgttttttcagaagtcttttcttttttctgctcggcattttttcatgcagatactggaatattacatacattactgggatgataaaaattccgaatagtactccggtaagcattcctcctacagtactataaccgatagaatggttcccttttgaagatgcaccctgcgtccagatcaatggaagcattcccacgatgaaggcgaaagaggtcattaagatcggtcttaaacgtaatcttgatgcctggagtgcggattcaattaatgattttcctgcttttcttctctgtacggcaaactctacgatcaggatagcattcttagccaatagtccgacaagcatgatcaatcctacctgaacataaatattgttatcaattcctgccagccctgtgaaggcaaaaactccgaaaatccctgttggaatagtaaggataatagcaaaaggaagcacataactttcatactgagcagccagcaggaagtatacaaacagaatacttaagaagaagataaatgcagtctgtccgctcgttttgatctcttcacgggtaattcctgtccactcatatccatatcctcttggtagtgattgctgggcaacttcttctaccgctttgatggcatctccggtactgtatcctggttttggagttccgttgatcgttacggcgttgaaaaggttatttcttgttaccgtttcaggtccgaaagatctttttaacgtaaccagtgttttggccggaaccatttcacctgatttattttttacataaataccttccagtgaattgatgtctgtacggtaagggatatcggcctgagccattactctgtaatattttccgaacctgttgaaatccgatacaaagctacttccgaaataaatctgcatggtctgcatcagttctgttacagaaacacccagctgattggctttatccgtatccacatcaatagtgtactgaggatttccagctgcataagtggtaaaggcaaaagcaatttccggacgtttcatcagctcaccaatgaactgctgagtggttgttcccaattgttcaaaagaactgttggttttgtcctgaagcatgaactcaaatccggaaacgttaccgaaaccttgtacagtagggaagttgaagaagaatgcattggcatcttttacctggcttacctttcctgttaaagttcctgcaatctgatcaggatctttcatctcaccacgcttgtcataatctttaagtttaatgaaacctgcagaatatggagaagcattagcattactgataaagttcatcccgtcggctacccaaaggtgattcgttgccttttcaccattgatgatcttatcgatctgagccgttgctctgtgtgttctttccagtgaacttcccggaggagtatttaccgcatataatacaaatccctggtcttccgtaggaataaatcctgacggtgcttttttgatcaaaaagacactggctgctgtaatgacaacaagaccgccaattgctacccatttgtttttgattaaaaacttaagactgtagatatattttctggtcatgctgttgaagctggcattaaatgcattaaagaatcttgctccaaaacctgttttatgaccgtgctcaccatgttctccctggggatcattcaggaacattgcacataatgcaggacttaatgtcaatgcgtttactgctgaaattaaaatcgcgatagctaatgtgaatgcgaactgtctgtagaaaactcctgcaggcccttgcatgaagccaaccggaataaacaccgcacacatgaccaatgtaatggaaataatcgctcctgagatttcactcattgagttcatcgtagcatgttctaccggcattcccgtctgttccatttttgaatggacggcttctaccaccacaatcgcatcatctactacaataccaatggccagaactaatgcaaacagtgtaagcatgttaatactgaaaccaaataactgcagaaagaagaaggttccgataattgcgacaggtactgcaatggcaggaattaacgtagatctgaaatcctgaaggaaaatatataccacaataaataccagaatgaaggcaatcactaatgtttccacaacctgatgaatagaagcatccaaaaagtctttggagttatacatgatgatgggttttactcctttgggaagggtagtttccattacttttacctgcttttcaatttccgtaaggatttcgttagcattggatcctgcagtttgtaagatcgcgaatccggcaaccggttttccatccaccctgtttgtagcagtgtaggtgtaagaaccaaattctactcttgcgacatctttcaatcttaggaaagaaccatcactatttgctttgatagcaatgttttcatagtcttcacccttgttcagttttcctttatatttaaggatatactcgtaagtttccttactgccctgtccaagacggcccggagcagcttcaaggttgtgatctttaatggctcccaaaacttcctgaggagaaagattgttagccgccagtctatccggtttcagccagattctcatcgagtaatcccttgttccgaatacctgagcctgtgctacccccgggatacgctgtatctgtggaataacattgatcttcaggtagttttgaaggaataattcatcatattgttttgcatcttcactggttaatcccatgaacataatcatactgttctgaaccttctgtgtggaaattcccgcctgtaccacttcctgaggtagctggctcatcgctttggatacacggttctgtacgtttaccgcggcattatcagcatcagcaccttgtttgaagaaaacgctcagggtcatggttccgtcgttactggagttggaggtcatatacgtcatgttctcaactccgtttaccgcttcctcaataggcgtagcaaccgaacgggctacaacctcagcattagctccagggtagaatgccgttacctgaacgctcggtggagcgatgtccgggaagagggcaatcggtaaattaaagagagacaaagctcccaataataagaggattatggagatgaccgttgaaaggaccggtctttctataaattgttttaacataagaagtttatttttttaagtcttctgtattcggaaaggattataatggtttcgcttttaataagctgtcagaagaaatatttttcggcttgatagaagcaccgtcttttaagttcccgattcctgtgtaaactattttttctccgggtgcaagaccttcagaaataaaataatagctatccgtttttcctgatattttgatcggtcttccggttaccttctgatctttacccattacatagacataagttttatcctgaatttcgaaagtagattcctgcggaattactacagcatttgaaatcagttgaggcatacgcactcttccggtgtttccggttcttaaggttccgttggaattaggaaatacagcacgtacactgatggctcctgtagttttgtcaaactgtccgtctacgatgcttagttttcctttttcaggatatgtactgttatcagcgatcaccagttctaccattggcatatttttcagtttctcttctaaagtcgctcccggatatttattctgaaagccaatgaagtcaagttcacttaaagagaaataggcatagatttcactgatatcagataataatgtcaatggattaggatctgttctggagatgagacttccttttttgtaaggaattcttccgatataaccacttacaggagcggtaatggtagtaaatcctacattgattctggcgcttcctacagaggctcttgcctgtgaagcagcagcaacagcagcttcgtaattggctttggctgttttaagctgtacatcagaaactacttttgcagcaaccagtggctgaagtctgtctacttctacttttgctttctgaatattagcattggcagcttgcagattagcctgtgccatgttcatctgttcgccatagcttctggaatctattttaaataatggctgtcctgctcttacataagagccttcctctacatagattctgtcaagataaccgtctacctgagatcggatttcaacattgttttttccttccaaagcagtagggaattcctgatatgtagtagcgggtgatgtaataacggtataaaccggaagttctggagctggcggcgcggcattggtgccttctgcggccttggtgcagctctgtaaaagaattatacttgcaataagtacaataaaccttgtttttccaggtattttcattgttagtttaatttttaatgaagtgttagatttaagtaaagttcttttgataaatgctgttttttttcctaacagtgttaatagttagttcaaaaaaaattacagaatttttaatgtgcaattaagtcaatcgtttccatagctgaattttttaatgttgcttttatatataagatgaggtgtatgtgtgttaattttactaacagtgttaattgataagcaaaaaatgattacttttaacagctgaatgttatgaattacttcataataattttattttttagttaggaatgaaagaataatttacattaattcagtgttaattttcctaacagtgttaatttttaattcaaaaaaaatttacaaagacttaataaaagccgaaacagtttcgtccaacgtcgtcttattcatcgttgaagggatatcagcggtacgcatcatcataatagagatcattccgtgaacggcagaaaacagggcgtgagacatatgacaggcattgtccggattggacccgtttttcttaataatctcgtaagtacattcatagatcagttcctggaatgatgagaattcttttttcatctgtccttttccacagcattgcattccaagaccaaacatcagctggtaatattccttatttttaaaagcaaagttccagtatgcatccacaatcgcaacaagctgctcttccggagtgtcatgtttttgctgagcttttaacaattctatgtgtaacttgtgaaagccatctaatgaaatttcaaacagaatggcatctttgttttcaaaataatcatatactacaggcgcactgtactcaatagcatctgctattttacgcatagaaagtgaaccccagccttcggttttagccaacgtaaaagcagcctgcaaaatatttgcacggatggattctttttctcgttgacggcgttcatgtagacccatgatatttttttactaacagcgttagcaaaactacaaactttttgatataagttccaaaggatattttgagttttatgggttcacctactttttaaagaaaaattaattaaaggccgggagctggaagaatgggagctggaagttatttgtaaggtcaaataatataataatagaatttgactataactattttggagacttgaaaatcttcctgttccttcctggattaaaaactaaaatgtctgtttcagaacccggctcaattaacaaaagaaataattatctttgccagtaaagaaaaaaggatatgaatactccatcaaatatgctggcattaggaacaaaagcaccgttttttgaacttcctaacccgtcaaaaacgaatgaacttcagtctttggaagaactgaaaggagaaaaaggaacactggttatctttatgtgcaaccattgtccgtttgttcttcatgtgattgataagattaatgaattatacgaagattataacgaaagaggaattgaattcattgcaatcaatgccaatgatattgaaaaatatccggcagattctccggaaaaaatgattgaattccagattgaaagaagatttgattttccttatttattcgatgaaagccaggcagtagccaaagcatatgatgctgcgtgcacaccggatttttatttcttcgatgataaactggatttggtatacagaggtcagatggatgattcaagaccgggaaataataaagatgtaaccggagaagatttaatcattgcttttgaaaatcttttagcaggcgagcctcaggaagaaattcagagaccaagtatgggatgtaatattaaatggaaataattgctggttgctagttgtttagttactggtttttactaataaaaagctgctcttttggagtggcttttttgttgatcgcaatatagttcacctattattcacacagtttgtcactccgtaggagtctcggcacagcttgtattcttttattgtaaacctctgaaaagtaagtctggattcctacggaatggacaaaaacaacgtttagtataaccatacgaattgtcactccgtaggagtctcggcacaactgatctttttattataagtacctgcaaaattttcataagtaagtatggattcctacggaatgacaaatacgaaagcattgtctattcattcactttgtcacttcatagtagtctcagcgtagtttttctattaaaaacttactttagctttagtctccttttcagtctttatatctacattaacattgctatgagaataattcctgatgaactctgaaggagtttttcccgtatattttttaaacattctgttgaaatacgttacattattaaaaccacattggtaactgcattctgaaatagatctgtcctgtaccattaagagacatgccttattgattctgtatctgtttacaaactctgtaaaagtgatctgtgttgcttttttgaaaaaattacagaaagccggcagtgtgaggttggcaagttttgcaacgtcttcaatatcaatttccttgtcataatggtgttctacataggtgaagatattttcaaggcgggctttatttttggaaataatcgtgtagggcataatttctttattcagaagatcataatcctcacatttcgaaagttcaaaaagaatttccaaaagcaataaatatcttttgtagccttctgattccagcataagtttcaatttgggaagcattactttttttactttatggtgaaaatgaatcccgtattttgaaagttctaacagatttttgatggatcgggcttctacttcctgttcaggaaactgaaggatttcttccttaaactgaaggacaatttcttcatgagggtcaatggagttcagcccgaatccggagtgaggaatattagacccgattaatacaagatccccattcgtgtaattacttttatggtagccgacatggcgggttccgctcccggaaatgacacataccagctcaatttcgggatgatagtgatattcccatttgaattctgaaataggagaattattatgaatagtgcggaatgaactcttttcattaggaatcaccctttcaaaagtaactttcatttaattaatcatatttaattcttaaaaatactaattatattaatatagttcaaatattgatttactgtgttaaattatcgttaacacaaatgcttctatcttagccagcaagaagtaacctgaatgaaaaatagtaacatcaaggccgttttatttttaaattattttgtctttgccattcttctgaattctgtaggaacagtgatcctgcaggtacagcagaattttggaatttcaaaatcctcggccagtgttctggaaggctttaaagatcttccgattgccatatgttcattcattcttgcttcatttcttcccaaaataggaatccggaaatcaatgctgattgccctgctgctggtaagcagtatgtgttttataatgccgtttaccaattccttctgggttttcaaattattatttgccactgtaggagtttcatttgccctgatcaaaatatcggtttttacttctattggattggtaactgaaacagataaggaacattccagttttatgggatttctggaagggtttttcatgatcggagtattagccgggaatgttttgttcagtttatatattgacgatcataatccggaatctacacaatggctgaatgtttattgggttctcggaggactttccagcttatcttttatattccttttcttttcaaaactggatgagaaagaagcgaaaagtgagaaaacagatctgttgggagatttaagaaacagtgcaagtctgttcagttataaaaaagtgttgtgctttttattatgcgctttcctttttgtactggtagagcagagctttcagacctggactcccactttttataaagaaattttaaaagtaccgacttctatgagtattcaggcgggagcggttttggcaggtgctttcgcactgggaagattcttgtcgggtttcttctctaaaaaattcagctggatctatgtggtttctttttgtgtgataggttttgccattagtttgcttctggttctgccattaactcacaatattcatatagataccaatactagttggctgaatgcgcctttggtcgtgtatttatttcctctgatgggaggtttgctggcacctatttatccgagtattaattctgttattctggcgtcgataccaaaatatttgcatagtgccatgtcagggttgattgttgttttctcagcaatcgggggaactataggttccatcattaccggttttgtgtttcaggaattcagtgggcagcgggcattttatctgtccttgattcctctttcattactgatcacttcagcggttttcatgaataaattaaaaattaatcctaaaaaataacaatgagtaatcaactttatataaacgatattcaaaccctttttgatgacgtgcagagatctgaaatttttgaggatcagaaaatgatgacggatgcagttcctctgtttcccattgtaaagatcaataaagagtatgaaaaaacgaaagacagtcccggttttgatctgaagggttttgtaatggctcattttgattttctaggagccagagtttctgttcagagagaagatcatcttccgattgtggatcatattgaaaaattatgggacgaactgacccgaacggcatatgaggaaaaaggaaccctgttaaaattaccaaaaccttatattgttccgggcggccgttttaatgagtttttctattgggacagttattttatcatgcttggattaaaagcttccggcaggatagaaatgatggaaaatattattgagaactgctcttatcttattcagactataggattcgttcccaatgcgagcagaactcatttcctgagcagatcacagcctccttatttttcattaatgctggatcttctttttgaaacaactcatgaccaggaaatttatacaaaatactatgacactcttgaaaaggagtatgctttctggatggatggcgaagaaggacttgaaaacaattccagtataaaaagagtggtaaaaacaatagacggagatattcttaaccggtattacgatgcagaaaatgcaccacgtcctgaaagctatctgatcgatattgaagatcatgaaaaagcaacaggagctgaattttacagaaacataagaagtgcctgtgagtcaggctgggatttttccagcagatggttcgcagacggacaaaatatacagacgatagaaacgctgaaccttgcacagattgacctgaactgccttttgtggcatttggaagtgaccttggcaaaatcttcagcacttcagaatctgaatgaaaaagaacactatttttcagaaagagcagcaaaccgaagacagatgatcaatcaatatttctgggatgaaaacactaagatttacaaagattatcacattaaaaaaaacacaaaaacaccgtctgaacatattgctgctctttaccctttattccttggtattgcagatcagaagcaggcagaggcagttgctaaagctatcgctgagaaatttctttatccgggaggacttgtgacgaccactaaaaactcaggacagcaatgggatcttcccaatgcgtgggctccttatcaatggcttgggttcagggcaatgaaaaattacggctttgatgaactggcagaaaaaattaaaaataactggtgttccaacgtagaaagagtctaccagaataccgggaaactgatggaaaaatacaatgcattagatacagaaacaatagcaggcggcggggaataccccaatcaggatggattcggctggacgaatggagtgtatttacaattacaacaaaactgaaactaactataaaaataaggctatgaaaaaaaaatcaatctttttaatcgccgcaacagctacgttatattttaataatgcttatgcccaggaaacaccgcaggattctgcaaaagtttcctccatcgatcagattgtcatcacaggaaactcaaatcctaagaaaaaaatagaatccagtacagcgatttccacattcagttccaaagaaattcagaagcaaaacccgatcagtgcagctgctttattgcagagagttcccggatttgctgtggaaacctcaggaggtgaagtaggtaacaacctttttgcaagaggtattccttctgccggagcctatgaatttgtacaggtacaggaagatggtcttgcggtttttgaagacggcgcacttcagtttgccaatgcggataattttttccgtgtagataattccgtgagccgtatggaagctttgagaggaggatcaggatctatttttgcaaccaattctcccggcggtttgatcaactttattacaaaagaaggaaccaatgatttcagaggtacggcaaagctggaaaccagtacctacggattaatgcgtactgatgttaatgtaggcggagcattggttcaggataaattgtttttcaatgtcggtggcttttacagaacagatgacggtatcagaaaaacaggcttcaaagccaataacggagggcagatcagaatgaatctgaaatatgtttttgataaaggatatgtgaaagtatattataaaaaactggatgacagaaatacattcttccttcccattcctttgatccaaaacggaaacaagctgaaaggatttcaaggttttgatcctaattatggaacctacagctacagagccatcagccagctgaatattccgcaggccggaggaggatttttcaacagaaatcttgaagacggaattcatccgaaagttgatgttgtaggtgctgagtttaaatatgaccttggaaataatttcagtgttttaaacaagacaagatatacggatatcaatatgaattataccgggatttttcccgcgggaggtccaaagctggcttctaaatatgcaacagatcaggtaaaagacggcggacttgggatgagtgactatcaatattctatggtaagcaacggagctgttgtaaatcctgagtttgttcaaaaattaggattctgggcgattgataagcagatgaataattttgtgaatgatctgcagttcaattataaattcgataaaggaaacgttacagcaggtttttacaaatccaattggaaatcccagcagtactggaactggagtaatattctgacaacagctacagacagacctgagcttttgaatctggtaaatccatctcttagtccatctgatgacggatactccaagacttacaacggagtgatggatatgacatttttacagagaaggacacagactcagggaagtttgaatgacctttatgtaaacttagactataacattacagatgctttaagtgtgaatggagggcttcgttacagccatgattattataaaggaaattttgccaatacaacaactgctaatttaaataactccgggttaaccactgatggaactcatggtttcaatacgactacagcggatgataatatgagcgtattaggaaataaatatacctactggaattataatatagataaagtttccttcacattggctgccaattataagatcaacagggagaatgcagtatatgcacgtttttccaatggtttcagatctccgaatgaggaagcgtattacaattatttttccaacccgacaccggataaacctttaaaatcagtaacaaccaatcagctggaagtaggatacaaatattactcgcgtacttttgatgtagcagtgattccgttttattctacattaaagaatctgtcatttaccgatatcttttctgatggaaaatctgaaaacacttttgccaatacacaaaactatggagttgaggtggaaggatatgcccgcttattcaataatattttagaacttaccttcaacggaactattcaaagtccaaaatataaaaaccttgaagcaggaagtgttctggaaggtaatgtagtaagaagaatgccgaaattttatttcaatatttctcctgcagtgaatatcacaaaagaatggagggcttatgtaagcatgaattactatggaaaacgtttccaggacgagaagaatgtacagacattgccttctttcacagaatttggagcaggaatgtcttatcagttagggaaaatacgttttgcagtggatggtaccaatattttcaacaccattggtattacagaaggagatccgagagcaggatcaccaaacggagacggaatcatcatggccagacctattatgggggctgctgcaagagcgtcaatcactttggatttctaaaatctgtttctttataacaacaaaaccgtcggaatttctgacggttttgtattttttatatcctccggtattaagtatcaggctagattccgggtatttacagagccttctcaaatgcttacttcaaaaacggattatactgtttctcaaagccgattgaagtaggatttccatgtcctgaaaaaacctgggtatcattatctaaaataaatagtttcgttctgattccttcaataagctgatcataatttcctttataaagatctgttcttcctatgctgccttcaaaaagcacatcccctgaaatcatgaatttttgattttcgttatgatataccacgcttccgggagaatgtcccggaacatgataaattttaaacttttctccatccagatccagctcgtctccttctttaatatattcgatatctacttttacaggatctaccttcatcccaaatctcacaccgcttgcctgaagcatgtccagtacttcctggtcttcctgatgcatattcacaggaactttaaaagtgtcaaaagcccattgaagcccgaagacatggtcaatatgagcatgtgtcaaaagaattttctgaatcttcagtcctttctcagtaatgaaattatcaatagcctgagtttcctgagcattcatatttcccggatctattaaccaggcatttttattttcgttatagatgatgtaagtattttcgctcgcaaagttgaaaacgaaaccttgaatctgaagcatatctgaatattttttattcaaaaatacgatattattaagaaaatggctatttttcgctatcttcgtcataatgaaaactttgcgaatactcttactttctttgagcggattggtttttgggcaaaatatccaaagtatccagctgttcaatcctcagaccaatgacgaaactcctgtcattaagataggagaacaattggttcttggttttgatgatcttaccaacggcagtcagatctaccggtatacattcaaacattatgacagaaactggaatgaagataatctgttttttacagaatttgctaccggaagtatgaatgcacttctggaccagtttcagtattctttcaatacattgcaggcttatactcattacaaactggtttttccgaatgataaaatccagctgaaagtttcagggaattatgagctgattgtttataaggattccgctgatcagcctcttttcaaaaaaaggttttatctggtggaagatgtaacttctgtggggttaaatatttcaagatttgcagatgcaaaaaatccgaacgttaaccagagggtggaagtgaacgtttctccgaaaggaggagatatctcttccaatgtcaattcaatcacgatgaatgtgatgcagaataacaacccgaatatggtgatctctaaccttaagccgagcagtgttttaggaaatcagatactttttcagcagatgaatctcgtttttccgggagacaatgagttttattattttgataataaaaatatgaatatggcagcagatatggtgcgtgccacagaaataaaagatgatgtcaaccagacttatcttcatcctgtatgggcttttcccctgaattaccaatatcagcctgacgtcaatggcgcatggtattacagaagaaatgacctgggaagagaaagagatgcagaaagagaagctgattattcatgggtacacttttatctggattctgatcctgtggacaaagagatttatgttttggggggatttaataattataagccaacaaaggagaaccaaatgcagtatgattctgccacaaagcagtacgttgctaaaatattcctgaaacagggtttctataattatgtactcgcaactaaagaagcaaacggcccattgaactttggagaagtgaatggtaatttctggcaaacggaaaacctttatcaagcatttctgtactatgcaccgttcggaagaaattacgatggccttatgggatatggagaattcagaactccgattgcgaataagcgttagtgatcttacattacttataaaattacatacaaacgggactatctcttgagatggtccttgttttttgtccatattaaaagaattaatctcttaaaattcggctcagtacttaattttttttaattataatgcacagcatagtgaaaaaaaataattcacaaaattttgattttaattaaatattttaatataaaatttatattactgaaaaattatatttaaataattttctttgttttaaaatcattattgtgttttgtttattgatttataatatcaattgaattttattcattatttttgttgttttattgcgaaaagtttataaattcgtcatcacaatcaaccattattaatatgaaaacgaaatttatcttagtggctagcgttgctgcctgctcttttgtttttggacaaaacacaccatcaaaattaattccgggtaaaagtggcttacatgccgaatttatgagatttgacaaaaatgcaccggcatttcagggaagccctgttttatttgacgaagcatctcagagactgtctcccggacaagcccgcaaactgggcctggaaaaggatgcattaggtttcgaaactcaaagattccagcaaaccgtcaatgatattcctgtagaatacggaatgatggcggtacagacaaaaaacggtaaaattgtaggtcaatcaggaaagtgggttcttaatgtacctaaaggacttgagaagaaagccaatatttctgaaagtattgcactacagaatgctttatcgtttgtaggagcggaatcctataagtggaaaaacaaagaagaggaagattttcttaaaaaagaaaccggtgaccctaatgcaagctatgctcctaaaggtgagttagtgtattattcagatcctgatgatgacaagctgaatgatttaaggctggcttataaatttgatatttatgctgaacaaccattaagcagacaaaatgtttttgtagatgccaaaaacggaaagatactgggtgtagatgcgattattcatgaagtaaatgctccgggaacagccgttacagcatatagcggaacccgtaatataaccacagactcatataacggaagctaccgcttgagagaaacaggaagaaatgccggaacagctgtggaaacctacaacctgaaaaaaggaaccagctatgcttctgctgtagactttacagatacagacaataactggaataatgttaacaccaataaagatcaatacgctacagatgctcattggggagcagagatgacagtggattattattatacaaaatacgggcgtaagagtattgataataataactttgctattaaatcttatgtgcattattctaccaactattttaatgcattttgggatggttccagaatgacttatggtgacggaagctctacaacaaacggcggaaaacctttaacagccatagatgtgtgtggtcatgaaattacacacggtttaacttctaaaacagctaatcttgcttatcagagagagtcaggagctttaaatgaaggtttctcagatatcttcgggaactctatagagcgttgggcaagacctacgcaggcaagctggactctgggagaagacttcagttatgtgatcagagatatgtccaatccaaatgcttacagccagccggatacttataaagggaaatactggaaagatgctactactacaggatgtgctgtaccggggcaaactaccaatgactattgtggagtgcacactaactcaggagtgctgaacttctggtattatcttttggtaacaggaggttctggaactaatgataatggttttgcttataatgtttccggaatcggactggataaagcaggcgctatcgcttacagaacattgacaacctatctgacttcgtcatccaattatgccaatgccagaacttactctcttcaggcagcagcagatctatacggtgctggaagcaatgaggtgacacaggttaccaatgcatggaatgcagtaggtgtaggaggtggaacttctcctgcaggattggtagcatcaacttcaactatttcagcttataccatcagcccgaatccggcaactgacagattcactgtaaactttgaaggtaaagcaggaaaaggaattgtagagttggtaagccttacaggtaaaaaagaaatttctgaaaaagttgagatcactgacggagtgaataaacttaacatccagttaccttccaacattcttccgggagtttacattgtaatcgtaaatggacagaaagcaggaaacctgattaaaaagtaacaccaaataaattttaatatattcaacaaaaaggccgcaagttaattcttgcggccttttgtatattttaaacgtataaattaaaccagatagaaatcgttaagcttttcttcacaaaggatttttaccacttcaatccagcggtcttcatcattcagacatgggatataatggaaattttctccgcctccatgcaggaactgttctttaccttctacggaaatttcttccagtgtttcaagacagtcagaaacgaaagccgggcatacaatagccagattttttattccttttttaccaagattctcaagtgtttcgtctgtataaggctcaatccatttgtcttttcctaaccttgactggaaagaaactatggttttttctttaggcaaattcagcttatcgataacaagctgtgtcgttttataacattggtggcggtaacagaactgatgacttggattatcttccctggaacaacagtcattaaggttacaggtcctggtaggatctgtcttataaatatgtctttccggaacaccatggtaagagaactgaagagcatcgaaattttctggaagcttctctttaatactttctgcaaggcaattgatgtaaatatccctgttgtagaaaggctgaatataattgatcttcacctgtggaaacttctttttccttacttcttcagctttttcaattacagtctccgttgtactcatcgcatattgaggatatagaggaaaaagaacaatttcagtgattccctgatccaccagtttctgaataccggtttcaatgcttggttctgcatacctcatcccgatttccaccggaacatctactaccttttgcagttttttctgaatctgttcagtaataacaatcagtggtgaaccttgatccgtccaaaccgttttataggcttctgcagattttgcaggtcttgttttcaggataattccctgtacaagcagcgcacggaagatccagcgataatcaatcactctttcgtccatcaaaaattcatcaagatattcctttacgtcgtttacagaagttgatctcggtgatccgaggttgaccagtaaaattcctttcttattcaatattctaatttttaattatgaaacagacgttgtaaaatctgttactaattctgctactttagcaaaggtattactttccagtaagccattgctgtcaaatttgccttttatcccttttattaatacctgatgtttatcatctgttactgcgcccagagtttttaaaatcaataacaactcttcatgtcctttttccccgcttgcggaagctgtaatgactgctgtcggtttatcagaaaaaactgttgtggaaacacaccactccaacagattttttaatcttccaggaatactgaaaatatattccggtgtggaaaatatgactccagctgaatctttaatagcttctctgatcttaagaacttcttcaggagtattgttatctgttaatgcagtatcaaaatgcggaagaacagaaagatcatcatagattttgaaatccgcatgatccgcttttttcagtacttgttccattagtttcagattgctggaattttcagaagcacttcctataatgataacaattttctttccggcaggcattttttaactgttttatccgtttacggcttctactttttctactaagtccggaacgaattgttttaaaatattttcaattccattttttaaagtagctgtagaacttggacatcctgaacatgcaccttgcagaagcatttttgccgttttattctcctgatcatattccatcaaggaaatctttccaccatcattttctacggccggagctacatattcatttaagatatcagagattttctgttcatcttcagtataatctctgttgatgattttttcaacagggttttcatgtttctgaggttctatttttgaaatctcacctccgttttgaagatattcagcgataagggcacgaacagtcatcatcacctgatgccattctacagaattatctctggtaacggctacaaagttgtcagaaatgaaaacttccgttgcaaaatcaaattctctaaaaatagcttgagccaaaggaacttcttctgcagcatctttcgattttacttccacaaaaccgtccatcagtaatttgcttgaaacaaacttcattacattcgggttaggagtcatttcagcataaatctgatacatttcttttttcttctgaagatagattctcgggttagccagtaattcatcctcaattacgtttttcagactctcagcaacatgttcccactccacagtatcctgctttgccacagcaacaaagttagccgtgatgaaaattctttccacaaacggataattgaaaagttcctgtgccaatggaatttctgatatatctgaatttctgtccagctctaaagaacccgggatgagattgtagtctgctacaaatttcatcacttttgggttttcagttggttctataagtacggtacgcattttttcgttaaatttgagatacaaaaatacgcattagaagtcagaagctgaagatagagagttagatttttgctatcgctgtaatttagaagttagatacctgaaattatatggcacatatcatattctcaaatcggcttattttcgaattttcaaattaatattatggcacttataaaagaacttttaggaaaagcaccacagatcggagagaatacatttttggcagagacagcaaccattattggggatgttatcatgggaaaagactgcagtgtctggtataacgcagtgatcaggggagatgttaattatatcagaatgggagacaaggtgaacgttcaggataatgcaatgctgcactgtacctatcagaaatatcctctgaatatcggaaataatgtctctataggacacaacgcgattgtgcatggatgtactattaaagataatgtattgatcgggatgggagctattgtaatggatgattgcctggtagaagaaaattctatcataggagcaggttctgtagttactcagggaacccacgttaaatcgggagaagtctggggcggagttcctgcaaagaaaatcaaagatatcaatgcacagttactggaaggagaagtgaacagaattgcggataattatgtgaaatactcttcatggtataaggaaaatgtgaaggatcatcagttttaaagattgtcaatagtcaattcgttgcgcttatcaattatttgataaagacattcactattcattggcgaaaaattcacgattaacaaatataaaagctccgtccccgggacagagcttttttcgatttgatatagaacctttgctttattgttagttagggtcaggtgtgatcaatcttatcttgccattgatacatttcagggatgtaggaggcatgaccatcatacagtctgacacaatattatacttttcattaaaagctctcactttatccgtatactcattgactctcggcaggaaagtctcttctattttctttggataggctatgtattgctgaggcccgccgcaggattttgatcccattggcgtaaatgcccactcactggcatccgtacatttttcgcctgatacttcagattcaatggaagcttttagtttatccagttgagcctgttcatacttctggctgtcttcgtcagcaggtctgtctgcaatatcgataggaagattggtattggcattttttgatgtattacaggaaaccaaagttaatgtagtacataatactattgccgggatatgaaagaataattttttcacaataaacttttttctttttaagaattttcaaaacttatgccaaggtaagaaaatcaaattcatttccgtatttttgacaacgatgaacaatcatttttttgacttaatagaatacaccaacagaagcgtttttttaaccgggaaagccggaacagggaagacgacatttcttaatgattttgtaaggcgtaccaagaaaaagcatattgtggtggctcctacgggaattgctgccattaatgcaggaggtgtgacgatccactccatgtttggactgccgttgagaacctttcttcctactacagaaaggatagacaccagtttggcaaataatattgctgatctgatgccccatttcaaatatcgtaaagataaactgaagcttctgagggaagttgaaatcatcatcattgatgaggtttcgatgctgagagctgatgttctggatatgatggatttttccttgcgttttatcagaaggaataatcaaagatttggtggcgttcaaatgttgttcattggggatttgtatcagcttcctccggtggtgagggatgagcatatcctgaaaatgtattacaattcacctttcttttttgacagccatgccattaaagaaattcccattgttaccattgagctgacaaaagtatacagacagtctgatgaagaatttctggaaatcctgaatgcgatccgtgatggagatgtggataatatcgattttgaccatcttaatgaaaggtatgatcctgactttgatatggggaaagaatcttacgtttatctgtgttcccacaataaaatggcagatgaaattaatcaggaaaaactggcagagataaaagtagatcctcaggtttatgaagctaagcttgtaggagactttaaagaaaatcagtttcccaacgaccagtttttagaactgaaaatcggggcccagattatgtttatccggaatgatatttccggtgaaaagaaatattttaacggaaagctgggggagattatcggattggatgaaaatgaaatccgggtagtattggatgaaagtgaaagagaaattgttgtaaaaagagaaatttgggaacagaaaaaatatttccttgatacagataaaaatatcaaggaagaagtattgggaagttttgagcagtttcctattaagcttgcatgggcggttacaattcacaaaagtcagggattaacgtttgataaagtcattattgatgctggaaaaagtttcactgccggtcaggtgtatgttgctttatcccgttgcagaaccctggaaggaattgttttaaaatcaaaaattacacctgaagttatttttaaagataacaggattttacactttcataccgatacgattgccaatgatcatgttgaagccatccttaatcaggaaaaatatgattacagcatcaggaaagtgctgcgtacgcttgagtgcacttggtttttgaaagaagtggaagagtggaataacctttccattgtaacaaaaaatattgatcatgtcaaaaccaaacagctttatctgcagttaaagcatgaagcggtgaatcttgggaaaatatttgaaaaactggaacggattattttccagaaagtcaataattttattgaacagaaagaagaatggtccgaaattgaaagcaaatcaaaaggtgcagttaatttcttctttactgagaccagaaataaaatattcgatcctttgaaagaattttacgctgaaataaaaggagcaaaaggattaaaacagtacaacgaagaatttaaaagctggctggaagacattgaagaatatctgaatagcttaagagaaattcatcttcttgaaacgaaacttttagatgaaaagaatgataaggaaatcaatctgaaaattgctaaagtcccttctcaggttttgaccttccagttgtttgagcagggcaaaaccatcggagaaattgcattggaaagaggtttggtgaaagagaccgttatcggccacctggctaaatttgcagaacagggattgctggatatttccagagtcatcacttcagataagatcaaggcttttgaagatgagttttacagaaaccctcacgaaactcttacagaatggaaaaatgcactgccaagccattttgaatttaacgaaatcaggattttaattaatcactataattataaaaaagaaaagaactcgtaagagttcttttctttttatgtgaaaatttttcaaaactaaggatacatagcattaatggtattgatatctcctgtagtaaagccggttctgttataagtgaaattgctgttatcagctctggtaatcgttggcagcccgtttttagagtacgaagtcggccagtacatcatcacagaattgatattaaaagggccgatatctgttccggaactgtagatattaaaattataagattgtccgttctggatattgttccacaggatttttacatattgatccctgtctttacgcgtatgctcatgataaagacctactgtatgtcccatttcatgaataactgatcccacagaaatatattgatccagagaaatcgtttgttttcctccctgatatccgatatgtgcccacccatctgatcccgatgagcttccgaatataaattcaacataattagactggttggtacggtaaatccattgagtattggttttagtattatactcattaattgcagtattgattttgtttacgttgatagagcccatattgcttgcaatcgtgtagtaaatcttaccgtttggccaccttgaaaaactggctccgcctttattaagttcattgtcttcggatagctgtttatcggtaagaacaatatctccctgaaaaaaattcattccgttttttctttcataggtaatttcctgactgttcaattgtcctttttttacattgtcaatgttaaaggcattggtttgtgcttcagatgtaatttcatcattatttttactacaagatgagaatgttgcagcaataagaaaaattataagcatagtttttcctgtcagcatctgcttataaaacagactgttttgttttttgatcatattaatatttttaagaatttggtatacgaatataatcaatatatctctttttattgatttatttttcttaaaatataatttttattatcatgatttgaatttttaaaattctatatataaaatcaaacaaaaaagaatcttattccaatagtttttccctgaactgatcaattgtttttattaattacaaaaagtaactaatgcagtttttatgttttaaatttgccttgtttttcagattaaagaaaaattaacatcataacatgaaaaattttgaaatttctgttttggatcttgccccggtaaagcaaggaaaaagcattcacgatacttttcaggacagcttatcactagccaatcacgctgaaaatttaaattataaaagattctggctggcggaacatcacaatatggaaagcattgcaagttcagcaacctctgttttaataggtttcattgccaatggaacgaaaaaaatcagagtaggttcaggaggaattatgcttcccaaccacagttctctgattattgctgaacaattcggaacactggagtctttatttccgggcagaattgatcttgggttaggaagagcgccgggaacagatggcttaacggctcaggctttgggaagaaatccagccatcatcaatgaacagtttccaagacagatcctcgaacttcaaagatatttctccaaagaaaattcggacgcgatggttcgtgcaattcccggagaaggactggatattccgctttatattctgggatcaagtacagacagtgcctggctggctgcggaacttggtctgccttatgcatttgcaggacactttgctccggagcagatggaaatggcttttaaaatctacagagagcattttgaaccatcaaaatatctggataagccttatatcattgcctgcgtaaacggggtagcagcagaaacttccgaagaagctcacaagatttccactactttattccaggcattcatcaatattgtaagaaacgacagaaaaccattcgcgccgccggtagatgacatggatgaaatctggtcaccaatggaaaaatctatggttttacagaaactgagatatacatttatcggagatcaggcagaaattcagcaaaagcttaaagatttccaggaaaggtttgaggtagatgaaatgatgatcaattcacatatctacgatcatcagaaaagattaagatcttatgagattttcagaacggcagcagactcactatccaaagcgtaataaaccatccataattaattggcagatgcttatttttatgagtatctttgcacaaataaaaagtaaaaatgtccgatattaaattaaatactattccagaggctattgaggaccttagaaatggtaagataatcatagtagtagatgatgaagacagagaaaatgaaggtgattttctttgcgcggcagagcttacaacgccggaaattatcaattttatggctcttcacggaagaggtctgatctgtatgccgcttcctgaaaaaagatgtgatgagcttggactagaagtaatggtaagcagaagcagcgatcctaaagaaactgctttcacggtatcggttgaccttttaggaaacggaacatctaccggaatttctgcaggagacagagcaaaaacaattttagctctgatggatgaaaaatccaaacctacagattttatgagaccaggccatattttcccgcttcgtgcaagaaaaggaggcgtattgaaaagagccggacatacagaagccgctatcgatcttaccagcttagccggtttaaaagaaggaggggtgatctgcgagatcatgaatgaagatggtacaatgtcacgtctgcctgaacttcacgcttttgcccagaagcatgatatgaagatcgtttctattgaagacctgatccattatcagcttaaaaaaggaaatcttgtggaaagaattgaagagagaaaagtaaagacgttttacggagactttgatttctatgctttcagggaaacttcaaatgaacagatccattttgccttaacaaaaggcgcctggactgtagacgagcctgttttggtaagagtacagtcatcagattcttattttgatgtattgacaagattgaataacggtgagaagccattgctggaaaaagtaaccaatatggtgaatgaggctggaaaaggagctattattttcatcaacaatgtttccaattctgaaaatacattgagaaaacttcagcaattcctgaattatcaggacgggcaggaacaacatcctactttagcgtacaattacagagattatggaatcggaacgcagattttaaagaatttaggaatcaacaagttcaaagtaatcactcaaaaccctaatattaagcctcaggttggaggttatgatgtagaggttactgagatggtgcaactatagtgaatgaatagccaatagtgaattttttcacttcaatggctgtttacaatacaaaatataaggtttaggattttctgaacctttttttatttttaaactatgactgagcctttaaaaaaacatatccggagttatattgatatttcagatgaaaagctggagaaatattgcagtgctttcaaccttaggaaaataaagaaaaaggaatttcttttaaaagaaggtgagatctgcgaatttgaagggttcgtactgaagggctgctttaaagtttttcatacccatcataatgcagctgaacagatattatattttggcattgaaaactggtggatttcggatatcgacagctttgtgaaccgtattccctcaaagcttaatattcaggctttggaggacagtgagattcttcttattcccaaaaaagaaaaagagaaactgtatgccgaaatgcctgagattgaaagattaatgaggcttaaatttcaaaaatcaattatagcattgcagcgcagaatcattgataacttaagtaagccttcggatgaacggtatgttgagtttttaaaggattacccgcaaacagcacatcgtcttaccaatattcagattgctgcctatctgggagtaacgccggaatttataagcagaatcagaaagaaaattgttagtaaagcataatctttctttatataaaatttaaaagtcccggaagctgtaaatacttcgggactttattttgagtatcttaaaagatgttctttaattcagagtgattccatcaaagtttcggaagccgttcagaaaatcttttaccatcattctctttttaccttccagctgaagttccaatggataatagattccatcctgtgtataaattttaaatccgttctttgagatatccagtgttccggcaggtttaccatgatcagaaagttcaaacttacctccgaatatttttaaacctttttcttcgttttcaatctttaaagtagtgaatgctgccgggtaaggagacattccaagaatgaactggtgaatggtctttgaaggctgctgccaattgattctcgtatcttccttgaaaattttataagcatttttaggatgttccacctgtggctgaggcttctcctgaatggcattttctgcaagcccgtccagtgttttcacaacaagccctgaacccatttccatcagtttgtcgtgaaggcttccggcattttcatcaggtaaaatttctatttcctgctgaagaagaatattcccttcgtcaattttttcgttaataaagaaagtggttgctccagttttttcttccccattgattactgcgtaattgataggagctgcccctcggtaatcaggaagcaatgaagcatgaagattgaaagtacccatttttggcatttcaaaaagtactttaggcatcattctgaaagcaactactacaaaaacatcagcatccagttttctaagttcttccaaaaactccggatttctcagcttttcaggctgaaaaacaggaatattgttttcttctgcatagatttttaccggtgattggtgaattttctgtcctcgtccgcttgccttatcagcaacagttactacacctacaacctggtgatgagattgatggatggcctccagagaagtctttgcaaactcgggagtccctaaaaaaacgactttcaatgatttcatactgcaaagataagtttttgatctgagagtcggaaggtttcaggtttggggttgggagagtatgagagtatgagagtatgagagtataagagtatgagagtgggagaattttatagtataagagtttttagagatagactgcgattacgattacatcatatcatatccaggcatctttcttattactcatcactcattacttattactcatgattcagcgcatacgttctgaagttcagcatccttacctttccggaatctaataggaaaatcagattttccagaatattttctttggaatgataactcagctgtatagacagttcttcaatggtagcagactttttggataatagattaatgatttgctgggaaatattttttccaaagatagactgcttatttttttcacagactgaacattgaccacaattttttgaatttttttcgccaaaataagcaagaataagtttcattttacaatagtcattgttttctacgtaaaatttcatctcttcccatttttggattttgttcctttgaatatgctcaaatagtttccagtaagcattattcacagctctctcatcacggggtttcaggaatttaatactggaaagcgctccgtcgatatattcaaggtaatttttttgttgaagttccttcagtcgttctttaatcaaaggaacgctgatgttaattttatggcttacctgctgctcactgaacattactttatgagtcgtaattccggatatagtacggaaaagaagttctataaaataggcatctttttgtggcagctggtcgatctcatccgctttaataaaaagttcgagtgaagacaggcttttgttgtcgttgtagtagacaatttcctgattatgcagaaagttgagtacattgttaatctttgccttcgacagttttgtaaagttctgtatgctgaggatatttaactgaaatgttttttcaggaagttcaaactcggctacctgaaaaatagagtagaggtaactgataatcttcaaaaattcagctttgttaggagtctgattttttaaaacctgatcaaaattcaataattcctgcctgttccaaagcataaacgcaaaactgtcttttccatctcttcctgctcttccgatttcctgataatagttttccagggatgctgcaggagagtagtgaataacaaaacggacgttatctttgtcaatacccattccaaaggcattggtagaaatcaggacatgattgtcactgttgttccaaagattctgctttgcatttttttctttagttgttaagcctgcatgaaaataatctacgtttttcagctgatttttcttcaggaattctgccagcagctctgcttcttttctcgtccttacgtatacaattccggagtcgttgctgtattttaagatatcaaaaacacgctggaatttatcagatacttcatcagtaaatattttgatattttctcttttgaaacttttttgaaaaacaaatggattcttcagttccagtttatttttaatttcttccagcacttttggagtcgctgttgcagtcaaagcaaggcagggtatctcagggttgttacttcgaaacccctttatattctgatagctgggtctgaaatcctgtccccattccgaaatacagtgtgcttcatctactgcaatgaaggataattgtatttcctccatattttggataaactgtgcattggtaagtctttcaggagaaacatacagtaattttgtaagcccttccttacagcggccataaattgtttcagtgtcatattcatccatctcagaggaaaggtattctgcttctatgccacgggctttaagctgattaacctggtctttcatcaatgccagcaacggggaaactacaaggcaggttccttccttcaatagggcaggcagttgataacataaagattttcctgctcctgtgggtaacagaaccagagtatctttttcattgatgacggcattgataatttcttcctgagaatctctgaagtcggtataaccccagaaatacttaagagtatcatattttagtttttgaaaatcctgcggagaaatcatgttgtaaaaataaggaaagaatcaggacaaaaaaagccacgcatggcgtgacttttatataatatattaataagtttattatttagcttcgaagtatactcttctgttggctctgtttttccattcagggcacttcgttgctggttcacactcaggatatttaaggtctttttcaccttttcctatggcctgaagtttacctgtctgaacaccgtttttaatcagatagttcttaacgttgtttgctcttctttcagatagtttctggttgtaagcgtcagtacctcttgtatcagtagcaccgattacattgtaagaaccacttgaagaattaatatagttgacagcattgtttaggattggagtatttgatggtaaaattctgtcagaatttaagtcaaactcgatgccttccaatttagtttctgtctctactacaggtcctgttgtagctacaggacaaccgttgttttcaacaggtcccggaactgtaacacacttatcgtaaaggtcaattacaccatcaaggtctgtgtcaagagcaactccggcaccatccactcttgctcctgcaggagtatcaagctgtctgtcccaatcgtcacataccccatcgttatcagcatctccttttttacatacttcgatatcctggtttttattagccaatacatcaagtttgtaatagatttcctgaagcgggtcatgccacattaagtgagactcatgttttccaagttttaaagaaacccctaaagtagcgttgaagaagttgtcagaaacctgctcagaacgcttgttgattgcgctgtaagcatcacctccgccatcaaactcatcatcaccggttaccacatacattaatctaccttcaatatcaattcttctgttcactttaaatttcagacctgtaccagcctgcatgaacatagaacctaattggaaaggtttaacttcagtcattagtcgttgtggtccgttacctactttctgatatgctctgtaggcaatagtaccaacacctgcgtatccatgaagagcccatctgtaaggagaatggttatcaactcttctcaatagattggagaagttgatatctcctaagattgagatggcgtcatactgagttctggctcctactgcagttgcatctggtgctgtttttttagtattgaaccatccttgtcttgtttcacctctgtcatattgtaggttgattccgaaagcatgggtaattgctttgtcaatacttacatacgctgaatatccaaaaaggtttttaccgttaccgtttttgatagaggttaaatccgctgactgaagaagcggaacacccaccccggcagaaattgaccaatcattaaatctttttgattgattggtgaatggggaaacgttagcagatcccgaagaaaatgtattaggatattctccttttgaaactgccgttgagtcttgtgcataggtagcagaaggaattgctaatgctaatgcaacaattgctaaacttaatttcatagtgttatttttttaagttaagttattttaaatgattttttacgttaaaaagcgattttgtattaatttttttcaaaacaaacttgttgatttttaatgtgtttcatgccagttgtcctgaaaataatgataaaggtaggtaaaaaaattcgtagtagaaaaaaattaaaccgaaaagaacaattctttccggtttatgtatttgaaattaattcttctttttcttagctggaactttttttactgctttttttacaggagtatcttcatagtctttctttttgatagaatcccattctgaactttctacaaatcttacagtaacttttctgtctgccattctttcagcatctgaagctgatgcaggaattgttgcttcagcagaacctacacctcttgatttcagaacattttcattaatacctctgctttccaaagctcctacaacagcagccgctctttctttagacagtcttaggttgtaagctgcgtttcctttaatatctgtatgacctgtcaacaagtagtttcctccgttttctttaataattgaagctgcaagatccagtttctcattagattcaggtctgatagtagccttattgaaattaaaatagatatctttaagagtcttttctacttctacagcagtttctttattatcttttttagctacaggacaaccgttgttttcaacaggtcccggaacggtaacacacttatcgtaaaggtcaattacaccatcaaggtctgtatccagagcaactccggcaccatccactcttgctcctgcaggagtatcaagctgtctgtcccaatcgtcacataccccgtcgttatcagcatctccttttttacatacttcgatatcctggtttttattagccaatacatcaagtttgtaatagatttcctgaagcgggtcatgccacattaagtgagactcatgttttcctaatttgaaagaaacccctaaggtagcgttgaagaagttgtcagaaacctgctcagaacgcttgttgattgcgctgtaagcatcacctccgccatcaaactcatcatcaccggttaccacatacattaatctaccttcaatatcaattcttctgttcactttaaatttcagacctgtaccagcctgcatgaacatagaacctaattggaaaggtttaacttcagtcattagtcgttgtggtccgttacctactttctgatatgctctgtaggcaatagtaccaacaccagcatatccatgaagagcccatctgtaaggagaatggttatcaactcttctcaatagattggagaagttgatatctcctaagattgagatggcgtcatactgagttctggctcctactgcagttgcatctggtgctgtttttttagtattgaaccatccttgtcttgtttcacctctgtcatattgtaggttgattccgaaagcatgggtaattgctttgtcaatacttacatacgctgaatatccaaaaaggtttttaccgttaccgtttttgatagaggttaaatccgctgactgaagaagcggtacgcccgcacctaccgaaatagaccagtcattaaatctcttggattggttcgtaaatggggaaacattagcagatccggaagaaaatgtattgggatattctcctgttgaaactgccgttgtgtcttgcgcataaccagccataggaatggctaaagcaaatgcagcaattgctaaacttaatttcatcgtgtatttattatttgatttcttttttttgaaaaaagaattttaagtttttgattatttaaccgggcatccgttattttcaacaggtcctggaacggttacacacttatcataaaggtcaataactccgtcaaggtccatatccaaagcaactccggcgccatctactcttgcacctgcaggagtatcaagctgtctgtcccagtcatcacatactccgtcattatcagcatcgcctttttcacaaacaacaagatcggtagctgcattttcaagaacgctggttctgtaataagcttcctgaagcggatcatgccatgccaggtgagataaatgtttacctagtttgaaagatactcctaaacttactgtccaggcgttatctgatcttctagagtttagcatgttatattttgaacctggtgtagaaggatcataatcattaggatcagcccatccgccaccatcgaattcatcatcaccactgatgatgtacatggttcttgcttcaatgtcaataagttttgaaacattatattttatccctaaacctccctgatagaagatcgagttgatatcaatatcctgtttgataaacaatggagttcttcttggagttgtgctccatctgaattcatcgttgtcatgtaatgatgttctgaatccctgtagcccaatacccatgtatccatggaaagcccatctgtatggagaatggttgtctactcttctgaataagtttgagaagttgatatcccctaataaagagatattgttaaattgtgtcgttgcagtagcgattcctgatttaacacctgcagcaccaggaagctgggctgtttgtttcgtttctcctctcatatacataaggcttagaccaaatgcatgtgtgatttgtttgtctacgcttacatatgcattgtacccccaattggtcttatctttacggatagattttaaatcggagtgtaccataaatgcaggacctcctccgacagaaatagaccagtctctgaaacgtctggctttgttgtcaaagggttgtacattagcggagcctgaagagaatgtattaggatactcagtagaagagtttactgtagtagcattgctttgtgcgaaagctgcaattggcaatgacgtagccaataataataaacctaatttcatacaatatgttttatgttttaaataaaatcttttaataatactctggaaaaatccctttcaaaaagatgttttttatgagggatttctaatctttctgatttaaaatttaattcattatatttaatgatatcaatatctattatcctgtcagtatagcctccggatacttttgaatcattaattcttcccatctcaacttctatattcttaatacaatcaagcagttgaattggagaaagatctgtgaatattactgttgcaatattacaaaaaatattggaactggcaaattctacgggttcagacattaaatattcgctgatttgtgaaatgtgatttccagcatcgctgattttctttaaagcgagctctacattttttttttgctctcccaggttacttcctagtaacaaaactaccttatgctgcgacatattggaaaattgattgatttatgagaagtttcttcaaaaatgttttggcaaatatagtggcaattatcatactttgcgctctgtttttcatctttttcattatgatgcttgtattcagtgcgatgggaaatgataagtcggtagcggtgaaaaagaactcggttcttacgattaatttaaagaccaatatcattgatagccctacagaagaggaaatgggattgttcggtataggagcccaaaataaaagtatccttatctatgatgcagtggaggctattaataaagccaaaactgatgataatataaaagggatcagtatagaagcagatgacctgaacgcggggcttacccaaattgatgatcttagaaatgcaattgaagatttcaagaaaagcggaaaatttgtatatgcgtacggaaacggagtatcacagtctgcttattatttaggatctgttgccgataaatattacctgcatccggcaggaatgatcgaattaaaaggtctttctaccgaggttacttttttcaaggattttgctgataaatacggtatcgggatagaagtgatccgtcacggtaaattcaagtctgcagtagagccttttttaagaaatgatatttcacccgaaaataaagaacagctaagcactcttctgaatgacctctggaaaaacacatccaataaaatggctgcttcaagaaagattgataccgctcagttccgaaccattacagacagcttatacggaatgattcctgagcaaagcttacaatataaacttgcagacaaactgatgcagaaatcagaatatgaaaatcttatcaggacaaaattaaacataaaagaaaaggagaaactgaacaaaatttctctggcaagctatatcagttcttatgctgatgatgataaatctggtgaaaaggtagctgtattgtatgcttccggttctatcaataacggagatgagtacaatgatattcattccgagaaatatgtgaagtatattaagaaacttcaggaggatgataaggtgaaagcggttgttttcagaattaactctccggggggaagtgctaatgcttcagatgaaatcttatttgaattgcagcagctgaaaaagaaaaaacctttgattgtttcttttggtgattatgcagcatcaggaggatattatgtagccatggctgcggataaaatttattcagagcctaatacacttaccggttctatcggagttttcggggtaatgccttattataaagatattgcggctaaaaacggaatccgagcagatattgttgcaaccaatgccaactctatgtattattcaggtttaaacggagtgactccttatggcgttaatatgatgacaagaagtgtggaaggcacttataagaggtttgtacattttgtaactcagaacagaaagaaaacttttgagcagatcgataatgtaggaggaggcagggtatggagtggtgttcgtgccaaagagataggattggtagatgaacttggtacattaacagatgctgtgaagttcgcagcgcagaaagcgggattaaaatcatatcaggtagatgcctttcctaagagaatgtcgccgtttgagcaaatcttcaaagacctgaatgaggaagatgtttctgcaagaatcattaaaaacaagatagggaagtccaactatgaaattttacagcagatcacaaacaaaaaactacagtctgaggtgaaaatggaaatgccgtatcagatcagaatcaacaactaactaaatttatattgtatacaaaaatcccggacctgaaatttcagatccgggattttattttttatcagcgttaatatcagcttttccttgtggccattccgtaaatccagaggataattaaagcgcctccgattgaaagaatccagcttctcggattccagaatgaagtgacatctccccaatgcagaatgtaaactcctatagctcctcctacaaatgctcccagaattcccaggataatagtgattaaccatcctcctccctgagttccaggcatgatcattttagcgatagcacctgcaataagaccgaataagatccatgttagtattcccatagttgcaaatttttttagtgttaatatttaaaaatgatttgtttactaatataagggaaaacatgatataaatcatcttttcttgaagaatgagtctacaaattccgtaccattaaaaagctgcaggtcctgcattctttcacctacacctatgtatttaaccggaatctgaaactggtcagaaataccgattacaacacctccttttgctgttccgtcaagttttgttactgctaaagcgtttacttctgttgcggctgtaaactgcttggcctgttcgaatgcgttctgccctgtagaaccgtcaagtactaaaagaatttcatgaggtgcatcaggaattactttctgcataactcttttaatcttggaaagctcattcatcaggttaatcttattgtgaagccttcctgcggtatcaataattacaacgtccgcattttgggctaccgcactttgtaccgtatcaaatgctacagaagcagggtcggaacccattccctgttttacaatcggaacatcaactctttcactccagatcgtaagctgatcaacagccgccgctctaaaggtatctgccgctccgagaactacttttttaccttctgatttgaactggtgggcaagctttccgatagtcgttgtttttccaactccgtttactcctacaaccataataacatatggttttttggaagtgtcaatatttcctgtacctgcatgcggattttcaagcaataatcctgaaatttcttcacgaaggattttatccagttcgtttacacctacatatttatctctggcaacacgttcttcaattctttcaatgattttgatagtggtagaggcgccaacatcggaggcaatcagtacttcttcaaggtcatccagaacctcatcatctactttgcttttaccgacaacggctttcgtcattttttcaaagaatccctggctggacttttccagtcctttgtctaaggtttctttttcttcttttttgaaaatatttttaaaccaactcatagtttcagtttattcttatttatttttaatcactgctgtggcttctacctctataagcacatcatctctgaaaagcctgctcacttccacaaggctgcttacaggaggattttgaaggttgacatataaatcccttacttttctgaattcaggtgtttttttgatatctgtggtatagattaccattttgataatatcttttcccgtagctccatactcattcagaatgttttcaatatttttgaaaacctgctgtgcctgttcttcaatagtatttccaacaagtttcccttccggatccagaggcacctgtccggataacaaaatcattctggaacttccgcagtcaatgcttactgactgtgagagcccttttatgtcgaaaacttttggcgaacttttatattctgcagggttcatttttttctgactgaatgaaaatagaaaagttgctgtgcaggccagaacaagtatctttttcatactttactgattaataatctggtgcacaaagataacaaaaaaactacccaaaatatgagtagttttttatattgtaaacaaagtaacgattattttttcaaataaccatctacttcatcagcattcattactttttcttcgaaaacgtaagctcctgatttagaagacttaaccattttcaccactttagtcatctttttagactgaccgctttgtagggttgctactactttctttgccatggtaagttattatttataaattacttaatttctttgtgaatggtagatctcttaagaacaggattgtattttttcaattccaatctttctgtagtgttctttttattttttgtagaaatgtatctagacattcctggcataccactttctttgtgctctgtgcattcaaggattacttgaactctatttcctttttttgccatgatttattaattctttttaatcaatccgtttctagtagctctttcaatagcttcctcgattccaatcttgttaatcactctcaatccatgagctgatactttcagtgttacgtgcttatcttgctccggaaggtaaaacttcttctctaataagttaatttcaaaacgacgcttcgttttgttattagcgtgagaaacgttgttaccaaccattgcacgctttcctgttatttggcaaattcttgacatatctcgatgttcttatttgtataatatttgagagtgcaaaataacgaagaattttttagatagacaaatcttttggaaaatatttataaataagtggctgattaataatattgaatttttaaaataacagaatccttgggatacagcagataatcagtgctgatatatttcatacaggctttttttcagcaaaagaatttaataatttatctttgtttttaattaatctaaataaaaataaatatgaagaggatttatattttttgttctatgctccccatatccctgatggctcagaattttactgaggtacaaacgggcatgaataatttttattactcagcggctgatgttgccgatatagataacaacggtacattggatattgtggtgaatggagcgatagattctgatggcgatgggaatgtagacagtacctataatgaagtatatcagaataatggaactacattactgccgtttacgggattaggaggagatgtgacacatctgggagatattaggttcattgattataataatgacggactgatggatattatttccacagggctcagctatatggatgttgttaattataaacaataccggttcaaaaataccggagcaggatttataaaagaggcagaattgccaggtaaaatttatgggtctctggaagtttttgattttaataatgacggaaagcctgactatggccttaacggaactcaatatgcgcacggcggaggtttcggaaacagccttgattattataaaaacacaggcaatgattttgccatgacggaaaactgggtggatggaactcagaatggaagctttaaagtggtagatcttaacaatgataatctgctggatcttgtgattatcgggtcggatatcaatggagatgcagtatctaaagtatatatgaatcaaaatggaattcttgtacctacacaggaacttcctcccgtagccgtaggaaaaatagattttgcggactttaatgctgatggctttcaggatattgtaatgattggaagagatataaatgacgaaggatattttgctgttctgatgaatgacggaacgggtacactgacgccacaggtaattccggagaatggtatttcagatgtggcattaagtgtcggggatttaaacaatgacgggtattacgattttatcatttcaggaaataagaattacaatgctgttgtgaaaacgtatctgtataatgtttccaataaccaatttaatgagggaacagtaaccggaattactgagctgggaggtccgggactggtacatctttttgattttaataatgatcatcacctggatattttgttgggtggatttgattggtctgcatctgatctgccttcactgacgaaagtttttaaaaatacttctacatcagtcaatgcgaaacctacagctccgacccaattgaatctgaccaaaaacgttaaccggttcaattttacatggagtggtgcatcagatgataaaaccccggtgaatgcgctgcgctatgaaatttcggtaggttctgcacagggtgcccacgatatcgccagatatgtggtcacaacaccatcatggtttctggagcttgatccggctattcagaatgtatactggagcgtaaaatctattgatgcctcaaaggtgtattctgatgcttccacacagaattttctgggaacagcagaaatcagatcggaaaaacagctgatgatctatcccaatcctgcatcagataaagtttatatcaaaggggagaaggtttcagatgcggaaatgtattcaatggatggaagaaaacttaatatcagtgtaaatggagatcagtctgttgatgtttctcatttaccaaaaggagtatatctattaaaactgaagataaaaaacgaaataaccaccagaaagcttacgattaagtaattgaatcaattctatcttctatcaatgagaaaagccggacgtccagccggcttttctcttttttattgctcaaaacttaagttgtgtcgttcgtgtaaagatttgtgcggtttgtgtttaaaaattacgctttctttgttttctttttaaaccattcaatcaggtagtaaaacaataagaatcctaatgcaaatatggaaaaccttgaaagaaggtctcccgctctcgtataaaacgtcatggtatcatatagatttacctttgcaaataaggctgtctggtcaccatagaaagtatcggcagtgacctctccctttgcattgatatgcgctgaaattccactgttggcagcacgggcaatttcccttcttgtttcaatggctctcagtttagcataagataaaagctgtttgtgtccctctgttactccccaccaggaatcgttggtcataattcctaagaaattagctcctttttttacataatctgttacaaattcaccataaatgctttcataacagatgattggcgccagctttcctttgttgtaaggatttgaaaaagccactctttctttatctgttcccaaagaagccacagttcctcccagattcagcatcgcatctcctaacaaaggttttaaaacattcatataaggaaatatttcaacacctggtaccagcttccctttgtggtaagcctgtactttttggttagggacaagctgaatggcagtattataactgcttacccaaacaccaccattgatctgatatgcctctttaggtaagtcagcaggattataataaaaacggtgcgacgaaattcctgtggcaaaaacagatcccggatggttggataaaaatcctttaatattgttgagaagtaaactcttttcaaaagctgtttcggaaatagaacctcttccaggcagtgctgtttccggtgcaatataataatcaatcctacctgcggaatttttttcagcaagcgctaataaatcctgttctatggtgagactgtcttttgaatatttttcagcataaggatcgaggtccggttgcagcatcagaacattaacctgaccggatggcttttcatcaaaagtattgtatttaatgaccgagataatcatcggcagagcaattaaagctgcaatgatcgctgagtttttaatcaggtcttttctctttcttcctgcttcccaggttcttactgtataaaaaatcaggacattaactaaaagaatccagaaacttcctccggttgctcccaatgtgtcataccactggatcagtttcgggtagtcagagaatacgttcccaaggttcagccagggccatgttaattcccatcccagatggaatttttcaaagctcatccagatggcaatcagaaatcccaatccccaataggtgccttgagcatttttataccagtgatagcattgaaacaccaaagaatataaaagtgaatttaccagtaccggaaataaaaccgccatcagagagtggcttccgtcaggattctttgagccatacagccatcccgtagtaactacattccagatcacgaaacataagtaagataatccgaagaccacccagctttttcttttataatccgaaaattttgaaacaccatgctccatcatcatcagaggaacaagagcgaaaaatataaaaaacggaaccccgtaagttggccatgaaaccgacagcagcattgctgaaataagtgtaagcagaacgtatttcattaaattattttaatacacaaatttaatgtttttgaaatgaatatattagcagttcaatgttaaagaaaatatataaaatcattattgttccgtatacacttttgctgctttacctgatgtttttggggatgggcagatttcagtatgatgaaaatttaattaccatagaacccgttttatcaacgataaaatttatccagggtccgaataagaccatagatattgtgaagattgttttgggcaatattattatgtttatcccttttggatttcttgggtggataattcctgaactgaaaaagctgaaaccattgatatttggttttatctcatgtatcgttattgtggaagcacttcaatattttacaagaatgggaatatttgaggtagatgatatcatcctgaatacttttggggtgtatctgggatgggagttttgcagaatgattgaaaagagatttagctattaagttctttcgcccgtttttcagcattcagaattccctgtttcagaatttctttgaaactgttttcttcaaaagtttttaaagcagcttcagtggttcctcctttggatgcaacatctttaataagttcctcaagattcttttctgagttattgattaaatgataagcgcccagcatagtctgctttacaaaaagtttggaaaggttttcttcaatgcccatttcaatacctgccttgatcatggcatcaataatgtaataaaaataagcaggaccgcttcctgaaagggccgtgacaccgtccagaagctcttcgtcttccagataaactgatcttccggtactgttcaataatctttcaatattgattaactgactgaaagaaattccgttggcagcggtatacccggtaattcccattcccagaagagtaggagagttcggcatggctcttacaaccagcgggtgattcagtagcttttggattttttcaatattaattccggccatgatggataaaaccatctggttttcttttaaagtaaactgaatattttgtgcaaccgtctggaaatcctgaggttttacagcaatgatgattaaatccgcatcaatgtcttttacttcttcgaaagtggaaattttagatttggggaattcttcagctattttggaaattttttcctgatttctgataatcagatgtaggtgttcaggcttgatcagttcatatttcagaaatgactttgaaaaagaaagtcccatatttccggctccaagaatcgctattttcattacgaattgtaaattttttagctaaaataatgattttccggagattggatatcaattgattctgaattaattttgttggaaaatgcaaagacgcaagattttgaataagatgctgttttaagcgcaagaaaatcgaagattttcagcaggagtgaaataaaagtaatatcataaagatctgtgtcatctgagaaatccgtgcgaaaatattattgcataaaatacgcagtattaaattgcatcggagataaaaatccctggggcttaaaaatattcgatacagataattaagaaataaaaaggctgaaatcatatgaatcagccttatgtattttaaataatatttacttcccgctcaagctctatcccgaacttctcctttacagaattgataatttcagtagaaaaatcaaaaatctcttttcctgtagcgtttccggttgcattgatgatcaccagagattgtaatttgtgtgaagcaacattcccgatctgttttcccttccatccacattgctcaatcagccatccggcaggaacttttaccatatctccgtttggatagccctggatattttcaaatttttgtttcaatgcttcaaattgggccagaggaatcgttgggtttttgaaaaagcttccggcattcccgatttctttaggatccggcaatttactttgtctgatattgatgactgccctggaaacatcctgaatagtcggattttcaatgccaaggttttccagttcggatttgatggcaccatattccgttttgatatggtgatctttttgggtgagtttaaaagttacctctagaataacatacctgcctttcccttcctgtttgaaaacagagtccctgtaaccaaacctgcattgttcaagattgaaagttgtaagctcagaattctccagatccaatacctgacagctaacaaaaatgtcttttatttctgttccgtaagctccgatattctgcattggagaagtacccacatttccgggaatcaatgaaagattttccagtccgccataattcttttccaggcaatacatcacaaattcatgccagttttcacctgcttttgcggttacccatacttcattttcattgatgctttcctcggaaattccttttaaatttaatctgatgacaagaccttcaaagtctttagtcagtaaaatattgcttccgcctcctaaaaacagaagctgaagagattggttttttgcgaaaataagcgcctcttttaattcatcaatcgtattgacttcagtaaaataccgggcccgggaatcaacaccaaatgtgttataaggctttaatgaaaaattttcctgcatattttattggtattctttagggagaattttgtctagttgttctttaagttgttgtaactgcttgtaatgtagggtgtctgcataagcgtttacatagatatgtgattttttgggagtccggatctggaacgtttcatctgtcccatccacaggctgttgacttggcgagctttttatgtgatcaagatctgtgattttgactgatgatataagctttttccacatttcggcattaatggcagatgaccattttttatgagtttgattggctgtcatccctttttcagcaaaaacagaatcttctgtggctttgataattctgtaacttccgagattccctccgatttccgatacactgacaaatgtaatttcgtacgggtttttatggaaatcagatggttctgctttttttgaatcacaggaaaagaatgccgacagcaaaagaatcgaaaacaggattttcagatagcgtttttttgttgtcggcataagttatattttacaggctgaattcttctctgtacttctttaaagcttctttaagaatttcagcacttctttttaaatcttcttctttcaaaacgtaggcaattcttacctgcttttttcccagttcaggattgctgtagaatcctcctgcaggtgcaaccatgatggtttcattattaagagaatatttttcaagcagccactgtgcaaatttttcagtatcatctaccggaagttcggcaacacagtagaaagctcctcttggcttaggacagatcacgccaggaatcgcatttaaaagatctaccaatatatttcttctgtgggtatattcttctcttaccgctctgatataaggtccgtcgttctgatgtgctgctgttgctgcaatctgtcccaagagaacagggcttagtcttgcctgggcaaaaagcatagccgcattacggattttgctggaacgggtaaccatacatcctattcttactccacacattgaataacgcttggattcagaatcgatgatgatacagttttcagctaattccgggaactcaagcattgagatctgctgctttccatcatatacatattctctgtatacttcatcagaaatgattacaatatcgtattttaaagcaatttctgccagtttctgaagttcttcacgagtataaagatatccggtaggatttccagggttgcagataatgattgctcttgttttttctgtaatttttttctcaaattcctctacaggaggtaaagcaaaacctgtatcaatagtagaaggtacagctactacgtttacatcaaatgtgctggtaaatccattgtagttggcatagtaaggctcagggataatcacttcatcaccttcgtcacataaagtagagatggcaaagttaagagcttcagaacctccgttggtaacaataaagttatcaggagtaagatctgagaaacctaatgaatgataatattcagtaagggcttttctgtactcgatattaccttcagaaagcgcatattccaatacttttaaatcgatattttttaaagcatttaaagctgtttccggagtttcaatatcaggctgtccgatattaaggtgatatacttttattcctttctgttttgcttgtaaagcaaagggaaccagttttcttaccggcgatggcggcatatgcagtgctctgtttgaaatattcggcattgttcaaaaaatttgtatgacaaaaataggatttaatttctcaataataaaattatgagtcaataagaaaatattcctgaacttttatattcttcgaaaaattcagttattacagtggtttttgatatggatttcctatgtgttttaaataaatgttatgattttgttaaaaataatatttttgtattgttatttttcgttaatttcgctgtaaatgtgattaaaatggtaataaatttattttctagagtggtacctgctattgctctgttttcagcctctgcaatgatggctcagaattatcaaactatgcccgtttcctctggctttacagctgatgtaattgcgaacggtataggctcttcatcaattactacaaacaatgacgtagacggagtttcttacgcttttgtagccaaagattttcagctgacttccacaagtcctgccattacgtatggtatacctgtggacggagttattaattctgtggtggcaaccactccgggattgagctttcagctggcaggtctgaatgccaacaattcgttaaggctggctgcaattaatgataacggaactctgacatttacggcaccgaaagctgctaccaagctttatatgcttgccgtaagcggaagtggtacttcaacggtaagtgtagtggtgaattttaccgatggcagttcccagacgttttcaagtatcagtcttgctgactggtacggaggttccaatttcgccatacagggaataggaaggattaaaaaaccgggggctactcctgcatccggtgatgatgttccttcacctgaaggtggaaccaatccaagattatatcaggctgaattggcaatagacgcagcaaaccaggcgaagctgatacaaagtgtaacggtaaccaaagcaagtggctcaggtatcccgaatatttttgctttttcagtggatgcttattcagattgtatgcctcctgtattacaggcagtttcaggaattacggccaactctgctttagtttcatggacaggtaatgcagccagttatgatgtataccacagtacttcaaatacaataccttcgagctctgtgacacctacttatccaggtgtaacgggaacaagtacaacaataggaagtcttaattccaatacgacttattattattgggtaagatccaactgtaatactgcaaccggccaaagtacatggtcttttgcaggaacatttaaaacagcctgctctactttcactgttccgtatacagaaaactttgatacaaccagtaccggttcgagcaccaacaacaacgctccaagctgctgggcatatctggaaagtgcatcatttgcaggctatggatatgtaactacaacaaataactattcggcacctaatgcttattatctatataattcaagcgctactacaggaagtcagatgttggttgctcctccaacgatcaacctttcagacggaacgaaacgtgtgagattctatgcaaaaacaggaacaacagggactccgttattaataggtactctatcgaatcctgcagaccctgcttcttttaccccaattggttctcctattactttgacatctaaccatacacaatatacagttaatattcctgcgggttctgatttgcagttagcatttaaacatggtttaggaggtacctaccgttctatttatattgataatatttctgttcagaatattccttcctgcgttgagccgacagccgttacatcatccaacgtgaattcaaattcagcaacaatcggatggacagccccatcttcagctcctgcgggcggatatgaggtgtattacagtacaagcaatacagcacctgatgcttccactgttttaaatgcagcaaactctgtaacgtctgcaacaacttctgcaccgataaatacattgcagccatctaccacctattatgcgtgggtgagatctagctgcagcgcaactgataaaagcatctggactgaagttcctgtatcatttacaactacttgtcttccgataactgcactgccttggagtgaaaattttgattcaatgacgaatataggctctgctatcgttccagggtgctggaaacaaactccgggaggaagttcatccagctataactttacttcagcaaatgcttcccagcaagcttataatgatcctaaatctgctccgaattatctgacgatctattatccatatagtaatgccgcttatttatggacacctacatttactttaactgcaggaacgtcatatgaattctcattctactgggtaggagacggctatgcaggctggcaaaatgaagtattggtaaacaatggacaaacagcggccggtgcaaccagtttaacgacatttatcacttctgatcaaacagcaacaggaggaggtaacagcaccgaatatactaaggttactgtttcatatacaccaacaactaccggcgattattcatttggaattaaagctttgaatacaacaacggcgccatattatatgggatttgatgatttctcccttacacagtctaatttaagcacggctgaaacgtctgttaagaaaaaagaaatcaatgtatatcctaatcctttcaaagatgttctgcatgttgcggatatcaaaaatgttaaatctgtaaccgttacggatgtagcaggaagagtggtgaaaactattgataatccaactacagaacttcagttaggagatttaaatgctggtttatatttagtgacaatgaactttaaagatggctcgaaatcaacagtaaaagccattaagaaataaaattttttgagttaataatttctgtaggcagttgcattcgtgtggctgcctttttaatggctttttcacataataactggaaaaaattattatcggaaatgttcataaaattattatacatttgtgccgaaaactataacaaccatgaatagatttaaactcctttttttactgcccatattatgttccggattctcccgggctcagcgaattgataaagaaataatcagcttccagcttttgaaagaaccggtttttcctacagacctttccaacagaaattatacgattaccgtaaaatctccctataatattacaaaagatgatgtgataagaatttcaaaagaagattatcaaaggaaggtggacaattatcagacgaatgttgaaaatgccaagtacgaacatcaggaaagattaaaagactacgatgctgaggtaaaaaaactacaggagaaatacaaactggaatcagcagaatataataaattatctgcagttgagaaaattgctgcaaccaacggagctcctatgttgagattaccttcaaggccaatcctgaatatccctccaatgccggtttaccaacaacctgatctgagagacgccctgattgtagataacaaaattctggcgtcacaaatggatgtgacaggtttttcaaaaggcggaaattatcttgacatcgttattgaaatggaaagaactaacttccaggacaaccaaggaaaaacttttgccaatcagcctacaaggatcgttgccaaacaaggcgatgcagtaaagctggataaaacctatttctcagattttactgaagtagcaagtgttccgactaatgaaatcaatttgaatgcccaggaaaaaagatatcttcagagaacgatggaccgtacaaggaatattattaatgaaaatttcggttatcagacaatcaattccacggtaactctggcgacggtaaagaacaaaggagaatatgatgatctggaaaaagcatacatctacgtgacgaccaatctgaaaaaacttcaggcaaaatcagactacaccccgaataaagtagccatggaaaacatgcagaaaggaattgatctctggaaaaccgctttgacaaaagtgaattacaatgacaaaaaggctgtttacaaccaaaagatcggcgaatacctttattttaacctgatcagattgaatattgctttaggtaattaccaggaagcagagaaatatttaaatgagttgcaggaacatttagtagatatcaaattatcctacgatgccaatcttgaactgaaaagattggaagaaaaaatttataataactaaagaaaacaatatgattaaacagattattgcttcggcattaataaccgcttctgtgtacaattatgcacagacaaaagtgactgaaggaacaaagttcacagtggacgccaatcttgaaacggatgataaactggtactggcagatgattacaactcttatatgttcagcgccatcaatattgacggcctgatgagaaatgttttcccgcataagaaattactgatgagaaaactggatcagaacggaagccttgtggatacatatgtgaaagattatgccaacaaaacgaatggtgtacttcataattaccttggctcacagcagattgatgatgataaatttatagcatttactgaagagtatttcgggaaagaaaacagaaaggaggtatttcagcatgttttcagtaaaaaagaaggcacatttaccaccaaaagcattgcaaaatacagcatcgaatctaccaacaaatcaggaaccacttatgttcttttttcggaaaacggtaaatatgcagcgatcttcaatgacagatatgccaacaaaaaaacagataacgtgaatgatgttctggtcctggatctgagaacactttctccggtttggaacaaagagatcacattaagcaatgattatgttgaaaagtctttgacgctgactaactcagcgaagattgttgtactgagaaaagctgcaggatggaaggaatcctataagctggaacttgtttcgaatactgaagataaagatcttccgtttgatgataaatatattcctgaaaaattatatgcattcagtaaaaatgacagcgattatctggtgacatttggaagaaaaaatgcggcggttaccattggtgcaagtacgtttggaacagtaatgttttatgatatgaagtcaggaaaagcagtaatcagcaataccaatttagccggaagcaaagatatgaatgatgtgaaggtcatcaaaacgattataaaaggagatgaaactttaatggctgtacagcaggaaacggtgacaagaccgatgccgacagcaatgaaccgtttcccagatcctgtgtattcactggatgcgggaatgctgatcaaattcaataaagaaggagaagtaaagcagtttgtggctgcgggaacttctacaggaaaaagaattcatgtggttgaaaccggagataaactttatatttctgctttctatccaaaaggagcattcgggaatacaggattttctatgaaagtctttgatttcaccaatctgaaacctcaggaagtaagccttgattataaaggaagaaactttttccagaactatggctttgcagatggaaatatgattcaatatattccgaatgtcaataaaatgatgttccttcaaaagagcggtaaagatgttcagatgttcaatgtatataattttataaaataattgtattttagaaaaaattaaaatatgcagattcagtcagtttccgtagaagattatatctcaaaaattcctgaagaaaggcaagaggcttttaaaaaactttttgatacagtgaatgacaatcttcccaaaggtttcgaagaagctacaaattatgggatgatcggctgggtagttcctttggcaacatttcctgcaggatatcactgtgcacccgggaccccgctgccattcattaatctggcttcccagaagaattttatagcactatatcatatgggactttattcaaaaccggaacttcttgattggtttgtggcagaatatccaaaacattccaaaaagaaactggacatgggtaaatcctgtatccgctttaaaaaagcagaagatatcccttttgaactgatcgcagaactcagtaagaaaatgactcccgacgactggatcggaatttatgagtcgcagtataagaaataaaaaagaaccctgaaatctatttgatttcagggttcttttttgcgctggaaactggaagtttgaagctggaagttatagttgtgtttttagaatcaatgtttgtcgtttggtgggtatgtattgtaggattaaaaaaagttaattaaatggtgtgcatgtattcatcggcttccggcttcattctttcagctaaaaatgaatatcccagattcctgctttacgctcaagttcaattaaagcagatgcattatcggcaaggacctgataatagtcttttcttacattattgtaggttctctgggcattcagaacttcaaggatagaactttctcctcttttatagctgtaaataattccttccagaatggtttgtgcttctgcaagcattccattgtggaattgtctgagctgtttctgggttgccacatactgttgataagcctgcattacttcagctcttatggcttgttcggtctgtttatattcaatttctgcctgtgaagatgccatttctgctatttttactcctgcatttcttttgttggaaaatttaaggggaatgctaatgcccatttttacagcatttacagtgggagagggtgcaatttcgttgatggcttctgtgtggcgttctgctcctgcactgatgccaaggtctatgacacggttggctttttcaagactgatctggcttctggtaacttctgtattttgtctggcggccagtaaatctgctctttcattcaatgcctgaagaatcaggtcatcaatactgaaattcctgttgaaagcatttaaatctccgctaacctctctgtccataattttgctgtctcccagaaatacagataaactggtgagagcctgctgttcttcactttcagcctgatatacttcgttgaggagagaagctgcttccagcttactttgtttggaagtcacgagcgatatggttcccaacctgtagcggatactgtcggactttgcaagctgttgcatgtttttataagaatcctgttgtacttcaagcaatgctttggattttaatgcattgatataccctaagctggcatctgcacgaaggttcctgaagaaatcctgcaattgcagtttgctaagctcagattggtttctggccagatttaccctagcttttcttttaccgccaagctcgagggtccagccaagtgatgccccgtaaacataacccatattttgattcacaccattattggtggtttccatttccaattgaggatcaggaaacatatttgcggtccggatagcagcttcagcgatacttacattgtatttctgagaagcataacctaaatttttacttccgacaagattcaggtattctccaaatgacaaaagctctttttcctgtgcctttacacttgtgatgcagagcaatacaatggatactatgataaagtgaactctaattttcatctgattctaaattttgttttttgtttctggattcagccataaaataaatcgccggcagtacaaatagggttaaaacagtggagaacatcagcccgtaaacaatcacagttgccagtggacgctgtacatctgaaccgattcctgtagccaatgatgccggtaacaatccgattatagcaaccgttgcagtcattaatacaggtctgaaacggtcttttgcccctttgatggcagcctttttcagttcatatcctttcttacgcagatcgttgatgtgagaaatcatgatcactccgttctggatggcaactccgaataaagcgataaatcctacagctgaagagacattcagagacattccccggatattgagtgccagcattccgccaaataatgccaatggtacaatagacatcaggactaaagcctgtctgaaatctccaaatgcaccatataacaaaagaaacataatggccagtgcgagtggaacaataaatgcaagtcttgaataagccctgttttgattttcaaactggccaccccatttgatctggtacttttcgtggtcgtatctaatatctttctcaattttattctgtgcgtttttcaggaaagatgaaagatcggtacctctcagattaagctttaccgtaagatgacgtttgttcatttctcgggtaatcgtgctttctccggtactcagtttcacttctgctacctgtgacaatgggattttggctccggaagctgaggtcagcattaggtttccgattttatccggagtatcgcggctgtcttccgtgtaacgacaggaaatatcatacactttattgccgataaagatctgagaaatggcttttcctcccaatgccacttcaataaggtcggcaacatctgctacattcagaccatactgagcaattttgtccctgtttgcaatgatctgcagctgaggtaacggcggctcctgatcaatggcaaggtctgctgatcccgggattttattcaaggtagacaaaacatcttctgcaatgcgtctggtttctttaaaatcttctccatatacttttacaaccagttcactgtgagcgccggagattttatccatcactccgtcaatcataggttgtgaaaagcctaccgtgaatcccggcatgtctttataatctgccgcaagttctctgatgaggtctgcttttgtttttccggaaggccattcgctgtaaggctttattccaatagaaacctcgaaatgagaagctgtccacggatctgtgccatcatcattgcggcctgcctgtaccatcatataagtgatttcggaatgtttcagggtacgggcccgcagggtatcactcatttcttttgattgggctaaggatattcccggagacagctgtacctgcagccagatagaaccttcatccagctccggaagaaaatcttttcctacggtgtaagacagaattccggaggatatcaatataataatgattggaataataactcttttgggagcctgcattattttttctatcctttttccataggcagcagcaagtttttccaaccatttattatgatagattttttgtggtttgcggtagatgacatacgctaatcccgggatcagaagtaatgctacagcgagcgcaccaagcagagcgtatccaacagtaaaagccatgggggtaaacatttttttctctacccgttcaaaagcaaacaaaggtagataagcggtgatgataataattgttgaaaagaaaatgggcttggctacttcaatcaccctttgggtaattgttttttcttccagtgcttctttcggattttcttcccgtttcttcagaatggtttccagcataacgatgcttccatctacgataattccgaaatcaatagctcccagtgaaagcagattggcaggaatgtcagtaaaatgcattaatataaatgcaaacaataaagaaatcggaatggtaatcgccaccagcaatgctccgcgccagcttccgagaaatacgatcagaataataataaccaatacaattccttcggtaagggtatgagaaactgtggtgagcgttgtttttacaagatctgtccgatccaggaaaggatggatttttacacccggagggagcgtttctttattcagttcttcaatggcttcatgtacacccgccagtacttgcgaaggattttgtcctcttagtaaaagaacgattccttctacactttcagaataattacgtttccggtcggtatagccaagaattccttttcgctcaaggtttccgtatttcagtgttcctacatcatttaaaaaaacaggaacgccattttgggtttttactacaattttcccaagatcatttaaatcttttaccaatcctatcccacggatcacataggccaggtttccgcggggaagcatacttcctccggcacttacattatttttggaaatggtttcagttacttctgaaagagaaagtccatactgttcaagcttatgaggatccagttcgatctggaactgggtggtaatccctccgaagttggtaacgtcagcaattccggaaacctgtttgatgcggggaataatgacaaatttttgtaaatctgtcaattcacgcagactgtggttattgctttctatgatatagcggtacacttcgccgatgggagaggtgaggggatctaatccaggctgtgcactgtaaggaagctctacatctgtcagcctttcctgaatacgctgccgtgcccagtagtcatcaatgccatcatcaaaaaccatagtgataatggaaagcccaaaggtacttttgcttctcatcacatgcattccgggaagtccgttcagtgatctttccaaagggatggtgatctgctgttctacttcttcagccgccagtcccggaacctgtgtgaccacctgggaagttacatctgcaatatcgggataggcctctatagataatctggtccaggaataatatccgaagaatcccagtaaaaggaagagggaaagcatcagccatctcttctgtatggagagtgtcaataatttcttcataatttttcatttacattattttgcatccggcatataaattccgccttcactcatgatgatttctccgggttttaagcctgctgtgattcttactgttttctgatcggtttctccagttgtcacaaagcgtttgataaactggtttttaccggtttttacccatacatattgagagctgtcctgttgcattaatgctgttacaggaatcatcaaagctttttcagaaactgttgaaaaattaacggtagcgaacatacccggttttagtttccggtccggattatcacattcaataaggaccttgatgcttcgggtatcttcatccaccatttcattgatatgatatacttttccggtaatgtttctgtccggataggcgcttacttttacggaaacctgatcaccaatactgacaaagcggatgtctttttctttcacatcaccggaaatccagactttggataattctgcgataatcattaccggatcagcatctcctttcagatattgtccgtttacaattctgttggaaataatttctccgttaatgggagctcttaccacaagcggacttcctatacctccgcctttgctgttatacacttttaatgctgaagaagcgttggaaagggatgttcttttatttttaagatcggtttccgcttcgtccagttctttctggatgccgactccgtgtttgaccaagtcctgctggcgtctgtaatttttttctgcaagctgtgcatcattcagggcatctgtataatccttctgaactgaaaaataatcggaagaaaggatttcaaaaagagggcttccggccgaaacattctgtccaagctgaataaaggatttggtaattcttccggaaaaaggactggcaatttccgcgtaatgattgggaatggcctgaattgttcctgctgaaattaccccgtcactgtgttcctgttctgtaacggcctgcgttttaatttttttgaaaacagtattgttttccggtattgtgacctgattatcctgaatgactatttcctgttcgttgttttgctgaggtatattatccttacaggagactgcaaagagaattacactgcttaagattgttcttttcatgttcttaaaacaattgagtgctgttgctgatttttattttttctgtattgtttttccgggtgttgagcagttttttactccttgcttcttttttggaggatagagtgggtctcagaaatatgtttgtagagacaatgaagaaaactgtaataagggcttctttaggatatccgagagcacataaagcacctatggctgcagagcaccataatgtggctgccgtattgaggcctcttacggtaaggccgtctttcataataacaccgccaccgagaaaaccgattccactgacaatataagaggtaattcttccggctgcatcaccaccaattctgatggctatcaatacgaaagctgcagagccgatgcatacaagtgtgttggtacggagacctgcattctttttacgccattgtctttcgaagccaataccggctcccaggcagaatgcggtcagtaaacgaagggtgaattcaaaggtattcataacttttcctgtttttataaagcttttcagctgtacgggaaaagtaggtacaactaaagcttttaagattgataattactgtaaggatctgagtccatatgctttattttttactgtgcaaaagtaaaaagggctgaagttttatgcagttagaaaagctttagaatatgattagaaaattattagagaaaataatttcttgtttagagtatcaggaaaagaattaaaatatttatgtattaagtcttattaataagtgaaaactgtacccattgcaaaaggtaaaaaatcaatacatttgatggcagttattttatatgatgaatttcacggtttacagtataaaataagagtttgttaatcccggaaacttctttccaaaatcttttgaacgatatatttttaggcatgaaaaaatcaaatatagcaataccggctacgcttttagcaattatctgtgtacagggaggagcatccattgcgaagcagctttttcctgctataggagctattggtactgttactttaaggattgtactttcagcggttctgcttactttgattaaccgtccgaaatttttaacatttaacagacagaagtggcaatattgtgcaatatacggaatcgggctggcagcaatgaatcttattttttatatggctattcaaagaattccattggggctggctgtgactgtagaatttgcggggcctttatttcttgcactggctttatcccgtaaactgctggacgtagtatgggctttgctggcttgtgcgggaattttactgatcgtaccgtggcataatgatcatgtagatttgataggtcttggattggcttttctggcagggatgttctgggctgtttatatcataatgggaggtaaggtttctaaaataatggacggaaaggatgcggtaacaacaggaatgatattcgcgagtctggtgattattccttttaccatatgggatggtgctgttttcaacctgactccaaccatttttgtgaaaggtctcggtgtggcgattctttcgagtgctttaccattttctttggaaattatggctttgaaaagacttccggctaaaacgttcagtattctgatgagtctggaacctgcatttgctgcactttccggcttggtcttccttgctgaaaaattatcttttttacagtggatttctattgcctgtgtgattgctgcaagtataggaacaactgttttcagcagagcatctaatcattaaaagattttgtcccatgataagattacattggaaaatacagcttattctgcttctgatttcgctttttttcgttggcttgggtatacaaagtattgcagaagaaaaaaagtccggaactcttttattcagaaattttttacatattttaccttttgtgatcagtagtatagtttttatcatcaatatccgtaatcagagcaaaaaaaagtgataatgctttttgagaaggttatgtaatgtcaaatatcacggtgaaaacagtctcattgtattctgatactacgttgatttttgcatggtgaagatgaatgattttttccgtaagaaataatcctattccgtgcccttttttctgccgggaggcttcacttctgtaaaatggcttgaaaatatgctgtaaatcttctttaaaaataatatttcctgtattgctgaaagtgatggtaagagttttggaatgaacgctcacatcgatcaggcaggtatgttccggggaatatttgcaggcgttgtcaatgagattattaaaagcaaccctcagaagatattcatttccctgaataataagctgatgttcttctacagagtcttctatgttcattgaaactttatatcctgaattttcttttattgttttggtataagattccagaagaacttcatccaggcgtacttcagcaaaactgatttcattgggatcataactcgctttggcaagatccattaagctattggaaagcgttaccatatttcgggcatcttccagcgcatatcgtatggtttcctgatattcttctttggttttatctttttcggaagccagttcaagttctgtaatgatagcagataaaggagttctaagttcgtgtgaaatattggctacgaaatgcttttgtgaatcaaaggaattttcaaggcgctccagcattccgttgaagttttgggccagttcattcaattcatccttttctttcgttgttttcaggcgcagctgtaattttccggcggtaatctttttgatctgattcaccatttcactgagtgggctcaatgcttttttggaaagaaatattcctgccagatagatcaggatcagaatactgaaaaaggaaataatactgatggttaaaagatgcgtaagatattcgtatccgtatttgtcataagccgccgccgttacagcataagattttccttcataatgatacaccattccaatgacctgcagatcatttaaaaagaaactgattctttttttccggaatatctgtgaaagcatttcaggagtttcctttacataatctaccttggcatcatcatgataaaccaattgcttattgctatcataaattgctacctgaacctcattcagtgttctggtattgttttgataaagcttatgcatttcctcctctggtaatgaacttctgaaaaacaggtctgctttggcaatggcttcgttctggagttcgctgtaaaaagattgctctctggcttctttggatgaataatagatcgaaacgctgtaaacacttacaagcattgcagtaattaaggtaaaaagcagcgtaagccgggtcctgattttcatccgaatatttttagtttatttccatcattattgcacaatgcctgactcgtaatttttcttcaggataaatcccatgccggccttggtgtgaataagcttggtttcaaaatctttgtcaattttcttccgcaggtaattgatatagacatcaataaaattggttccggtatcaaaatgggtttcccatactttctcagcaatttcacttcgggaaagaactctttctgaattttcaagcataaatttcagaagattaaactctttgggcgttaatttgatcgggatatgatctctgattactgttttctgctccagattcatttcaatcccgtcatacctcagtatcagaaccttctgatgtctctgttgtgaaaagcgtttcagaagtactttgattcttgccaccaattcccgcatttcaaaaggcttggtgaggtaatcatccgctccggcatcaaatccttccagtttatcatcagtagttcccagcgcggtaagcataatgacaggaagatcgggttttaaagctttgatctcattacaaaattcgagtccatcttttttgggcagtacaatatccgttacaatcagatcaaaatgattctgcagggccagtttcattcctgaatttccatcataagccacagtaacctcaaactgagcttcctgaaatccttttgcaatcaattttgaaagtctgtcgtcgtcttcaactaataaaatatgtggcatgagaatattgaaaatgtttgggttgataggaagaatacatcaatattcccacaaatgtaatgaattctattttgtaattttgattccggaagtataatcagatgtcagaatttacaatgcctttaggaaaaaaaatcaaagaaattacagttacaggattttggttctgtttattgatcatattggctcagtgcagcagcaattctccgggaacggcaccgctcaaaaacggagatctgctttttgttaccgcaaaagaatccggactgtccggggctatcaataacgttactcaaaaacaaaagtctgcttcatttgaccatataggtattattgaaaaagaagataacaggttttatgtcctgcatgctgctcctaagggtggttcccagaaacagaatttaaaggattttataaaagatcagaaggaagaaggacagcaagtaattgtttaccgtttaaaacccgaataccggaaagccattcctaaagctgttaaaaaagcacacgccatgctgggaaaaccttataattttaattacattctggatgaaaactcatattactgttcggattttgtggaaagagcttttcgtgaagatcatatttttaaattggaacctatgacctttattgatcccaaaacaggaaaaacgaatgcattctgggaagaattttatactaagaaaaatctgaaagtccctgaaggagagcctggttgtaatcccaatggtcttgcaggttcggagaaacttgaaaggataggaaccctttaaaacaaagagaagctgagatcggcttcttttttttgtgttaaattttaaaaaatattagtctactaatttggtggactaatatttttttatatttttgtcacagatttaaatgcagagcgcgatatgatctgacaatgtttaacccaaaaatgtttagcaatggttacacctaatcccggcctgcaggttttacaaaacaaaataaacctgcctaaaaaagaattgttactggaaatagagttgaatggcaaaatgaaatttgaacatttgatgaacaccatctataaccaattaggcatctgtcatagagtgttatctgctaatgtagagtatgtgaacggatatagttttggttccgtacagttatatattaatgtcaattcagaagactttcagctgcttgaggtctatctgaataaaaataaacttatcaatacgacggtagaatatacctgcagaacatatttttaagtgagattcatatagttttaattacccaaagtgtccggttcttttaccgggcactttttatttaaaagttatttgagaaccaatatagagttgatggtcgctatttgatggggagtattcctctcctctggaaggtgtcgaaaatagccaataaaaaaagcgttcagaatattccgaacgcttttgtattaaataaataattttaaattctctcgatgtcagcaccaatagctcttagtcttccatcgatattttcgtatcctctgtcgatctgctcgatgttgtggataattgattttccttctgctgaaagtgctgcaataagaagtgcatttccggctctgatgtccggggaaaccattgtggttcctcttaaaggcgcttcctgatttagcccgattacggttgctctgtgcggatcacataaaatgatctgggctcccatgtcgattaatttatccacaaagaataatctggattcaaacattttctgatgaaccaaaatacttccttttgcctgagtagccactactaaaatgatagataataaatccggtgtaaatcctggccatggcgcatccgaaatagtcaggatagatccgtcaataaatttctggattttataatgctcctgggcaggaatgtaaatgtcatcattactttgctcaagctggatccctaattttctgaatgtgttcgggataaccccaagctggttccagtttacatttttgatggtaatttcagacttggtcatcgctgcaagaccaatccaagatccgatttctaccatatccggaagcatcgtgtgctctgttcctctaagatattctaccccttcaatggtaagaaggttagacccgattcctgagatattggctcccattctgttcagcattttacataattgctgaagataaggttcgcaggcagcgttataaattcttgtttttccttttgccagagccgctgccatgacaatattggcagttccggttacagaagcttcttcaagtaagataaattttcctcttaattctttagcttttaaagagtagaaatattcttcttcatcataattaaattctgcacccaattcaacaagtccctggaagtgggtgtccagtcttcttcttccgattttatccccacccggagtcggcatataagcttctccataacgagccaacattggccccatcagcataatcgatccacgtaattttgctccgtcttttttgaattcgctggattttatataatcaaaatttacctgatccgctttgaaagtataatctccctgtccgtttttcgtaacttttaccccaaaatctccaagaatttcaatcagtctgttcacatcatgaatatccggaatgtttttgattcttacttcttcgtccgtcaggagaaccgcacataaaatttgtagagcctcatttttggctccttgtggagttatttcaccctgcagtctttttcctcctcttatttgaaatgttccactcattattttctgtttttatgattgttattatgtcttcttttgttgggctggttattgttcttattattgctgttgttcctgttgttattgttattatttcggttgttgttattattggtgtaatagattttacttttttcaagagaatctattccggtaagatccaacctgttttcagacagttctttcaggtggcggaaaatcacatcatccgtcacatgttctttattatagacattgtaagacttcttcatattgttggcaatcacttcaataagagcttctttttcttcccctgtttctagttcgattgctttttctattagctgaagaatactttttccgtaaaacttaaagtcaccctgaagttttggatattccattcttttaggtctttctgccaattgttctctggtaggaaacggatagggagattctacatccagatcataatctgcaagaataaaaagatgatcccaaagtttatgtttataattttcttcgtcgcgaagttgcgggtttctctgacccataaaatcgatgattgccatagccatttcattcctttcctctttggtaggaagttctttacagcgctcaaccaactgttgtataattctgccgtattccggcatatgaagctgagttttttgggtgttatattccatagtatgcaaatatatggattaaaagaaaaattgtttcgagaatcttaaaattttatgattttttaatgaaaaatttaaatgtctttcttcctgatttattattgaaaattaaaatatttcccattcatttgaatttgtttttaataaaattgtatcttgtttaatagattcataattaattattgcgatgaaaaaaacatattttttcctttccctgctggctttagcgtttgctcactcatgccggaacagtgatgaattaacaatggaaccttccaaaaaggaagaggtccacaataaaacggtgaatgtaacgaaccatgacgggcggcctttcagtacaggaaacggttcaggctctgcacaaagtaaatttattgccgggcccggcggcggagtattgatgcagggtttctactgggatgttcctgatggtggcaattggtggaatactgttaaagataagctgacagcgtggtccaatgcgggaattggtgctgtatggcttcctcccgcatcaaaagcacaaaacggagcatactctatgggatatgaccctacagattattatgattttggaaactttaatcagaatgggagtgtggaaacccgtttcgggtcaagggccgagctggaggcattaattaccaaagcgcatgatgaaaatatgcaggtgtatgcagatattgtgattaaccataacagcggcgggcaatccgaagccaatccttttactggaaccaatacctggacggatttttcgggagtggcttcaggaaaattccagagaaactataatgatttttataagaatgcctacggaaataatgacgaaggagcttttggaggtttcccggatctgtgtcatgccaatcctcatgtgcaggactggctttggggaagagatgattctgttgctaaatactataaaaacgtgatgaaatttgatggctggagatttgattacgtcaaaggttttggcccgtgggttgtcaatacatggaactctaaggttggaggattctctgttggcgagctctgggattccaacgtaaatacattggattggtggtccagtaatgccaacagttctgtatttgattttgctgcttattataaaatggatgaagcgtttgacaacggaaatttaaatgttctgaatgatgatatgatgtggaaaagaaacccttataaggcagtcacttttgtagccaatcatgatacagatatcatctacaataaaatgccggcatatgcttacattctgacccatgaaggatatccgactattttttacagggattatgaagaatggctgaacaaagaaaggcttaataatctgatctggattcacaataataaagctaccggaacaacttctattctgtataccgataatgatgaatatatagcaagaagaaacgggtacaatggtaatccggggcttgttgtttacatcaatacttcatcaagctggcaggaaagatgggtagaaaccaattggagcagtcagcagattaaagatttcacagggaattcaagctggtatccaaccactcagggtgataaatgggtgaaaatccagtgcccgccaaattcttattccgtttggtcgcttaatttataagtaatgagtaatgggtaatgagtaataaagctagtaagaggttgttattcagattaattccattaaacattaaacaataacaactctacatcttatttgtcattccgtaggaatcaattcaatgcatcatattgcaaaagaattcttacggaatgatattttctctaaagttacacctgaataaacttttttctctgatgctgatccggcagataacacttctgattggccagtttcattctgtttctcgaaacaagatcgtaagctttgtcactcaaaaacctgggaataattttgcctaaaaaagccagggagtatattcctcctaacagtttggcaatgtgaagtattgctcttgatttaatcagataatattttcccggtttccagaggtacatggtattgaatatttgagtatccaaccccctttcggataaaaactgctgtccgaattcagactgaagggaagcaaacataaactggtctttccgatcccgctcaagaatccattgcacccagaaattacatacaccgcagtctccgtcaaaaaatacaatatgtttattttcccagttttccacaactttatttattaaacatgattcctctctcagtatcttcctttacctttttgaaatattgaataagatctgtacgctgttcatccgaaagtttggcatcctgatgtcctatataataagattcaagcggcatttctttcttttcaaccatttctatacattcatccagtttatgaagctgtctctgaggctcataaactgcaaaggtagaaaaattaaggctttttctgccctcatcaatatgattttttacccaccatgatgtaggggaaatattagcataccagggataagttgtttcattggaatggcagtcataacatgaagttctgatggtacgggcaattttttccggggtattttttattttcagaaaatccatgcctggtgtaagcggcggattggtcttatcaatggggaagaattgaatgataataaaggcaacgagaatgactacaattatttttttcatagcaggtgttcatattttgataaatataaaggtagttaattttttttatgctttggctggaagttgtgagcagagaaaaatttaccggtcagttttttatttaattattaatttcctattcaattatacaaatgtgcagaggatattttttgtctgttataacttccagcttcctatttccttcttctcgctttttctcttacattgagttattctaaatagagcaaagccaacccaatgaatttaaaaaatgattaacttaataccacaattatgtcctggaaattatgcggtaggaagaacttgtttatagtttttaactatcattgaaataaaaattaatagattgtatttattatttaatcgttgtaggtttgtgatgttcttacaacagagaatgtaactgaattaatcaacataaaataaacgacaatggaaaaagatttgaatgacatcagcaaatgcccgtttcataacggaaccatgaagaagaataatgtagccggaggcggaacaaaaaattctgattggtggcccgatcagcttagagtagatctgcttcgtcagcattcttccctctctgatcctatggataaggattttgactatgccaaagcatttgaaagccttgatctggaggctgtaaaaaaagaccttcacgcattgatgacagattcacaggattggtggccggcggattttggtcattacgggcctttatttatccgtatggcatggcacagtgcgggtacttatagagtaggagatggtagaggcggagcaggagcagggcagcaacgttttgcaccgttaaacagttggccggataacgtgagccttgataaagccagaagattactttggccgatcaaacagaaatatggcaggaatatttcctgggcagatcttttaattcttaccggaaacgttgctcttgaatcgatgggctttaaaacattcggatttgcgggaggacgtgcagatgtatgggaaccggattctgatgtatattggggatcagaaaaaacgtggcttggaggtgatttacgttatgctcatggctcagaaggagtggtagaaggcaattcggcggttcttcctaccgatgatgatgcagacggagatattcattcaagaaaccttgaaaatccattggcagccgtacagatggggcttatttatgtaaatccggaaggaccggatggaaacccggatccgattgcagcggctaaagatatccgtgatactttcgggcgtatggcgatgaatgatgaagaaaccgttgccttgattgccggaggacatactttcggtaaaacacacggagcaggtcctgcagatcatgtaggtaaggaaccggaaggcgcaggaatagagctgcagggacttggatgggcaagtacttataaatcaggaagcggaagagatgccatttccagcggtctggaagtaacctggacagaaactccgactcaatggagtaattatttctttaaaaatctttttgaaaatgaatgggaactcacaaaaagccctgcaggcgctcaccaatgggtagccaaagatggtgctgaaatcattcctgatgcatttgatgctgacaaaaagcataagccgacaatgcttacaacagatctttctttaagatttgatcctgtttacgaaaaaatttcaagacatttctatgaaaatcctgatgcgtttgctgatgcgttcgcaagggcatggttcaagcttacccacagagacatgggaccacgcgcccgttatctggggccggatgttccacaggaagagcttatctggcaggatcctattcctaaagtagatcacgaactgattgatgaaaatgatgcagaagcattaaaatcaaaaatattgaactccggattaagtatttccgagctggtttcaacagcgtgggcttccgcttctactttcagaggaagcgacaaacgtggtggtgccaacggagccagaatcagacttgaacctcagagaaactgggaagtcaacaatccttcacaattgaataaagtattaggtgttctggaaggaattcaaaaagagtttaacgactctcaaagcggaggtaagaaaatatcattggcagatctcattgttttagctggtaatgctgctgttgaagtggcggcaagaaacgcagatcaggatgtgaaagttccttttgcacccggaagaatggatgctttgcaggagcagacagatgtagaatctattggatatctggaacctgcagctgatggattccgtaattatctgaaaagaaaatataccgtatctacagaatccttactgattgataaagcacaattactgactcttactgcgccggaactcactgtattgattggaggaatgcgtgcattggatacgaactttgacggttcaaaacatggtatcttcacaaaccgtccgggtgttcttaccaatgatttcttcgtaaatcttttagatatgagtactcagtggaaagcaatgtcagatgataaagaattatatataggaagtgatcgttcaaccggccaaccgaaatggaccgcaactcgtgccgatcttgtctttggatccaattctgaattaagagctgttgctgaggtatacggaagctccgatgcacaaagcaaatttgtcaaagattttgtagctgcatggacgaaggtgatgaatctggataggtttgatctatagaaaataattttttagataataggatcggctgcccgaagggcagccgatttttgatttatcagtattaataaggttttgttggttttacaaaatattgtagggtattgctgttttaaagaaagttaataagttatcctttgggtaaactttaaaagttttaattttgtgagcattaaaaacataaccataaaataataattacactcggcaatttgtgtatttctatatatacaataaatcaatcaacatttacttaacattaataacacaagtatcaaaaaaatctacatgtgctaaaccaggtcactacaatagttgacggacaaccgatcacaatctcaagctgatattttacaagaattaagaatagtaacaaatgttcgaagtgctggtgtcaaaaaaaaaattaattatgccacaatatatagattcatattatcttgttgatactagaaaattagaaattgtttatgattttttttcaaagtattttccattgggagtagaggacttagctatagattatccatttcctgaattttctgattcgccagaaaaaatttttcactcagtaagagaactattattgcatctggaagataacttaggatatgagtatacaatctattttgataatatagataaatcagcaacaattaagcaaataatattacaatatactgatgatggaaaaataatttttggagtatctattattggaaatgatccatcgttaattcaacagattgaaattataaaggaaattaaaaattatttaaattcgaaggatgcttgtgctacagttgaagaaattcctcctataaattcaagtgaatttgttgaattttgtgatgaaaggtatagaatatagtttaatttgtaaagtttatttagaaggtgatattgcagttaagcacccaataattggtttaattttcctgaaaaacttgaatttgatgaatcattaactttggattacaaataaaaacaggagaaacgataattatagtcattctcctgttatgtagacccacagggattcgaaccccagatgactgaaccaaaatcagtagtgttaccgctacaccatgggtctgtttctatgccgcgaaattatagaatttattttaaatatgaaaatcaaaattaaagattcattaacataattagtaagatgacagctttatgtactgatatccaaagaattatttttttaataaattttagaaaaaaaactgtttctatccataaacattagatttgtggatattacttgctcaatttgatgagtaggttttacattaatttattcgaggaataataacttcccgcttccttcttccagctcccatccttcaaaattcagttaaataataaaaccttatctttgcaaaaaaattgggctccaaaagttggagtaacccattaataacatatcctgagcacagcaaaggagtattaaacatttttttatgtcaaacattgttgcaatcgttggacgtcccaacgtaggaaaatccacgctttttaaccgtttattagaaagaagagaagctattgtagattctacagccggtgttaccagagaccgtcactacggaaaatcagactggaacggagtagactttaccgtaattgataccggagggtatgatgtaggtacagatgatatcttcgaagaagaaatccgtaagcaggtacagctagcagtagatgaagccacttctattatctttatgatgaacgtagaggaagggcttactgatacggatcacgaaatttacaggcttcttagaagatccaacaaaccgatttatattgttatcaataaagtggattctgcgaaggaagaacttcctgctactgaattttatcagttaggaatcgataaatactatacactttcttcagccacaggttccggaacaggagatctgctggatgatatcgttagagacttcccgaccacagaatataaagacccatttgaagggcttcctaaaattaccattgcaggccgtccgaatgtagggaaatctaccttgacaaacgctttattggatgttgaaagaaatatcgtaactgatattgcaggaactacaagagacagtatccagactttgtacaacaaattcggacacgagtttgtattggtggatacagcagggatgagaagaaagtctaaggtaaacgaagaccttgaattctattccgttatgagatctatccgttctatcgaatattctgatgtagtgatcattatggtagatgctacacaaggatgggaatcccaggatatgaacatcttcggactggctcagaaaaacagaaaaggaatcgtaatccttgttaataaatgggatttgatcgaagacaagcagaccaatacaatgcgtgatttcgaaaaatcaatcaaagataaaatcggccagttccaggatattccaatcttatttgtttcagccttaacaaagcaaagaattctaaaagctgtagaagtagctatgcaggtttatgaagatcgtaagaagaaaattaaaacttcaaaactgaatgaagtaatgcttccgatttttgaaaatacaccgccgccggctttaaaaggaaaatatattaaaatcaaatattgtgttcagcttcctacaccgtcaccgcagtttgtatttttctgcaaccttccgcaatatgtgaaagaaccatataaaagatttactgaaaatcagctgagaaaagaattcgggtttaccggagttccgattgaagtatatttcagacaaaaataataagaacaaatattataaaaactccggcaagcgaagcttgccggagtttttgtttcaaataaattttcatttcaggcttttcaaggcagccacttttcatatacaagtcttacagggcggtaaccctgtgaaacaagccaccgctgcattgtatcattattgcataatgtataacggtaaattttccggattttatagtttgcatacctttcttcaaattccttattgagggcagaatagattccccgttttctgaactctttttttacatatccttctgaaacgtacagatcatctccttccccaagctcaaaattactgtcatctttctcttcaagataaccgaaaagaaaacctattgccttcccatcggcttcagcaataagaaaagtaccatcattttcttcctcacatgttgacataaaccggagataactttctctgatctggctccagtcagcggtgttgttattcatttctttttctgaaatatggagttcacctaccagttcatcaacaacaggaaggttttctgcgatttttatttttctgatggaataattcataatgatgttttgtttacgtgttggaatccggaagaggaaaattggaaatttgtattgtttaatattaaaccctcgccattaattaataaaacagatttaattagaaaaacactcattcctattctgaacctgaattacttccatcttccggccttatgcttccagttttatcactttcctctcaacggactgccataccaggacgtattatccgaaagcacttctcctttcataaccagggaaagaggatcaatattaacattgtttccgatttcactgtcatatagaataattgttcttgaattgattgtggtctgctttccgatttttacactacctattttcataatcctgtcttcaaaaaggtgtgtttgaggaccacagtcttcattcagcatggtttcatccccaatagaaaccatatcgaattctgtaatatcagttgtattgagccatactctttttccaattttcacccccagaaatctcataaagaacggcagccagaaagtcccgcgcagaaaatcaaggaaaaactgtaccggaagggcttcatagattgttgtaattccttcactcagccataccttcatactgtacatcggcatttcagtttttttataccttcctacaaaaatccatttcagcagtacggtgaagaaaaaagaaggcaaagcaacaattcccagataataaaacggagacagtaagataagataatgaatgtttccttccagataagtacttgtataggcaatgaaaagtacgctgcagataatcaccacagtctgtgggagaataattctgattccttcaaccacagctcttgcaagcttaagtttaaatgatggattataggtaaggttattctgaaaagcatcagatttctgtctggatggcagaccaatcggaggagaaccaaaccagtctttttcatttgaattttgcagttgttcttcagatggagctttgctcaatactccgatcagcatattatctttcagttcatatccctgtggaatcagtccgctgtttcctacaaagctgttatttcctattttggttttcgataaaattaatttctcattccttacatcatgctctcccaaaatgactgcatctgcaataaatgagccttccccgatttctaaaagatgatgggaaacatcactggctgtcgagatttctgaattctttcccacttttgcgcccatcattttatagaatttactgatatagatagaggcaaaaagcggatgtacaataacgagggagagattaaaaatctggtcctttatccattttttataatacataaaactgtataccggatagatgccaggtttcatattatactgtaaaatcctggtcaggatacttaccactccgataaacaataaaatataaacggtagaaagaatcggagcctgccacagataatagaaactataatcagctgaacgctcgtccagataatacagagtataaagtgtgggggctaaaggtaaaacaataagaagaggaaagaaaaacaatgaacaggcatacagtaaagcaaaacggtttctttttctcgcagaagccagcgtaggtgcttcaatttcttcaccggattttactcttaccttttcagccggactgccgttccatacttctccaaatcctatttttcctccttcattaagacagcttaaatcctgaagttccccgaattcctcaataacggtatctccgcatacaatcacggaagatccaagataagcgtgcgctttgatatgtacttttctgatctttaaaatcccattctctacagaagcattgtcaatactgcagccggagctggtattcacatttttatctatcgttacaagatcttcggcagcgataggaaggaggcttaactgagcgctcggatctacttttactccaagaagcctcaggtatttcggatataacggtgtttctacaataaattctgaaggcatcagtcgcttaatcgttttccaaagccaccacctgaaataataccatccccaaagcggataatctccttcttttatttttccgattaccagccattttgtaagaacaataatgattgaatatacaggtggaatcaatgtataaagtaaaacagcactcagtaaagcataatgtaatccgtacccgttaatctggaaataataatagctcagataagggaaaaagatctgaatacttaataaagcaaatacaaccagcagactgatcgtctgggcaagattacaggcaatatactgcaaggttgaaaccctgtgaaacggttcctggcgggatgtcgcctgagtatgcttgtttttgagaaactcagaataaactgacaaaggacggttttcataaatctctttcagtgatgcagtaggaatacctgctttttgacgaagatgggaaactaatgttgccgccagcaaggaatgtccaccaagatcagtgaaaaaatcctgggtgagattgatttcttttcccggaaatacccatttcagtgtctggataagtttttcttctatcggagcttcagaatcaatgttgatttcttcgtttttctgatgaaccgtgaaactttcaggaagaggaagccgttttctgtcgattttaccacttggcattcttggcatttctttcatcagaacaatagagatcggaaccatgtaaggagccaggaattttgcaagttctttacgcatttcattttcatcgaaagaagattcgttgctcatgacggcatatcccacaagttgtccctgtccatttgaatcttcttttacggctacagcagctgaagaaacatcatgcagctgattgagccgtgattctatctcgccaagctcaattctgtatccgcgtaatttgatctggtcatcaattcttccctgaaaatcaataaatccatcttcgcgtatgataacagcatccccggttttgtatattctgtctccgggaagatcttcaggaaatggattggctaaaaacttctgttcagtaagttcaggaagattaaaatatccgttgcttactccaggcccggaaatgaccatctcaccacgttctccccgtggaacaatattcatgttttcgtcaaccacagcaatatgataattgggaagaggaagaccaatggtcagttcctgttgtccattcagttcagtcatattggatgaaactgttgtttctgtaggtccgtagctgttgatgaatactctatagggcttggcccatttttcctgtacctgttttgtacatgcttcccctccggtattgatgaacctgacagcaggaacttcgtcgataatggccagaatactgggaactgcatgaaggacggtaattttatttttggttaaaacatcgctaagctcatcgatcgcttttacagtggtggcgtcagcgatccatatggtggctcctgcaaaaagactgatccacacttcttcacaccacatatcaaaagaaacagaaaatccctgatatacgatatccgtatccctgatttttataaaatcctgctcagagcggattaaatgacaaatgttccggtgggatatcggaattccctttgggtttcctgtgcttcctgaggtaaacaatacataagcccagttgtctggtgtataattgggaacaggtgcaggaaccggatgttgaggttgtggtgcaatatctaaaggcttacaatgaatatgagcatccgtgtcagaaaaataagttttgacattaatatctgtaaaaaccttttttatcctgtcttcgggcatttcacggtctaatggaatgtaagcggcaccggctttaagaattccaagtatggctacaggaagttcaaggcttctcggataccatactccgacacggtcgcccggctgtactccatgatcttgcagttgaagcgcaatggcattactccagctgtccaattcagcataggatatttttttatctttaaatataaaggctgttttgtctttatatttctcaaaggtgggaaccaataattcaggcagaatttcatctttgataaactctgggctgatctttcctaaaatcaggcttttcatcatttaaaatttactaaatagggtacttgggatgttttaataaatatacatatttctcacaatctttcaattcgttttttagttgtaattttgcaggaattaattcaatcaactgaaattaaaaatataattttcatgcttactattttatcgcaacttttttctcttgtcaacgaatggatcaacgaacttagaaacgttaatatccagcatgaccggatgagattcagaaggaatatggagagaatcggggagattgccgcttttgaaatcagtaaaggactggagtacagggaaattgaaattcaaactcctttagatacaataaaaagcagggaaattgctgtacagcctgttattacaactattttaagagctggtgttccgttatttgaaggaatccttaactatctggacagagcagactgtggttttgtggcagcttacagaaaacatgatgccaacgattatttctcaatcaagcaggattatcttacttgtccaagcattgaaaacagacctttgatcgttgcagatccaatgctggcaacaggcgcctctttaattgaagccatcaaagatttgctgactcacggaaatccaacccagcttcacattgtagccgctattgcttcaaggcaaggtgttgagactattcagaatgcctatcctgaggctcagatctgggtaggagctattgatgagcatttaacctctaaaggatatatcactccgggactgggggatgccggggatttgagctacggagaaaaacttcagcgataattttaagaaagattccagaaatctttcattaagtttaacaataaatcaggccgtactttatccataggatgtttggtatccggaagtacggctaattttgcatcaggaagacttcggtaaatatgggcgctttcctcgatagtcaccatattgtctttatctcccaccatgacctgagccgggatatttatcgtagcaaaattattttccaaaggaggatttttacccagatcaatcattagtttagcaatagccggaagaagtgctttccattttgctccatgttgtgattccaaaagccgggcatactgagggattttctcaagaatgacatcaggattaagcattttgctttcctttaaagcctgttcttcagtccaggcaaacttagttcccagagtcataacagaatttatattttccggatttttcatagcatagcaaagagccacatatcctcccatgctatgcccgaaaatggatacatccgccagattatttacttcacaatactccgaaagctcctgagtgtacttttcaatactaataccttctgccggtaattctctatttccatgacctgaaaataaaggggtatgtactgtaaaatactgagaaagcacgttcagataaggcgcgaaaatatcgctgtgtcccagggctccgtgtaataaaagcagatttggcatagctatttaattttctgaaaattagcgaaaagaattgaatggtgaaaatggattaagcagaagtgtgagagggtttgagagttggagagcttggaaatatttttgaatataactcgtatcccgaacctcgtattaaacatcctcagccatcaccaaaacacttaccttattgtctccggcatttagaatctcccatgcaaccgatgaaactgtattgcctgtggtgaaaacatcatcaatcagaaggatatgctttccggtaacaggccgggtgatggagaaagtattgtctgtttccaatctgtgcttcttgtctttcaaagcctgtgctttggagtaatgatttctcctgattaattcatgatcaaaaggaatgtgataaaatttagacaaagtttcagtatataaatgaagctgattgtaaccacgttccttcagtttttttggatgaagcggtacacttaccaaaagatcaggattgtcgtcttggaaatccaggcgctccgttgtccagtctgccagaattttccctgttttttcgcggcttctgtattttagttcatgaataatcttgcggcttaagccttcctcctcgaaccgtatcaatccaaatgcattctcaacaggaaaaaataaactgcatttttccttaatcggattatttttaaaataattgtaatgggtaaaataaatctggctgaaacaaagatcacaaaccagaatctcaggaacaatgatcctgttgcagtgaaggcaacggttaggaaataataaatctaatatcatagtgtgtttttactaagatataaaattaatgtcaatttttgcttcgcaaagtcaatagtgaattattattgttcacgaattttatgagctaattattttatttagcatgaggcattttcgtggctgagtggaacgccatagcgaccgaaaagctattaaatagtatagaaaacttcgttaactccgcgtttagaaaaataacttatccgtgaatttcaacagcaaatctattattcataaaccttaatctcgcattccgaacttcgtataaaaattcacaagtgaagcgcattgacgattcactatttatctattaattctcaaatttcctcctgattttctccacagaactcttcatactcatgttaaaatgttccttttccagccttaccggcggcgcttgtcttacttcgcagtcagcaatactgcaggattcacaggtaacccctacattgatggtttttaaagaaggagacttgataaaacctatttttttgatcgtttgggaattcagtaaaatgccgaggcaatagcttctgttgcttccatctgaaaaagggtttctttgtgaagtggaaatcaccagatagcttattccctggtctttataatgagaaatctgggcgtcagttaaagtttcattttcctttaaatgatcaagatttttcacagcaatccatcttctgcagtaatgctcattggtggcattggcgtgaggagcctgctgatggttgagatgaagctcctttaaaatctggattttatcagaatttttcttttttaccaggcataaataaaataggtctttaatacccatttcagccgaaagaatattcgttagccggtaatagaatgtttcaggagaatgggtgaagctgttaatgagattttcaaaattttccggttcccatttattttgctggaaaaattcagaggctttttcgatgacaggttgttttgaaattaataaagctccggcaaaataagacgcataaaaattattcagaatttcttcaaaactcccgaaatcaagccatgaatatgtgttgggacggttttttaactccagcacattgaaaccgatttccttagcaaggataaatgttttctgatccttttccagtttatgattcagcagtaaaagttttttctcaggaataaaaagtgagcgcagattatccaaagtgccatatttttcaaaatcttcagattgaatcttgtaaccaaacttttctccaagaattttttccagaatgtctgactttaaatttttcccggcctgtaacttgttttccttcgtgaataagcttaccttttcttcaatttccgggaaataattgtcgtacaattcctgaaacgatcttaaaacggcaaagtaaaaccgttcttttccaagattataattctgtgaaatttcaatcagtgcattgataaaagcagttacttttttgggggcatcactgatgatactgatgagattatttttgttgattccgaatagttccaacggaacttccttaaagaaatcagattgcagaatttcattgaaaggagccaggcttttatcaagtttggtagaaaccagatcgtcaaatgtgcagctcagcgcttcagaaagctggatgatcttgtcatgctttggatattttttaccattctcaatttcattaagataagattttgataatcctgtctttacggcaaggtcctgtagagaccagtttcttttctgcctctgctgtttcagttttagtccgaaaactgttttgataaagtcgctttctgaattcattactcaaatataaataaatagatgcgattattcgcataataatttttaaataaatttagcgaacgttcgctatttgtgaaaatttttgtttatgtttgtaacatcaaatcacaaaatcaataagttatggaaaccaagactcagttagaaataaaggctcagaagcagtttgaagcagtttttactccggatctggtagattttctgattgtgcttcatcagaatttcaatcataaaagattagagcttttagaagaaagaaaaaaaacacagcagaaatttgataacggtaaccttcctgaatttttaaaagagacagaagctatccgaaacggaaactgggtgtgtgcaccgctgccggaagatttgcaggacaggagagtagaaattaccggacctgttgatcgtaagatgattattaatgccttgaattccggagcgtctacctttatggctgactttgaagatagcagctcgccggtgtgggaaaactgcattcagggacagattaatctttctgatgccattaacagaaccattgattttgtcaacgaaaaaggaaaagcatatacccttaatgacagaactgctgttttgcaggttcgtccccgcggccttcatcttccggaaaaacatattgaaattaatggagagaaagcttccggctccctgattgattttggaatctatttcttcagaaatgcaaaagtgcttttagaaaatggaagcggtccttatttctatctgccgaaactggaacattataaagaagcccgctggtggaatgatgtttttgtttttgcccaaaattatttggggattcaggaaggaacaatcaaggctacggttttaatagaaaccattaccgcatcatttcagattgatgaaattttatttgaattaaaagaacacagcgccggccttaattgtggcagatgggattatattttctcctatatcaaaaagttcagaaacctgccggaatttatcgttccggacagagatcaggtgaccatgacttcacctttcatgagtgcctattcaaaaagagtcattgaagtctgtcacaaaagaaacgtacacgcaatcggtggaatggccgctcaaattcctgtaaaagatgatgaagaagcaaacaaaaaggcttttgaaaaagtaaaaagtgataaggaaagagaagtgaaaaacggtcatgacggcacatgggtggcacaccctgcattagttgctgtggctaaagaagtttttgaccaatatatgccttccagaaatcagattgataaaaaatttgaatatcatattacagaaagcaatctgctggaaattcccaaaggtgatattaccgaaaaaggagtccggaaaaatatcaatgtaggaattctttaccttgaaagctggctgatgggaaccggtgctgccgccatttacaatctgatggaagatgcggctactgcagagatttcaagaacgcagatctggcaatggctgaaaaatgaagcggtgttaagtgacgacagaacattgacccgaaatatggttctgcagtgggaaaaagaagaaatggacaatattgaaaagtatgtaggagaaacccgttttcagaatggaaaattcaatcttgccaaagaacttttcaatgagttgattttctgtgaaaagtttgaagaatttctgactcttaaagcatatccttttatctagtttgagaataatatcccgaaccccaaaatctaatcaaacaaaatccaaatattatgaaaacaagacaagaacaaatccaggctattgagcaagattggctgacaaatccacgctggaacggtatcaaaagaccgtatacagcagaagaagttctgaaacttcgcggttcttataccatagattatacaatagcgacagaaatgtcaaaaaaattctggaataaactaaatagccaggactatgtggcagggcttggtgcattaaccggtaatcaggcagtgcaggaagtagatgccggactggaagcaatatatctttcaggatggcaggtagcggcagatgctaacttatcaggggaaatgtacccggatcaatcactatacccggctaattcagtacctgctgtagtaaagaaaattaataatgctctgttaagggcagatcaggtacagtctgtaaacggaaacggtaataaagaatatttagtgcccatcattgcagatgcagaagcaggttttggaggtaatctgaatgcttttgagctgatgaaacaaatgattgaagcgggagccgctgctgtacattttgaagaccagctttcctctgcaaaaaaatgcggacacttaggtggaaaagtactggttcctactcaggaagctgtcaataaactgattgcagcgcgcctggctgccgatgtattgggagttccaagccttattattgcaagaacagatgctgacgctgcagatttactgacgtcagatattgatgacagagataaaaaattcgtaacaggagaaagaacttcagaaggattttatgttgtaagaaacggagtagaacagggaatcgacagaggtttgtcttatgccccttacgcagacctgatctggatggaaacgtccaatcctgatctggaacaggcaaaaagatttgcagaaggaattcatgcgaaattccctggaaagatgcttgcttataattgttctccttcctttaactgggcagcaaagctgagtgtggaggaaatgtctaccttccgtgaagagctggcaaaaatgggatataaattccagtttattactctggcaggattccatgctttgaatactgcgatgtttgaactggctctggcttataaagaaagaggaatggcaggatattcagaacttcaggaacgggagtttgccttacagcagaaaggattcagagcggtgaaacatcagtcttttgtaggaaccggatatttcgatgaagtacagaatattgttacaaacggctcttcagctacagttgcgatgaaggattctacagaaactgcacaattccattagtcatttttttccatatttttttgatgttaaaccttctctgttttgggaaggtttttctgcattatacataatcaaaaattgagttatatttggggacgaaaaaattattaaaaatgaatttaatcaaagtactttttattacattaggattaacacttactgcaaatgctgcaaaagcccaacaaaaaattggaagcgtgaatactgatgacatttttgcaagtttacccgaagtaaaaacaataagtgcaactgtggataacctgacaaaaacaaagcagactgaaattgaaaaactgatcggagattatcagactaagctgaaagcagcacaggataaagaaaaaactcttagcgaagccaacaaagaagcagtcactaaagaattgatcgctgcacaaactgaattacaggggcttggtaaaaagatagaagattcgagagctcaggctgctaaagatatttctgcaaaacaaaacgaattgtttacgccattgcagcaaaaagtaaaagaggctattgctgctgccgctaaagaaagaggcatcaattatgtttttgatattgcatctcaggaaaccaataaccttgtttacaacgacggaagtgaagatatcacagcgcttgtgaaaagtaaactgggagcttccgcaacaaccgccaagccaacagggaaatctaaataagaatttatatactgaatatagaaacggaatcagcagagctggttccgttttttatatgtaaaagtgtgagaaagttcagttttaaaataataaatttgagtaaactttcaggagaatgaatttaatgtacgaaaaacagataaaggtaactaaggatcatatcgaccagaataatcatgttaataatgtacagtatgtgcactgggtagaagaagcagctgcagagcactgggatctgttaaaacataaaacagaatatgcaaatgatgtctggatgcttctggatcaccatatccaatataaaaaacaggtttatctgaatgatgtcattacagtaagaacctatcctctggcccctgaaggagccaaacagccgagaaaagtagaattttactgcaatgatgagcttgtggtagattcaaggaccctttggattctgtttgatcctgaaacccaaaagataaaacgtcttgaaagcgactggctggagaagtttttcaattagaataagatgtgaagtaaaacgattttaatttgttaaaatggaatttgagtataaaaagaataaaattttaggcaatttgatactggggtatttttatctatgttttactatctttattactgttatgattctacgtaacattagccgggagtggaatacgctttcattatcaaaaatattttcctctattattccggtttttttgttttcttttcttacttatctctttttaggaacggctctgatcagaagaaagtattacctgcagaacttaaaagaagaagctaaaattgatcctttagaaaagcaaattatcgtattggataaacagagcagaaaaggaagaagaatagatttcaataaggttaaggctgttgaattgtattattcatggaattcaaacgccttttcatcagatctgggatattctaaaattgtgcttggggatcatgctaaacctgttttgattactcagaataatattaatcaatactatatttataaagcttttaagaataaagtaactgtaaacaagtcaagatttgcaaataatttataaagaaatagagtggagtcaatttcttatgctgctggctttaaatttgtaactaacgaagattaattgtcaatcaaaaattaaaaacacatgaagcttttatatttccttacattgttgttaagcattgcaagctatggtcaggaaaacccttactggtttacagatgatattaaaaagaaagtggcagattctacccaaagtcaatcctggcgaagtcagatggcagcaacgtattactcaataagcggacaatataaacctgcactggaaagttgggacacgacttttggaagagtaaagaagctgagcaaggcagatagtctgagatttacagaattaatccccgtcaatgcaaaagattatcttttaaaaaaagcagagagtgagcagattattatcattaatgaagcccatcataacgcgagtcacagaacttttgtatcctccttacttcagggattatatgataaaggttatcggtatctgggactcgaaacattagtgagtgactctgtaaacgttacaaaatttgctgttcttagcagtggatattactccaaagaaccggaattcggaaaccttatttacaatgctttgaaaattggattcaggcttttcccatatgaagcggaaggaaacaataaagaaagagaaattggagaggcgaaaaatatttttgattttatgcagaaaaataaagaggggaaatatctgatctattgcggttatgaacacgcttatgaagggactcataaatcctgggagaaaacaatggcgggaagactatccgatcttaccgggatcaatccgtttactgttgaccagactcagttttcagaaaaaagtaacctgaagtataatgagccgcttttaagattggtaaataataatgttcctgttgttttaaaagatcaaaatgaagaaatatataacgatagtgacaaaaaactttataccgatattaaaatcatccatcctgttacaaaatacatcaaaggcaggccagattggatgcttggagaaaaccgtaaactgtataaaattccggtttctaaaatttcaacatatccggttatggtttttgcttacagaaaaggagaatatgagcaaaatggaattccggctgatatccttgaacttaaaactcccaaagagagccgttttttaatactggataaaggcaattatgatattgttataaaggataaagaatataaagtccttcaaagattcggaaaaaaaataaaataataattaacattaatgatcagtccaaataatatttaaaatcgctgcaatagaaacagtcttttctgtgttaagcggttttgtcatatctttgcagtatgatacgtattacaaaaatttttacattcgaaacggctcacgtactttacaactacgatgggaagtgtaaaaatatgcatggacattcctataagctgtttgtgacagtgaaaggaaaaccgattaatgatattgataaccctaaaaacgggatggtagttgatttcggagatatcaagagtatcgtaaaatctgagatcgtagatgtatgggaccatgcggttcttgtcaatgcactttctccacacaaagaattgggagatgatctggagcagaaaggacataaagtcatctattgcagtttccagccaacctgtgagaatatgttgtacgcgatcgccgctaaaatcaaatcaaaacttcctgaaggaatttctttagcttatcttaaacttcatgagacggaaaactcttatggagaatggtttgctgaagataatcaataatttatccacaaaactcagaaggtgttaaaaacaacaattaacttagaacctggaaaaaaagtatatttcgcttcagatcagcattttggtgctcctacgccaaaggaaagtaagttgcgcgaggagcggtttatacgctggatggacgagatcaaagaagatgctcaggttttatttttaatgggtgacctttttgatttctggcatgaatggaaacatgtcattcctaaaggatatgtccgtgttctgggtaaaattgcggaacttaaagacagaggaattcatatttatttctttgtcgggaatcatgatctgtggatgaaagattatctggaagaagagattggctgtacggtattctatcagaaacaatattttgaaatgggaggaaagcagtttctgctggctcatggagatggtctgggaccaggtgataaaggatataaaagaatgaagaagttattcacgaatcccgtagcacaatggtttttcaaatggcttcatcctgatattgcgatgaagatcgcattatacctttcccaaaaaaataaaatgatctccggagaagaagacaaagcatttcttggagaagataaagagtttctgattatttattccaaagaaaagctgaagacgcagaagattgattactttatctacggacacagacatctgcctatggtgctggatctggaaccgggtgcaaaatatatcaatctcggagactggatttcctattttacctatggagtatttgaaaaggattttgaactgaaaacttttgaaaaataaaacaaaaaaattacctctaaaaagaggtaactttcgaacgggtggaaaacccactcttgtttttaatccatattccggataaatgattgcaataagtttaccaaaataggttttctacattaaaaaattattaaataaaaatactgtatcgctgtaattactttgtagtaagggattaagaaattcaaattatggaactgaaaaaaatattcaacataaaaacggaacaggatttcctgaatgcatcattgaaaacatttcgttatcaatatgaaaatgttgaaatatacaggaaattcgttgactttctgaatgtgaatcccgatgaggtagacagcctggcaaaaattccgtttttacctatcgaaatgtttaaaaaccatcagattcttgataaaaacgtagcagcagatctgtattttcaaagttcaggaaccacacagatgaatctttccagacatttcattgcagatccggaattatatgaagaaagtatttataaaagctttgaacaatttataggaaagccggaagattttattttccttggcttgctgccaagttatcttgaaaaacagcattcatcactgatctacatggtagactatctgatgaaaaaatcaggtaagccggaaaacggatacttcctttataaccatgctgaactttttgatctgttgcataagcttcaggataaaaaggtcattcttttcggagtttcctttgccttattagactttctggattattgtcatgctgagcaaagcgaagaatctttcaattttcctgaaaatctgatagtgatcgaaaccggaggaatgaaaggcagaaaagaagaaatgacaaaagatgaattgctgaagatcttacaaaaaggccttaaaacagataaaatatactctgaatattccatgacggaactgctttcacaagcatattcccttgggaataacgagtatgagtgcccaaactggatgaggatcatggttaggaatgcggaagatcctttagcttatgaaaaagaaggaagaacaggagctattaatataattgaccttgccaatatccattcctgttcatttattgcaacgcaagatctgggaaaaataaccggagataaatttcaggtattaggaagaatagaccattctgatatcagaggctgtagtctgctcgtaagctgaaatgctgaacaggcaatggtgaatagtcaatttgcttcgcttgtcaatttttgtataatgataacaaatataaatagcttataactttgctgagtgaaacgcctttgcaaatatttttagggagttggtaaattaaaagctttgtgaacattgcgtttacaatatttgctgcattatcattaatacattttaccttgtacattttacagtcataacaatgatcaaaatagaagaactcatacacgcgtacattcattcccactgcgattttgaaaaagagattgtactgacgaattattttcaggcagattgggaagctgatatcctgatcattgatgcagaaggcggcagtcacgaaattgaaatcaaactttcaaaaagtgattttaaaaatgatttcaaaaaatcatacctgaataaagataccggcgaaaaatttctgaaacatgataaaatttcctgcggagattatatgtgtaattcttttagctttctgctaccgatgggaatggtagatgctgaacttattccggaacattgcggaattattgaattctatcataatgtggacacatgggaaactgagttttacccgatccgccaacccagaaaactccatgaagattcttactggaaactgaatgataaagatcttttcatcagaaaaatggccctgaatcttcttcagcgcaaaatggaaatcaaaggaaagcatgaagaactgatctttaaaaatccttttgaaatcaaaaagctgaaataagataaaaaaaatttttttaacgcaaagtttaatttcttattgatatgtcttaaggatgcaaaaaaggaatcaatttcattgattcttattaagcaaacattacaattagcttcatcagcgacgtagtcgtagccactttgctgccttgaataaaagctctccttcataaaaactttgcgtttacaaagaatttaaaaacaatttattcaaaatcaaaaataataaaaatcctgccgcctgacaggattttatcattgaatgttatttaaaattaatctgtaatttcagctgtgtctctctgaagtaggaacttataaatcaatcctcctacaactcctcccaaaataggggcaacccagaacagccaaagctgcgacatggcaattcctcccacaaaaactgcctgagaaagtgatctcgcagggttcacagaagtattcgtgatcgggatggaaatcaggtggatcaaagtaagagcaagaccaatggcaagaccggcaaatttaccgttagcccatttgtctgtagcgcccataatcacaataaggaaaaatgctgttaataaaaactcagccaggaaagctgcccccatgctaaaagcttttccattgtaaacagcctcaccgtaaaagttcgtggcgaaatctccgggtttcgagaattctaccgctccggctccgttaaggatcgtatacagacatcctgctgctacaatcgctcccagacattgtgctacaatgtaaggaataagatcttttgccggaaatcttccacctgctaaaagtccgaaagaaacagccgggttaaaatgtcctcctgagatatgtcctacagcgtaagccatggttagaacagtaagaccgaaggctaaagcaactcctaaaagtccgatgccaatatctggaacaccggctgcaaaaacagcgcttccacaacctccgaaaacaagccaaaatgtgccgaaaaattcagcgaaaagtttttttatcatattgtttattgtttaaagtatctcaaatgtaaaatttaaatcttaaagtaaaaagataaatctgaaaaaatatttcaaaaaagagagaacaaaaattacaaaatctgtaatttggtgtaaagtttgtttgggatttatttagagagtattatagtcggttttgaaagatataacataaatgttttatctttcatttgtaattttaaaggttggtgaatgagaaagtttttatgtgtggtctttgtaccttttatttatagtttacattattcccaggcagcaaaaaaagcttttccctgctatgatcttgccactgtattgaaggttgaacctacaccactttataaatctcacctcgatgcttctaagagttttgggctaaagctgctgaaagactccaaaacagtacagaaatacatcaatagcggtaaattccacaaaataaaaaagtcaggaaaagggtaccaggttcagagacttgattacagcaggccctatatggtaaccaaagcaaaaaccaccctggaaaaaataggatctaagttcagtaaggatacaaaaggcggtacatttactgtttcctcaattaccaggactcttgaagaccaatgcaggttgagaagagtgaattccaatgcctcacttgggattagttctcacaattacggcaattcctttgatatttcttacataagattcaacaacgttctgaagtacaatccaaaaatggaaatagcgctggagaaagttttaaaatattatgaaaaggctggtagaatatattatattaaagagaaacagcagagctgttatcatattactgtgaaaaattattaatcaaaaccctcttgcatagcatctttagtttatctatttttatacgactaaaaactatgcttatgtcaacattaaacattgtagattatatgctgcctgtagaagaatgcagagcagcatcaaatgagtggaaagcatccttttctgacttttcaaaacttcaaaaacttattcctaccaattacgtatttaatatttccagagaccaccttgagtggatgaaggggttcagtgattataaagacttttgtgcggcagtcggaatttacagagatcgtttgatccttattttttatcctatgaataacgatggcgggaaaatagatctgaaagaatatccgtacagtttccttactgagcttgacagagacctgaaattacaggaaattcaggaatatacggttatcagaaatgcagttctttctaaaaatctcgaaagcactgagaaaaatatgaacatgggattcccggtaaccagtacgccgattcttgagcaggatatagctgtagaagcaattcaacgttggagaaacgaaggaatggactggttttataaagagagcagagaaaacgaaggaagcggaatcttcagaaaattctatgttccaacagcagacctttgcctttcagatgaaggactggcaggaattacctgttctttcgggatcagatacaatgatatttatgggaagatgctcgtaacgcttatatttatctcttttcgtgaaaaccttagaaatgcagaactgggtgtagataccatctccaatacctatgactgggccaagccatgtccgccaatctgccgtataccggatgtagatgtaggttgcgaattttaaatgatacgctgaggaatggctgaactttataagacaattttattcctgaattatgcactgcttctgtctgttatactgctgggagcagcaaaataccgcatattaactactaaagaaaagcagtattatcattatgctgtttttcttttttttattgagctgctgaatctggcgctgccttatatcttcagtcttaatgatacctcattcctctatcctttatatatcgcaggagaattttttctactggccggcttatttgttagaaagctggattggccaaaatcttttttgggtcttgttggtatactcgcggcaggctttatgatctcaaaatacggattcgattaccctgcaaatgctgatattgcaaaagtagtttccaatatcatgatcatctgtctttccggttttaccctgatccgggaaattaaaaatacgtctttacagaaccgttttcttcttgcagatgccagtatttttttctactattccgtttcggtatttatttttatcatccagcaccagatcgccaacctgtcagaaaacgattattatactattctcagtgccaataatattctttcgagtattttgtactgttcatttttatatacttttttcagattaaagaagtaaccttaaatatcaacctgctgatccttataattgttaccataacagttatagtatcctttattctgctggcttacagaacctttataaccagaataatgaaggaaaagaatgcacagcatgaggcggaagttcttcaccagaaaaaactggttctggaaaacattaaagctcaggaagaagaaagaaaaagaattgcagtcatgattcatgatgatatcggaaaccgtctcaatattctttctttatggctgaataaccttgacacacaaggcgatgagcagatcaaaaaaaatatctatggccagatgtcatcactgattgatgctgccagaagtatttcccattcattatatcccgttaatctggaatcggtagggctggttttatatgtagaagaactgattgcaaatctttcccataaaattaatatctcattgcaggtaatgccgggatatgagaagaaagacctttttgcagaagtacagctgtacaggattattcaggagtttactaccaatgtgatcaaacactcggatgcaacggatctttggatttacattaaagattatccggaaaatacagcagtggtcatttctgataacggacaggggtttgaatatgaagaagtgaaaaaaggaatgggaatcaaaaatatagaatcccgtatcaaatcaatgaatgccacgcacaaatggaaaaaaactttttcgaataaaggaagtcgtttaatcataaaaattccaaaatatcatgagttcccaaatcaaagtagcactgattgatgatgaacagctgatcctcgaaggagtaaaaatgttgctgtccaatgaaaaaaacatatcggtaagtcttaccgctgataatggccccgattttatagaggacctcggaaaactttcaaaagatgattttcctgatattgcccttatagacgttcaaatgaaacctatgaacggctttgagctggtagaaatccttaaggaaaaatatccggaccttaaaattattatactatcttcccattacaaaacctctattctgggctatatggtcaagctgggggtgtccgcatttcttcctaaaaactcaaataaaaaaacttttattgaagccatcacaatggtggataaaaacggggttttctttactgctgaagaccatcagatgctgttcacctatatgaacagttcagccaaaaaaaaatctctttttgaaacagaagatgaactttccgaaagagaaaaagatgttgtaaagctgatctgccaggaattgaccaataacgaaatcggagaaaaactgttcatcagtccaagaactgtggaaagtcacaggcagcgtattctggaaaagataggcgctaaaaatacagtaggaatagtcatctatgccattgtcaacaatatttactcacttgaaaaaatataattggattccgtagaaatacggaattttttatttggtacttttcactctagccagccttgtttttcttctgttattttgaaatgtctctttcagggatcttagtaaaaaaaaacacaaacacgatctgtaataaaaaattaaagtaaagcatgagtggcagcagagtgatttccgtcgggattttctttgacggtacaggaaacaatggggcaaatattctttcagcggataaaccgctgaataataatgaaagctattatggaaccttcaccaatatctataaattatacagtttattcgttggagatgaaaaaatatatattgaaggaattggtaccgtaacaggtaatgaagataataattttgcaatagcaacctgcgcaaatccaccttatggaaacggatattcttcagatgataaacttcagaaagccggggattttgtacaaaatatagttaagaatgatgctgcggaatatcacttttacctatatggattcgggagaggaggaatgctggccagaaccttctgcaatcagcttttgactgattatgcaccggaaaattgcagaataaaatttttaggtgcttttgataccgtagagtccaaaccttttaatacttataatatgagtattgcgcaccgtgtagaaaatgctttgcacatctgtgcggtcaatgagagcaggtttttctttccgcttaccggtttctttgaaaactcaaaagcgatgcaggatcagaaatcacaaaccaggtcatctgtttggaaagaaatctttgtgccgggagaccatgctgatgtaggaggtggatatctggaagggccgcaatctgtatatatttccacagagtttatcaataccgatgatctgcataggtatatttcagaaataagaaatacaaaaacggatacggatggaaataaaatatgggatgcattgctgtcaggatatgaagttgagacagtcaacggacttgcaaaagcttatgtttgccgagatagagtgtataatgagctgtcaaaaatatatggaaagctgatgatggatgaaaccaatacaatatcagctgtgtttagtgccgggaatgaagcttatttcggaacaggctataacaggcattcttttctcgatcggttttatatcaaaatgaaagaatatatcaaagatctgtctgtgaacaaaaagccggtttatgattttggaaaatttgcggattatatccatatttcatcaaactttggattgtacagtgacagttttcggtatagaactcaacgtgaaattaatattgagctgatcaataacggattaaacgtttcaagcagtacctctgttgatcagacgagctgtacgagactttctgcagaacttcacctgccggaagacagttttatagccgactttctctatggaaccaacgtcccgaataatgatatctggatccgttccattttaaaagcaccggaaaagatcacattcagtgaaataaataagtagtgccaacgcttctcagttttaaatttaggttaggagacatctgatggtgtctcctttttttaagcctcacttctatagaagaaattgatttacaacagaccgtttttttatttctgggctattcatttctttttccgtatttttgccggcgaaaattcattattcattactaattataattaagatgctttcggttcagagtttaggattacatcattcaggaaattatttatttcaaaatgtcaatttcaccattaaaaaggatgataaagtaggtctagtaggtaaaaatggagcagggaaatccactttattgaaaatgctttccggagaaattaatttctatgaaggagaagtggtgacagaaggaagtattaccattggtttcctgaagcaggatcttgacttcgtaaaagggagaacggtttgggatgaaaccatgcaggcttttgaacagattaatgcctggaaaaatgagcttgaagaagtcaaccacgagatggcagtcagaacagactacgaaagtgattcttatacggatctgattaataaaatgaccgagctgaatgatcttttgatgaaccatgatgcctacaatcttgaaggtgatatggaaaaagtgttgtttggtttaggatttaaagcagatgatttccagaagattaccgatgaattttccggaggatggagaatgagaatcgaattggcaaagctgcttcttcaaaagaatgacatcatgcttctcgatgagcctaccaatcacctggatatggaatccattatctggcttgaaaacttcttaaaagattatccgggagccattgttctggtgagtcacgataaacagtttatgacagcggtttgtaaccgtactttcgatatcaacaataaaaaggttgacgattataaagccaactattccaaatatctcatcatgagagaagaccgccgtgagaaactgattcaggctaaaaagaatcaggacgcggagatcaagcagatggaagataatatcaataagttccgtgcaagtgctacaaaagcttctttcgcacaatcgcttattaaaaagctggataaaatagaacgtattgaagttgataatgaagacgtttcaaaattcaatatccgtttcgtacagtctatggttccgggaaaagtaatcttcgaagcggtaaaccttggtaaggcttacggtaacaaacagatttttgataatgtagatttcatcgttcagagaggagatagaattgcccttttaggacagaacggacagggaaaaactacactggctaaaattcttgctggagatatcaaagactattcaggaacctggaatcttgggcacaatgttaatatcggatacttcgctcagaatcaggaagaggtattaacacctaataaaacggttctggaagaagctgaagatgcagcaacggaagaaacaagaccaagagtaagagatttattaggatctttcttattccagggagatgctgttaccaagaaaacaaaagtactttccggaggagagagaaaccgtctggcactttgtaagctgttgcttcgtcctttcaatacactgatcatggacgaacctaccaaccaccttgatatccagtctaaggaaatcatcaagctggcattgcagaactttgaaggaacacttattgtgatttcgcacgacagggaattcctgcagggactttgtgataagatctacgagttccgtgacgggaaaatgaaagaattccttggagatatcaacgaataccttgagtacagacaaaaggaaaccatcagggagatttctgcagaaaaagccaagcttcataatgaagtgaaggaagaacctaagaaagttgaggaaaaacctgttgtagttagccagagttcaaatattgtcagcaaggaacagaaaaatattcagaataaaatcaagaaagtagaagaaagaatttctgagcttgaagccaaaattgaagaaatggaagcttcttttgccaaagaaaatccttcagacgaaaccctggagcagtataataaagctaaggaagacttagatacggcattgcaggagtgggaatacttaggaacccaactggattaataaaaatataaatgcttcatcaatttaaaaggatgaagcattttttttgtaacggaattctcttcaatacaacttattatctatagtcattaagtaatttaataaaagtttaagggaacaattaaattattttcataattttgaaccatgattaaagaaagcagaaatttaaagcgttttatctccaggctgttgtttggagtatatttcctcgcgctgctttctcaaagctttcaccatcacgattctgtagattattttaaggcttttcattttaaaaaagtcgagaattcggtgacgaaagccgttactaaagagaaagctggcgactgtctggcctgccactttttggttaccggacatacattagctcctgaagaattcagttttacttttgagcattacagccatgaagtaaaacaaatcatcgccatccaggagaaaatctggtctcagaccaaattcacctttcagcttcggggaccacccgcactttcataattcacagattctagagggtttaaagtttttttagtttaaagttcaatgtttgatgttcaaaggttaaaactgttggaaatcatttgataatgaatattattaacgatttcagtgactaacttttatatcccatcattaatacattttactttttacacaatgtacagtttacaaacaaacccttcccacaatttttaacgaaaaatgtaccttattgaaattaaaagggtacgcaatcaatctatttacaatgaaattgatatattgcctgctgctgatcttttgcggatcagtatttacaagcgcacaaaaaacctatactgtagagggaaccgttcaggatttccatgataaaacattgctggaaaatgcagtgatcaaaatcgggaactttacagccaaaacaaataagaaaggtaaattttcttttgacaaaattccagcaggaaagtatacacttattgcacaacatcctgattgcaatgattatactgaaaatataggagttgatcgggatgttcagctggtgattacactggaacaccatgtcaaagatattgaaaccgttaccatccatggaagccataaaaataatggttcattggtagtgaagactattgataaggcaatgatttcaagaaatgttaccgaaaatttagggaatttattaacaaatatttcgggtgttaatgttcttaaaacgggaaacaatattgccaaacctattatccatggcctttatggaagcagggtttccattcttaatgatggagtgaaacttgctgaacaggaatggggagtagagcacgcacccaatgtggatgttaataatttcgagcatattgatgtcattaaaggtgcatcagctttgaaatatggggccggcgctgtaggtggagtagtagttttacaacctcaggtcctgcctaaaaaggatacaatcatggggaacgtttctctttccggaatttcaaacggaagaggagctgatcttaatgtgaaactagcaaaaacctgggagaatggctgggccattaaaaccaatggaagctataaaaagctgggagatcttgaagctccggattatggtttgatgaataccgggattgagagttcaggatttaactttggagttcagaaaatgacttttgaaaaaggtttttcatttgattattatctaaccaaaagcacagtaggaattcttagaagttcccatgtagggaactcagaagatcttcgcaatgctcttacatcagcacaaccaatctatcagagagattttagttatgatattgataaccctagacaggaaatcgagcatcatattgccaaagtctctgcctataaaaggtttgaaaattttggaaaaattacagctacttatagttttcaatataatcatagaaaagaatatgatataagacgtacagaagctttgagcaaaaaaccggcattggatcttgaattgatcaccaatgatctcaatgtgaatcacctgatagaaagaggaaattggaatcttgaaacagggattaatgctggttatcaaaataactattccaatacccagacagaggcaagacgtcttgtcccgaactatgacagatattatgcaggaatttattctgtattgaaatataaaatcgcacctgagctggattttgaacttggaggtagatacgactatgatcactatgaggtaacaaaatggtatgatctgagtgactggaacaaaacctatgcagcagattattcagattttgtagtaagaattaaccaaaacagaattcttaccaaaccatctttaagctataataacatttcggtaaacggaggtgttgtttatcacccctcagaatattttgatctaaaatttaattatgcaagagtttcaaggtctcctaatgtcgcagaactttttgcagatgggcttcaccattctgctgctattattgaaagaggagatatgagaatgaaaagcgaaacaggaaatcagtttaatctggtcgcagatgttaaagcaaatgtcttaaaaggattaaatatttctgtaaacccttatttcttttatactcagaatttcatcaaccagattcctacgggatatcagaatacacagtggggtggagcttttgtagtatataactatcaacagattaatgcaaaaatgtatgggctcgatattgatgcacagcttaagattacagataatctgacctacaaaggaagtggttcctatgtctatgggcaagatacaacccatgatgtaccacttattttaatgatgcctcctaattttaataattcattggaattcaataagaaagaatggaaaggcttctattttacaataagtaacaatacttatctgaaacagacaagatttcctgtttataacgttccgatcagattattcgattcggacggaaatccttacaatgaagaagtggacatctctacacctccaagtgaatattccctttggaaccttcagacaggggtaaacctgtctaaaaatttcggaattgatttttcagttcggaatgtattcgataagtcttacagagactatctgaacagacttcgtttcttttccaacgaaatgggaagaaactttattttaactcttaaatatcaattttaattacttaaaatcaaaaaaatgaaaaatatttttaaaaatacaactcttatcttaggacttttattcttagctttttctttaagcttaacatcatgtaacagaagtgatgatgaagcagatgaccttcctcaggaagaactttcagatgttctattgagagtaacagatgttgctacaggaactccggttgtatacgactatcaggtcaatagtactactaatccgaatgttaagttaattaatggtcatacttataatgttgaagtaattttcaaaaatggcgatgaagatgctactcaggaaattaaggatgcaaaagatgagcatttcttagtgtataattttcccaattctgatattactttaacacgtacagatgatgccagctctacaagaggagacggaagccgcgtaggattgaaaacaaaatgggttgttaatactgcagtaaaaaatacttctgcacctagtcagctggttcttacattattccatgaaccggtgacagtttctgaagcttctgccgttagtggaaatggggttatttatggaacacatactggtggtgaaacagacgcacaggctaactataatattattaattaatatataccttaatcttgtttggaccgccggaatttctccggcggttttttatttaacaatatttggcgttataagttgattttaaatgggtgattttcataaaaaattcctatttttgcaacctaaaattttaatcaataatgaaggttaccgcacaaaaccatgatgacgtaagtgcattgcttacagtaacattggaaaaatctgactacaaagaaaaagtagagaagcagttgattaattatgctaaaaatgcgcaagttcctggattcagaaaagggaaagtgcctttgagtatggttaaaaaacaatatgaagcaggtattgcatttgaagaaatcaacagacaggtttctgatgcattgaacaactatgttaatgaaaacaaattaagattagttggtcagcctattcctcagccagtaaacgaattcgattacaatgctgatcaattggaagttgcttttgaagtaggatttgagcctgaattcacgatagatttagctaaatatgaagctcctcattacaaagtagaagcttctgacaaagaaatcggtaagagcattgaaaacatgcagaagcgtttcgctgagcaggttcctcaagataaaatcactaaagattcttacattgctttagaagtttctcaggttgtggaagaagatgctgaaggagaacaccaccaccacccgaaaaaccttacgattactgctgaaaacaaagaagctttcaaattggtaaaaggtttgaaaatggatggatctgtaaaagttactaaagaaacacttgcaggtgatgaagaattagctaaagaattaggattcagcaaagaagaagttgagcacttacaccacaatgaagtagaagtaaaagtaaaagacttctattcattaaacttagctgaacttaatcaggacttattcgataaagtatacggagaaggaaacatcaaatctgaagaagaacttaaagagaaagtaaaagctgaattggatgagtatttccagcagaacgctgatgttcacttcgtgaataaagtattggagcaggtaactgagaaagaagaagtaaaacttcctgaatcattccttgtgaagtggttattattctctaaccagaacatccagtctgaagagcaagctaaagaaattcttgaagctgagaaaaaccagttgaaatatcagatcatcgaaggtaaactgatgactgaaaacgaaatcaaccttgactatgctgatgtattggctcaggctgagcagttagtgaaaaatcaattggcaatctacggaatccaccacttaggtgatgaagaaatccagaagtatgctgttgaaatgttgaaagatcaggagcaggtaagacaaatttcttctgaagtagctatggctaaattaaaagatgtaattcttgaaaaagcaagcaaaaaagaaactaaaatttctcacgacgaatttttagaggaacttaagaaatagttatatcagatataaatatttgaaaaccgtcaatttttggcggtttttttatatatatcccacacctgaaaatcatgaatcattaatcaattatcaatcatcactaattgctcattattgatttgtatgtccgccaatattcctatatttaccctttaaactttattataaatatgaaaaagatcatcattccgtttttctgcgctgtacttttttcagtacctgcagcagctcagaaaaaaggggctgcatctgctaaaacagaagccgtaaaatcaaaattgacacctaaagaagtcattgataattatttcaaagcattaggtggaaaagataaactggacgctgtaaaatctaccattactgataacaccgtggctgtacagggaatggaaattcaaatgaccactaagaaattaggaaataaattcaaatctgtgcaatctttcatggggaaagaaatgattcagctttttgacggagaaaaaggatattttgatcagatgggaacgaaaacagatattcctgctgataaaattgctgatctgaaaaaaggaaaacccattgatgcattagcatttgatgcctctaatttccagacggtatctacagaaaaacttgacggaaaagactataatgtattgtcttcagataaaggaaagttttatttcgatgctggaaccggacttttgtataagacagatgcaggcgaaggaaatgcaactattaaaagttatatgacggtagacggaatacagttccctgccgaactggatgccgaaggcggaggtcagaagatgaccattaaaacaacaaaggttgtcatcaactctggagttacagatgctgattttaaataaaaaatcattttctaaaagataaaagccgggaatttcccggcttttttgatatattaatatttttaactcaaatttaactgtcaaacaggattttatgatttcttcaccttgtgaataattggtagttttaagccgtaaataaaatcgaaaaccatgaaaaaagtattatcttcatttgcagtcatttttttaatgtctgcgaatgcctttgcacagaatattcctgtggatccttccgtgcgaatgggtaccctttccaacggaatgaagtactatatcaaaaaaaataccctgcctgagaaaaaagtagatttccgtctggctatcaatgccggatcaattcttgaagatgagaatcaaagagggcttgctcactttatggagcacatgaatttcaatggaaccaaaaattttcctgataataaacttgttgactttctacagtcaataggggtgaaattcgggcaacaccttaatgcgtacaccggctttgatgagactgtttatatgctccccgttccactggataaacccggaaacctggatgccggactgaaagtaatggaagattgggcgtttaatgccacgctttctgatgagcagatcaataaagaaagaggagtggtgcttgaagagctaagattaggcttgggaccggataaaagaatgatggacaaataccttccgaagcttttatacaaatctcaatatgcggacagacttccgatcggtaaaaaagaagtattggaaaactttaagcctgatgttatccggaaatttcaccaggactggtacagaccggatctgatggccattattgtggtaggagatatcaacgtggatgaaattgaaaaaaagattaaagacaatttcagcaaatataaaaatccttcaaagcccagagaaagaaaatctttcgatcttccgaaccataaagaaacgctggtagctgttgaaactgatcctgatgctaccaattctatggtccagtttatcatgaaagatgctgatgcctacaaaccggatgtaaccgttgaacagtacaatcaaagtattatagaaaatctttcaacaacgatgttgaacaacagattgagagaactgatcaattctacaaatcctccttttacttttggatccgtataccatggaggaacttatgcaagaagcaaagaagctttccagggatttgctatagtaaaagaaggaaatcagcttaacggactgaaagttttactggaagaagtggaaagagcaaaaagattcggatttacgcagtctgaacttgacagggcaaaatctcaggtactttccaaccttgaaagatcttataataacagagataaaacagaaagtggtatgctggtagatgaatatgtaagaaacttcctggagcaggaaccaatccccggtatttcctgggagtatgaagataccaagtctttcttaccttctgttactcttgctcagaccaatgaaattatcaaaaaaatggtgaaggacgatagcagggtaattgtgatcaccggtcctaaaaaagacaatgtaaccatgcctacagaagcaatggttcttaatacatttgatgctgtgaaaatggctgatcttaaaccttacgaagaaaaagctgcgatcaaaaatttaataaaacctttcaaatctgaaggcaagattgcgaaaacagaaacggatgcaaaattaggaacaacaacctggacgttaagcaatggtgctaaggtaactttcaaaaaaacagacttcaaagatgatgaaattgtgtttacagcaagaagtttaggtggaagttctctgattcccgatgccgattacaacaaaacacagtttgcttttgctgcattaacggaatcaggggtaggcggtttctccaaagctgatcttaccaactatcttgccggtaagcaggtaagtgtaaatcctatggtgacatctctttttgaaggcgtttcgggaagaactacccaaaaagatttaggaacagctatggaacttatgtacgcatattttacaagcttaaattataacccggcatcttttaatgcatacaaagaaaagcagtcggcaatgacgaataacctgttatctaatcctcaggcttatttttctaatgaacacgccaaatttatgaatcagaagaatccccgtttcattggcgtattccctatggaaaaagattgggcgaatacggattataaaaaagcatatgatatctataaggataaatttgccaatgctgggaacttccagttctatttcgtaggaaatattgacgaagtgaagtttaaaaatgaagtcctgcagtatattgcaagtctgccttcatcgggaaaagcaacaatgtttaaggacacaggttacagaacgatgacaggagattataccaaggtgtataaaaaaggaaaagatccgaagagtatggtttctatttcttacagtggagaaactccttacagtgaaaaagaagcattggctttatcagctcttggagaagtggctactattaaagtaattgaaaaactgagagaagatgaaagtggtatttatggtggtggtgccagaggaggtatgaacagggttccttatggtagctataacttcagtataagctttccttgtggaccggaaaatgtagacaagctgacgaagagtgctattgcagaacttcagaaactgattgacaacgggcctgaacaaaaagatcttgacaagtacaaggaaggagaatataacgataataaaacggatcttaaagataatatgttctggatgaatgctattgccaagaaccagttagacggaagtgataaatacgatatcttaaattatcaggataaagtaaaagcccttacggtaaaagatcttcaggatgtggctaagaaatatcttacaaaaggtagaattgtagcgactttaatgccggaagatggctgggaaaaagctaaaaaagaagaaccagcaaaagtagaagctgtaacagtaaaagcaggagcagctaactaatcaactttttacttacaataagaaaaccgcagattggtctgcggttttttgttatttaattccatccttacaggttaagaaccatattcttttttccattcatcagcagcttcgctcagaacggtataaaactcttctccgtattttctgatcagcggagtttttaagaacttatatacaggaacctgaagctcttttccaagggtacaggcatcgctgcatacattccattcatgataattcaatgcggtaaaagcagaatattccgtaacacggatcggatagaggtggcatgagatcggtttttgccagtctacagcaccatcttcgtacgctttttcaataccacatttggtaattcctttttcatcgaatgtaacataagcacattcgcggttttctaccataggagtaacatacattccgtcgtgtggatcagtagtccatgtgccttgctcttcaagggctttgattccctcttgggtaagataaggttttattttatcaaaaatactgtccaatatttcaagctcgttcttatccaacggagctcccacatctccttccacacaacatgcacctttacatttcgaaaggttgcaaacaaattcttcggaaaaaatttcctctgaaatcaatttatcgtctatctgaatcataattttttaaaataaatcaaaaactgtacccgctttaaaggtcagtaaactaataataataacccatacactggcttctcgcatccagtatttgggtaaaaatctcatcatcctgctcagaataatactagaaggaaatgccagcagcatcaggtattcatagcttttattcatatacaggataatggtgacaagctgtgccacggaaaagaccagcagaaaagtatacttatatctgcttatcgggctttttttattataatttttgaaatggtcatatacggcataaataagcatcagaaccacaggaatcaatggcagaagctcggtgtaatctgttaccggtttcatttttccaaatggaaaataatcgatattccatgaagtaaactgaacgaaatacatgacagaaaaatagctgaatgtaatcaggacaattcccaaaaggaacctgaaaagattcagccctattttggcagaagttgcaatcacgtggatgatcacaaaaacagccattggccaggtagtgggaagaaagataaaattcagcgctacaatagcccccaccagcacatatgattttttcctgacatcctcatctgcactggtcagaagaagaagtagaaaagagttggtaagcagtgaaacggcaattcctatatccagatttccgggataaagtccgaaaataaaaaaagtatacaggaataatggaagatgggtctggtaattaagcgcaatactgtgaaaacaaaaatatcccaaagcaattcccagaaaagttattccggcaacaatagcttcgtaagtgttgaaattcagtatgttaaatattattactactaaaagaagaaaaccaatataaacaggaattgaaaaaatattgctttcttttgaaagtaatttaaacattttttataaatttgtacaaagttaatttaaaaaaggaaaataatgacgtctttctttctattcttaagcaaagttttcaaatggtctttcggtttctttgatgctttcggtaatgttttaaactggattctgtttatagtttgctgtgtactattcacttattggtgctatgtactggtggttacacttggtggcgacaaagataaagactattattctccaacggaaggtaagcacccttactacgatccgaatatctacaaaaaagaaggttaattaattggttatatagtaaaaaaccgatcaaagcatattgtttgatcggtttttttattactaacgattaaaattttctttttcttagtcgtgaatcggaagtaccagaacaggaatacttgaacttttcgttattccttttgttaagcttcccacgaatacatcatatattccgcttctgccatgtgatcccatcacaatataatctgcatttttagccttggcatgctccagaataatatctttcgcaattccttgttttaaaaggtgctcacaatcgatatcatgggcaaggatcctctgctcaatcttgttaagctgtaccagctcttctctgatctcattggcttccacttccggaaaatattgaaatcccatatcgccgatggcaaagccgatatctgatggcgctacgtggatcaggtaaattttgccgttaagctgttttgcaaattttatggcaccgtctaccagttggtctgtcttgtccccaaaatctacgggtaatacaatatttatcataacctctaattttgttatctaaagatatgaaaaatttgccagactctgatgttaaatacttataatattcggatatcaaggattttttcttcttcaagataagcttccagaatatcgttttcctctacctttccaaccccttttggagttcctgtgaaaataaggtctcctactcgcaacgtaaagtattgggaagcaaatgcaataatgtcgtcaaagttgaacatcatgtcttttgtattgccatcctgtaccttttctttattttttaataatgaaaactgaaggttttccagactgaaattctcttttttaaagaagctgcttaccacagcagaaccatcgaaacctttggcaagctcccatggaagaccttttgatttcagttcgctctgaagatctctggcagtaaaatcgattccaagaccaatttcttcataatgtttatgtgctgtttctttctggatgtatttccctccctttgaaatttttaataccacttcaagctcatagtgaatatcattagagaattcaggaatgtaaaaatcatttccttttagaactgccgtatccggtttcatgaagataacaggattttcaggaatttcatttcctaattcttttgcatgctcactgtagtttcttcctatgcagattattttcataacttaattaatttactttacctttaaaatatccttttccttctgctatgtattttctgggcccgtatccttcttgaattttaagttcggtatagccgaagatactgtctcctttttgataagattccttatccagaacaactttactgtccagaactttataatattctcccgtattcagaaaatcaaaaggtttgatattatctgtgtaagaataaggggaaactttatagcggttctgtaaaatatcgatttgataaccaccaccactaaagccatctccaacagaaaatgtaatgttcagtgttggatttctgttaatataacaactataatactcaaagcttgtgctatctgatgttattttgaaatcattggttttatcctcaccgttctgactccaaagagtggcctgtttctgttgattaaatgctttaaaaataggtttttggctcaaactgtgatcaatttcaacacttttccatactaataagaactttcccgttatgaaaacaagagagccaagaataatgatgagtacaatttttccaatccttttgatcatagttttttaatgcgtaaactcattcccgcaataatagcatttgaatttgtggctcgtcagaaaagaaattccgaaaaagctggtggcactgtcatccctgtaaatatgattggatccacatttcgggcagacaaaatcaaactcaggatcttcaatggtatgttccacttccagagaatattgttcattgtctttataatcctgaagaatttgccgggctttttccacatcttcttcaaatacctgaagctgtatgccgcctaccgcctgtgacagaagccaatctgattgaataagctgctcattggcaataaaactgttaatcccgttttcagccagaatttgtttgtccctgttagcttcaagggcagtttcgtaaaatttaaaacgtaccagatcagacatttttaaaacctgcttgataattgaatttttgtaaaaatctttttggtatacagcggaaaatcagcattctgaagccatccgaaataccctaaatctttctggaataccgctttcactccctgacctttatatttcccgaagttgaaaacctcttccattttctcattatatccgataaatccggcaagatctgcattcttgttatggaatgtaaattcacttaacggcgctatttcattcggaatatcatcatattttccgacctgggcatccagaacttcaaacgttgccattacatcagcttcggcagagtgtgcattttccaatgtttttccacagtaaaactgataagctgcccctaagttcctgggttcctttttatggaaaatagtctgtgcatccaccagtctgaatttattcagatcaaaatccattcctactcttaaaagctcttcagccagaagcggaacatcaaatctgttggaattgaaacctccaagatcacttcctgaaatcatttccataattttagcagcaatatccctgaaagtaggagcatcttttacatcttcatcataaatgccatggatctcactgcattctttaggaatcggcatttcaggattgacgcgccatgttttgctttccctggaagcatccgggtttactttcaggatacagatctcaacaattctgtcttttccaatgttggttcctgtggtttccaggtcaaaaatacaaagcggtttatggagttttaaattcatgtcggtgattaataatttgaagtgtgttttattttaataaattattttaactgtccctgaaaaatgagagacaccaatatataataaataacaagcatcggaattcctactacctgaaacagggcaagaataacaattcctcctgcaagtaatactactttaggatagttgtcttttaattgttttgatttgaacttcatcgccatcatcttgatcgggctgatcagaagccatgaagtaagaagggtaagcagaaccagcagcaattcattatcaaacaaaaagctgaaatttccggtttctttaaaggcataataaagaccaaaaagtaaaacagtgtttgtaggggtattcaatcctttgaaataataacgctgctcttcatcaagattgaagatggcaagtctcagacaggaaaatacagtaacgatgatcccgatatatttgatctcaaatggtagatgaatcccgagaagttctgcaccaaacggttcaagcgctttatacatcgtaagtcccggaattactccaaagcttaccatatccgcaagggaatcaagctgaaggccaagattggagtttgattttaatgctctggctacaaagccgtcaaaaaaatcgaaaaccgaggagagaataaggcagattgccgttgtctgataatctcctaatattagatgtattgcacctatacagcctgcaaataaattagccagggttaaagcattggccagattattctttataaaatccataaacacaaaattacagtttttaaaaattctaactcaaaataatatgaactaaaaaacgcattaaaatgattttgatgtaaatttgccccatgaaatttttaaaaggatttagaaaacaggaagttttggcattggtttaccggattttcctggcctatgttttttatcagattgccagacttttattctggtattttaataaagatctgattaaggttgactctgtttcagaatatataaagctggctttccatggtacagctttcgataccacagcgattctgtatgtcaatacattatttatactccttagtttattgcctttggtgatcaacaccaggaaaacttttcagaaaattcttttctggctgtatttcattaccaacgggattgcctatgcgatgaatttcggggattttatttactataaattttcacaggcaaggcttacttcagctgtatttcaggtagctgagcacgaatccaatgtttctaaggtactgatgatttctatcggacaacatcctttcgtactgatctggtatgtcattctgatgatcatgtgggttttcctttataaaagagtaaaggtagaagacacaaaacctctgaagctgctgccttatttcatcacctccattattactttgtgtattactgctgtactggttgtgggaggaatcagaggtgactttaaacacagtacgagacctattaatatggtggatgcgacccgttttgtaacgaatccgctgcagggaaatatggtgctcaacagtacattctcctttttaaggactttaaataccaataatttcaaggaagttcattttgtgagcgaaaaagatatagaagagtatgtacagccttataaagtatatgacagaaaagtaaaaaatcgtcccaatatcgttatttttattgtagaatctttcagtagagaatattcgggagctttcaataaagataaaaatatcaaagattacgtttcttatacaccgttcatggacagtctggcaagccagagtcttatttttccgaatacttttgcaaacggcagacagtcaattcatgggatgagcagcgtattggcgggaattccgagtcttacggatgcatttacgggatcaccttattccaatcagaaaatccagtctattgtttctgtatgtaatgaccttggctatgacacttcgttctatcatggagcgccaaatggttccatgggattccttggtttcggaaatatcttaggatttaaacattatttcgggaaaacagagtataaccatgatgaagatttcgacgggatgtgggcggtttgggatgaacctttccttcagtattttgcaaaaaatgtaggaaagaaacagccttttatgactactgtgtttacagcttcatcacatcacccttttaaaatccctgaaaaatacaacggaaaatttaaaaagggaaaaatagaaatgcatgaaccgatacaatatacggattatgcaataaagaaatattttgaaacagctaaaaaacagccttggttcaataatacgatctttgttttcacgggagatcataccaaccaggtctattatccggaatatgaaaaagcgatgaaccgttatgctgttccgttgattttctattctccgaatcctgaataccagcttaaaggagtcagccaggaaattgcacagcaggcagatatatatcctacattggcagacctaatagggtataaaaagcctatcagaagctgggggagaagtctggtgagcgataagaaatatcctttcattgttgtgaattctgacggaagtatggagcagttcatgatcggaaattatatttatcgttttgacggaaaagaaatagtaggggtatatgataaatctgatctgggccttgaaaagaatctggttaatgagattaaaaatccggaagtagagctgggaaagaaaacagcaaaagcctggtatcaggattatatggacagagtgattaacaggaaactgtattagggcgaaatggcaaaaaggtaaaaccgtaaaatggcgaaaacatcacaggctgattgaaacttagctttttcgcattttagcgactttacgttttatatcctctttatgctttgtataataaaagtttttgtttgttgaaaattaatttatacatttatcaatacgtagataagaatattgtattacaattaaaactataagaaatatgaaaaagatattgttaacgttcgcactttctttatgcggtgtgcttacatttgcacagatagaaggtaagtggaaaacgatagatgatgaaaccaaacaggcaaaatctattgttgaagtgtataaaaaatctgatgggaaatattatggaaaagtttcccagctgttaataaaaccggctgatgccaactgtacactttgtaaagatgacagaaaaggaaaaccgcttttaggattggaaatcatcagaggattaaaaaaagacggtgatgagttcacaggaggaaccattacagatcctaaaaccggaaagacatacaaatgtaccattacaagaagcggtgacaaactgaacgtaagaggttacttaggattgtctttattaggaagaacccaggtttgggaaaaagctaattaatttaagtttaaaatagaatttacatggcatttcagaaatggaatgccattttttgtggataaaattttgaacaaattcttagaaaccttgaaaaaccacaagaacaaagctgggagcagggaaattcattttaaatccagttaatattatgactttacattgaaatgaaaaggctttttattatgtgtataataaaaaaacactatttttgtagtctaaatttttcaagaaaatatggcagaatatacttttcgtgaggtaattgcacaggcaatgagcgaggaaatgcgtaaagacgaatccatctacctgatgggggaggaagttgcagaatataacggtgcatataaggcttcaaaaggaatgctggatgaatttggtccgaaaagagtaatcgatacaccgattgcagaacttggatttacaggaatctctgtgggagctgcaatgaacggtaacagacccatcgtagaatttatgacattcaatttctcattggtaggaattgatcagattatcaataatgcagctaaaatccgccagatgagtggtggacagtggaattgtccaatcgttttccgtggacctactgcttcagcaggacaattaggagctactcactctcaggcatttgaaaattggttcgccaactgcccgggacttaaagtggtggtaccttctaacccatacgatgcaaaaggattattgaaaactgcaattcaggataatgaccctgttattttcatggaatctgagcagatgtatggagataaaatggaaattcctgaagaagaatactacttaccaataggaaaagcagatatcaagagacaaggtacagatgtaactttggtttccttcggaaagatcatgaagctggctttacaggctgctgaagatatggctaaagaaggaatttcagtagaagttattgaccttagaactgttcgtcctcttgattttgataccattttggaatccgtgaaaaaaacaaacagattggttattttggaagaagcgtggccatttggttcagtatcttcagaaattacttatatggtacagcagaaagcatttgattacctggatgctccaatcaagagaattactactcctgatgcacctgcaccttactctgctgcattatttgcagaatggttccctaaacttgaaaaagtaaaagaggaaatcaaaaaagcgatgtacgtaaaatagttatagaaaaaaacttccgaaaggaagttttttcatttattatattcatgaagaaaaattcttgacgtcataaaattagtataaatttgcgcctttaaaataaattaagctgatatggcagaagttacagaagatggctaccacttcgacataaaaagactttcctttattggagttctggtgtctctgggaattgtttttggagatattggtacctctccgctttacgtaatgaaagcaattgtgaatgcaagatctcaggggagcaatatgcctttcaatgaatacatagaaggtgctctttcctgtattatctggactcttaccctgcagaccacaataaaatatgtgatcattgctttgagagcggataacaaaggtgaaggaggtattcttgctttgttttcactggtaagaaaccttaaaaaaggatggttgtacctcattgcaattattggtgcagccgcacttattgcagacggagtcattaccccatcactgacggtaatgtcagctattgaaggtcttgaaatttataatccccacactcccgttgttcctatcactatcggaattctgattgccatttttgtggtacagcagttcggaaccagctttatcggcaagtttttcggtccggtgatggtggtttggttcctggtattaggaggtctgggagttatgcatttgagcgaaaattttgaaattttaagatctttcaacccttactatgcctataagcttattgttaattctccgagtgcaattgtgattcttggagctgttttcctttgtacaaccggagcagaagcattgtattccgatttagggcattgtggtgctaaaaatatcagagtgagctgggcatttgttaagatcatgcttattctgaactatcttggacagggagcatggctgctgactaattataataaacctggattctctgtggtaaacccgttctttggaatcatgcaggaatggatgattatcccgggagtaatcttagcaacagctgctgcaattatcgccagtcaggcgttgattacaggttctttcaccatattctcagaagcgatgtcccttaacctttggccaaatcagaaaattgattatccttccggagtaaaaggacagatgtatattccgagaatcaactggggacttcttatcctgtgtatcattgtcgttctgcatttcaaggaatcaggaaaaatggaagctgcttacggactttccattacagtaacaatgttgatgacaacggttctgctggtattctggttattgaagcacagagtaagcaaggttttgatcctgtttttcgcattggtgtacatggctatcgaactaggtttcttcagtgccaacatcatcaaattcatggaaggaggatggattaccgtggtattggccggctcaataggagtttctatgtatgcatggtataacggacgactgatcaaaacaagatttatccagtttgtgaaaattgaaaaatacgtgtctattcttaaagacatgaagctggatgaaaccattccgaaatatgctaccaatctggcttacctgagcagagcaaaaagaaatgatgaggtggaatcaaaaattatttattccatcatcaaaaaacaacctaaaagagcagatcattacttcattctgagcatcgtaaatcaggaggatccttacactttcagatataccgtagatgaaattcttccgggaacagtatataaaatcaacttccttttaggatttaaagtagaccgaagaatcaatgactatttcaatatggtccttaaagatttaatggcggacggaaccattccttcaagaagcagccatccatctttaagagctcatgacataccgccagatcttaaatatgtgatcatagataacacctatatcaacgatatccttttaactgttaaacagaagattacgcttaacatttacaactttgtgaagtatatcggaagtgacgactttaaggcatggggagtatcttcgcataatgttgaagtagaatctgcaccgattacagaacttacagtttacgataataagatcgagcaatcaggatatttccgtcataactcgtagctacttgtatttaaccatactatctatttaaataaaattcaataaatttgtagataatttttttaatggatacaatacaaaaagaaaaaaatatagctttgatcaaggatgttttgagaaactacttattagaaaaagggttcagaaacacacctgaaagatatacgatattggaagagatttataatatggatcatcactttaatgttgatgatctgtatcttctgatgatgcagaaaaaatatcatgtttccaaagcaacgatttataatacgatcgaaattttccttgatgcaggcttaattcgtaagcatcagttcggagaaaagacattgacctcttcatcttatgaaaagtcttattttgacaaacagcatgaccacctggtgatctacaaaaaagactctgataaagaaattgaagaaattattgaattctgtgacccgagaattcaaggaatcaaagaagccattgaagaagcatttggcgtaaaaattgattctcattcgctatatttttatggcactaagaatgactaattaatgagaatagcactttttctgttactctttatttctacgctaagctttgcgcaggataaaaaccctgtgaagagagatccctatttacaggctccttcacccactcagcctaagcaggtgagacctgaagataaggtaaagatcatccatgcggacgagatcaagaaaaaccctgagaaatacgacgggaatcaatattttaccggcaatgttcagattgaacatcagggctctattcttacagctgatgaagtagttctttacaatgaagaaaacttcgtaaaagcaataggaaatacaaggcttcaaaatacagacggttccgtaattacagcaggagaaatggaatatgatgccaatacccaaaaaggtgttgccagaaaaaatgtggtccttaccgatccgaagcaaaccatcaaaacagatattctgtattatgacaggctggctaatcaggcttattttaatacaggaggaacaatctcagacgggcagaacgtaacctatgccaaagtaggaacctattttcttaatacaagggtagtagatcttaccggaaatgtaaaaatcgaaacccctcagtatatcatagacggacccaatatcaagcagaatcagaatacaaaaattgctgatttcatcggtccgacaaccattaccagcaagacgaatccaagaaacaggatctatactgaaaaaggtacttataaaatggataccaaggaggcttatttaaccaaaaactccaggatattttataacgagaaaatccttaccggtgatgatatgtactataaccagatttcaggattcggtaaagcaacgggcaatgtaaccctggatgatcctaaagaaaaaagatatataaaaggaggatacggagagattttcgagaagaaagactctgcaatgatgacgaaaagtccctatgctgtaaaagtaatggaaaaagactccatctattttgctgcagaaaaaatcatttcttaccaaagaccggattctcttgatatcaaagtgaagaaaagctatctcagagcctttaaaaaggcgcgtatttataaatccaatgcgcagggaagagcagactctatcgctttcaatgaaacagacggaattatgcacatgtataccaaccctattctttggagtggtgaaaaacaggtgaccggtgataaagtagaagcttattttaatacccagacagaagacattgattctttaaaagtaatcggaaatgcttttgccatcagtaaagtagattcactgaacctgaaagatgaattcaaccaggtgaaaggtaaattcatgacggtatactatgaaaagaacgcgattaaagaagcaagagtagttggaaatgcccaatcaatagtatatgtggatgataccgatcaggaaaccaaaaagcctgaaaggataggaattacactttctacctgcggaattatcggagcattatttgaagaaagggcattacagattatttcctgcagtatcggagcggcttcagatacttatccgatgagtatgatagaaccttcaaaaaggaaatttccggactttaactggaataccaaagacaggatcagaaaatggcaggatatccttgtagacagcccgaactacgaagaaatacaatatacagccgataacgaactcttcgataaagctcagaaagcaattgatgacgaaaaagcgaaagaagaagctaaaaagcctaagcggacaagaaaataaatcaaaagaccagtagttgctggtcttttttgtggattaattttagcgtttaatgaatcttttatagctttgctgaaatttttggagacaatggaaatgcataaagacttttttatatatcaggcacaaaccacaaaatttgctgcaggttttgaggtagagaaagctgtaggaagctatatttatggtacagacggaaagaaatatcttgactttgtggcaggagtttctgccaatacgctgggacattcacatcctaaaattgtagatgccattaaagagcagacggataaatatcttcacgtaatggtgtatggtgaatatgcccaggaaaagcctgtagcattatgcagattgcttgctgaagctactcctgatcctctggaggtaacgtaccttgtaaacagcggggcagaagctattgacggaagtttgaagttggcaaaaagatatacgggaagagaagaaatcgtttcctttaaaaactcttatcacggaaatacccatggcgctttaagtgtttcaggaaatgaaacccataaaagagaatttcgtcctttgctgccgatggtgtcttttattgaatttaataatgtagaagatcttgataaaatcacggagaaaaccgcttgtgtaattctggaaacaattcagggagcagcaggatttttggttccttctcaggactatatgatcagcttaaaaagaagatgtgaagaagtaggagcgctgttgattctggatgaaatacaacccggattcggaagaaccgggaaactcttctcttttgagcattttggaattgttccggatattcttgtaatggggaaaggaatgggaggaggagttcctgtaggtgcttttatgagttccagagaaattatggaaacgctttcccattcaccaaagcttgggcatatcactacttttggtggaaacccgttaattgcagcagcaagctatgcaactttaaaagaagttctgaatagcggactgatgaatgaagtggatgaaaaagaaaaactgttcagagaacttttggttcatcctaaaatcaaaaatatcaacggtaaaggcttgatgctggctgtcaatctcggaactcctgaatataccctggaagtagctaaaaaatgtatggaaagaggacttattgttttctggcagttatacagaaatgaatatctgagaatttctccgcctcttacattatctatggacgaaatccgggaaggatgccagattattctagacattctgaatgaaaattaaagataaaatctctccggaaaggagagattttttatgttttgcatggtagtttttagggcttgaaatctggcaaaataaagatgtaaaacctctgataaatatcatgctgattctataaaaaagtaattgtttttttgcgtaataaaaaaattaatttatatattgcgggacgataaaacaaagattatatggcgaaacataaagtccattacgaatttccaatgcactgtttatcagagattttatatgaatatctggcgactgcagagggattgtctgaatggtttgcggatgaggtaacagagaaaggcgatgatttcttttttagctggggcggaggacctgctgagaaggccactttgatcagatataagcctgaaggtttcgtgcgtttcagatgggaagaagatgaaggaactaaaaacttctttgaaatgactatcgtaatagatgatattacagaagatctgtctcttaatattacagacttctgtgaagatggtgatgaagacgaaaacgcaatgtattgggaaaatcttattgaaaacctcagaataaaattaggtgcagcataatgctggactttattaattgataaaactgatgaacgatttatcgttcattatttttttgtaaataaatcacattaaaaattggaaaatcaatattttacatcagacgaattaaatgtaaagaacagagcttttctctggggagactcagtgaaggtttctttctttgtgagaaatggtggattgatcatggacgaagaatgctattttttcctgatggcttccatgagaaagatgagaatgaatattcctttaacttacacgctggagtttttccagacactttttcagaaagatattattgaaggtaaaggagtagataacggaattatcaatttccaggtgttcagaaataatgacggattgacattggcaaaatcttctgtttcttatttttacgaagtaaccgaaatggctgatgtgctggctgtacatcaaagacctctggaattggacctgatcaaggaaattaatgttaataacaaccttttgagcaatatccgggttcactgtccggaaaatatttacggagcaatttatgcccaggaaaacgatcttgacgatgtgattcttctgaacccaaacaaaagaatagcacgtaccacagccggaaatcttctttttttagaaggtgatgtgatcaaagttccaaagcagactgaaggatcatacatttctcctttgatggaaaattttgttacttttttgcataagaataaccttgcagatatccaggaacacgagattattgcatttgaatctcagaaggctgaagaaattttaatgatttctgatgagaaaggtatgttttctgtaggtaagataagaaacaagacttttgaaacttcccgtttctcagaattgatagaaagctggaagaaaagttttaatcagtaaaaaattgacaaacccggtaaacaacaaagttccagaagtcctttaccgggttttattctgagtaaatcagaaattgtttctttttatttaatattcgttgatgatctcaacaaatttctgtgcgatttctttttgccccttttcactggtaatataattcctgttctcagaattattgataaaaccaagttcaaccaatacggcaggtgccttggtttctcttaatatgtgaagattgcgctcttcaattttgcgggcattgaattttttgtaaatttttccggccagttccttggaaacatcagaattctgaacgtacacttcaaatccgttgtcagttctttctttttgaggcgagctgttaacgtgaagggaaataaccatttcagggttcagtttattgatctgatctgttctctcagcaagagtagggaaactatcggaatctctggttagaataacttcatatttgtcctggctttcattgatcttccggatttctttagcaacacttaatgcaatatttttttccagaatttcaccataagtagccccaaaatcatttccgccatggccggcatcaatgacaatgtattttttattgataggagtaaatgataaaaaagcggtagaaaatattgacaaagcaagtaatgtaatacctttcatatcagtgattttagtttttcaaagaacggaaaaactttctttaaaattggttaaaagaatcttaaattttgttaattatcagattgatacgaaaaatatacggtttagtttaatgaaatgtcttcaggagaattggcccagagaaggaattctcctccaagattctgcatgatagatttccagagtgtctgatcgttgggaagtgtgtaatcaagattatatacatctactactgtccacatttttctttgaacttccgtatccagttgattaggcgaccatccggaatatcccgaaaatattttgatatgctcaatactcagttcgctgcttaaaactgcattaatgatccgctcaatatcttctgtaaggtaatattcatcggtaatatctgtatagatctcagtaactcttttgccttttacgatgaaaaataccttgtcgttttctacaggtcctccgtcatacacctcaattttaaagtcaaaaaaatctttgaatttgctactcatctggctgttctttttattcaatatcaaaccaaatgcaccactttcattgtgttcaataaccaatactaccgatcttgaaaaaatatcgccggagatgtcaggtgtcgagattaatattttacctttgtatgagtgattcatactcaaatttaataaaaaatatttatggaaaacctgcacgacaaaagaaaagtgtacgagaaatcccaacttattgaaagtgagatcaaacaaaatccaattgaacagttcagagactggtttttggaggcaaacgagagtccggcgatctcagaagctaatgctatggcggtttctacagtggaagaagatgggtgcccaagaacaagaatggtccttttgaaagcatatactcatgaaggatttattttttacaccaattataacagcagaaaaggaaaagcaatagaaaacaatcataaagcatgtcttcattttttctggcctaatctggagcgtcagattattatcaaagcagatcttgagaaggtagcggagaatttaagcgatggctattttcattcaagaccgaaaggaagtcagctaggagctgttgtttcgccgcaaagccaggttatacccaacagagagtttctggaagataagttaaaagaattggaaaaagaattcgaaaacactgaagttccaaggccggccaattggggcggatatctggccagaccttatgaaattgaattctggcagggaaggcccaaccgtcttcatgacaggattatctaccagctggaagatctggactggaaaatttcaagactggcgccgtaattggaatcagaggttggaaactagaaactagaagttagaagttagaagttagaggtagcctatggagatcttttaagaaattagatattcttatatcaatagaagcgggctttaacccgcttattatttgtgcatagcggtaaggcttcatcccaaacttaataatcataaacgcttaaaaaggcttaacggtttaaattcctgacaccacttacagaaataaaaaaggctgtttcttagaaacagccctgaattttttgtaatctgaatgattattttttcttagcacctgaaactgcatttgataaatcagctccagccttgaatttagcaacttttttagcagcgatcttgatcggttttttagttgcagggttaataccttgtcttgctgctctctcagctactgagaaagtaccgaaacctactaaagaaacttttccgtcttttttctttaatgtagtagttacgttaccaatgaaagattctaaagcagctttagctgcaactttagtgatacctgcatcttttgcgattgcgtcgattaattcagacttgttcataatttttaatattaaagttagttcgtaattatagcaaatataatactattttctaattgtgcaatttttttattaaaacttgtgaaaattttttacgtttaagtaaaatcagttaaaatatgataattccacttttcacagaaaatctacgttacaggttgctaaaatcatgccaaatgcttatgtatattgactttagcaaaaagttaatattatttcctctatttattaaatcctaaattgtgtgtaaacaattaatttttttgaccatatgattattaaatttacaagcaattttcatatttcttgtgttttgtaaaattaaacccctgtgtttgtgggagtttttaaatgatagtaaagtcctgttttattaatttttattaataaatttgcaacatgttaatagaagttttcaagtctaagattcacagggtgagagtaactgcctctgaccttaattatatagggagtattacgatagatgaagatcttatagaagctgccggtctggtagtgggagaaagggtctatatcgtgaatgtaaacaacggagaacgttttgatacttatgttatcaaagggaaaagaaagtctggggaagtatgtctgaacggacctgctgcaagaaaagtacagaaagatgatattatcattatcattgcgtatgcacagatgacaccggaagaggcaaaagacttccagccgaaaattgttttcccggatgaaaaaacaaaccttcttacgtaatacatggagaaaacatcaaaaagtccggtaaaatcaatacttacaatagtaatatcgcttgcttttgcaggcttttttttatggctcgccttaagaggactggattttaaagtcatccagaaatcagtggcaaaagccaattacctatgggtactgtttgcctccgtatttggacttcttgcttattggttcagagctattcgctggaaccttatgctggaacctatgggacaccacatatcgaattccaacgcactttggtccatatcattcggttatctgatgaatcttaccattccgagaagcggggaagtagcaagagctacagctttatatggagtagaaaaagtgcctgtagataaatctttcggaactattattctggaaagggtggtagatctggtctgtatgttgggattcttgattctgacagtgatttttaaatttaatgcgattctttctttctaccattttgtaatggataaaaaggatgagaaagagaaatttgttcctaatttttttgaagagcaaatgatgaaattaggcgtaagtgattttgactcgttttatttatatgttaaaattgctttggcgatattggctttaattgctttagctcttctttataattataaaaaagaacaacttatcaattttggaaaaggaattcttcaaggattaacttctatatttaagttaaaagaaaagggaaagtttatcctttatactttgggaatctgggtttgctactatctggccgcttaccttgtctgttttgcgcttcctgaaacatccggatttacctttgcagacggtttctttatcattgtagtgggaacattgggaatgataatccctgcaagtggaggaattggagcttataatcttgcaatgaagtacggttttatggcactttttatttcagtagggaaaagcgctgacttcggaggtgaaatggggcttacttattcctttatttctttaccgctgcagattgttattatgctggtaatggggcttatttccattcctatgctggcaaaagcaagaaatgctgctgttgcagataagagctttgaaaattaaattcaacctaactgtttacatcatacaaggtccaatttttcaattggacttttttatgctcaattttcccaacctaaataatttcaatttactgcctttcagtttccataaaatatgaatgctcatcttctcctacaattttaaaccccagacttgcatagagatgctgagctttattggtttttaatacacttaatgatacggttttccctgctagtgaagcttcctccaggatgtcagacaagatcttttttccaagtcctttaccttgttgggcaggatcaatttggagctgaagaacctcaatgttggtaaaggttctgcctacctttaacagtccgatgggttggtggtctaaaagaataatatgggccttatcaaactcatgaagaaccctttgaagggttgtttccctgtctgtagaaagcccggaagcttcatagtgaggattcatggttttcattctgagattgagaagaaaatcaatatcagtttcatcagcttttttgtaacgcaggtcaggaatcatagtcagagattagtgttttattttaatgcaattttcagtcccatttcttctttcatatacagcagaacctcagcatttcctctggcatcatctaccggattatgagtatgctctgtttttcggaggtgtttccattgtgcaaaagtatctttttccaatccacaatagagatcggaaagtctcctggaagaaaagccaaaaggatttcgtccggtaaaatgatgaaaataccagcagataaacatccagtcgaaaccattattatcactgataaaaataggtctccctctggaatttgtattaatccactcttcaaaggcaagcattactttttcaggatcatcgaaatgcatcgtttcttccctgctgaagcctgaaactgccagggcctccggattgaattgttcagaaatcggtttcagttttccataaaaggtagtatccagttcttcattgacgagcaccgcaccgaaacaaatcattgaaaaatcaccaggaatcggtccgtccgattctatatcaaccatgaagtagctcattggaaatagtttttacaaaaacgaagatattgaaataagttgaaggagagaatagtaatgtaaggtcaggggaggagctggaagttactattgtatcgtagtgaacctctgtatttttaattttaacttttgttttaaaaacatttcaatcaaaaacttcagatattttacgtctgacaaaaaacttccctcttccagattaccccaagcctacactagctcaaaaaagcttctttttccaatttttatttttgttccgggaatcagctccaactcttcgctggaatctgttattttactattattgatctgaactcctccgttttcaattaatctccgtatagcagatttgctgaggtcattcttaagttgatgacaaagttccacaagggaaattttgttgtcaatactcaaagagttgatagggatggattggtattctttttcttcaaaatttttattctgaaactgagtaataaaaaactgttccgcctggtttgctgcagtgctattatgatattgcgtaataatgttttttgcaatgatttttttaatattcataggattttcaccctctgccatcctgaacagaagctctgctttttcttgcggggaaaaatcagtggtcaggttgataaattcttcaatcaaggcatccggaattgacatggtttttccaaacatttcattgggttcatctgtaagcccgataatattgttcagggatttgctcattttttcttttccatcaagacctctcagcaatggcatacacatcacaatctgagcagacatctgatggacttcctgaagctgccttcccattgtacagttaaaaagctggtctgtgccgcccatttcaatgtcacactcaatttttacggaatcatagccctgaagaacaggatataccagttcatgcatggcaataggcgtattctcagtaaaccttttattaaaatcattacggtgcatcagctgagctacggtgacctttgaaagcagctggattacatctgaaaaattaagtgtatccagccagtctgaattgaacacaatctttgttttccgaacatcaataattttggaaagctgattgatataagtctgtgcattatgttgtacctcttctgcacttaagggttttctagctttattttttccggtaggatcaccaattcttgctgtaaagcttcccacgactataataatctgatgtcccagatcctggaattgcttcagttttttcaatacgaccgcatgtcccagatgaagatccggagcggtaggatcaaatcccagtttgacagaaagttttctgttttctttttttgcctgattaagcttttcttcgagaccgttttccggaaggatgatgaccgcattttcttgtaatgaatgaatcatgttgaatagttttaaaatgaaaagcccggacaggtactgtccgggctctatatatacgtagattattttattggattacagatatagaaagtcttcccgaacgatagtccggagtgtaatattcactgaagaatggaagacgtagtatactgttcagatgtttcattgtgatgtcaatatacaggatttacctgtggagccaatatttaaaccattaagacgcattgcagggttataacaagatttgttttaaaagaaaaacttaaccatccatcaatcttaatggcttaaaataatggttcaaaacaattttacttgcgatttctgaagctaatttcatgccataaatccctttacagcaaaatagaagatcagaatgtacaaactgtattttattattttcttcattagtttgtatgaatttaataaagctgggtttatactctgtttttcggtatatgttttcataagaagtagttttaataatgaattaaatgttttgaatataaatttttgatctgctctttccatatttccaggtcttcagaacttgcccggtctgccttgtcgaaaaataaatgtctgatgatttccagcccggaataaatgaaaatgccatgatcggaagttagtgtaagcgccttatccatccctgtcttttcatattcttcagatgattttccatgggtattgataatcattgttgatttccctttcagaagtcctttctgtacaccctggtcataacggtatgcaaaaccatagctgaacacacggtctatatagcccttcatcatagcgggaagccctgtccaccagatgggataaataaaagtaatctgttctgcccacgaaatatgatcctgttcagtttttacatcatcagatacttttcccatacgttgtccctgcatatcagccagagaaaggacaggatcaaaacctattttataaagatctctcacaataatctcatgatgttgggatcggagggtgtcaactactgtgtttaaaaaattatgatttaaactgttttcattagggtgtgcgtaaatgattaaatgtctcattgttttgatgatttagattaatgagacaaaggtataggagtgagcttttcaaaaattgtaagaaaacgaaacggcctatccggactttggattacagatatcctgctggaatttcagatattgtgcaggtgaaatgttgataaaatgtctgaaatcatggatgagctggctctgatcataatacccgcattcatcaatgatggtaaaccattggactttattctgttttccggtctcctgttcaatgattttgatggcttttaaaaagcggttgtaccggttaatttcctttaaggaatatccaaactgttccttctgttttcgctgaatgtttctctccgtttgccgggtctgttctgcaatgacttttattggatttaaaagatcactttcaaaactgcttaacagtttgccggtcgtgtcctgatattgaagataaggtttgcagaattcaagaatgtaatccacctgtgctgtggtggaatgtaattctgtcagctgatgccacagttcagtaaagcagttttcttccagcaattcgtcaggatgtcttacagattgttcaatagatgctttcccgaaaaacctgtagaatgcatcatctttgaaattggccactaaaatggagcagccggcgggaagtgtataatcaaaggcttgcctcacaggaccgaataccatacatttatcaacacttatacttgtcttttccagggtagacatggtggcactttctccaaaacagaataatagaatcgtctggtaggtgggcaaaagtgttttagtgaccggtctttcagctgtgttttcagcaagataaaaatgcgtgaatatagtttcaaattcttcaggaactgaaattctgaactcattatattccggttgtaattgcattattcagaaaaattaaaaaagactttttatcattttataattggtcaaagttactcctttaacgttgacctcttgttcctggactgcccgaaaaccaattttctcaaaaaacggcctggcagttttgcttacctctgctgtcagttgtttttcacgctgccggagtgcttcattttcaacctcctggtaaagaattgatgcaatgcctttttgctgctcatctttgtgtacaaaaagaagatcgatataatttccctgatcaagagtacaaaaacctgctattttattttcgttgagagcaattataacatactgatctatgatcactttcctccatctttcctcattttcagctccggatttccatgcttcgagctgttgaggtgtataatcttttcgacacactgcatctattgtggcagcaaaaagctgtagcatttccggaagatctgcttctttgccttttcggatgataatattatgcttattggatatattgctgttcataaagcttttgctgttctttattgagtagtggataaaaaagattcatctggagaagcgtataatgctgtatcgcttctttaggactcagtttcaggataagcctgttatgggtaagccagttatctgcaatgataaaaatttgctcggtaaggcagtctacaataaagcggggaacatctttctgaaaaatatgactcttctggagatctgaaaaaatcagttgaaactcttcttttctgctgaaattgatgccctcgtacctggattctatttctgggatctgattcatgatatctataaaactgataaatataaagcggtaggcataaaaaatttcacaagtggaaaaggtaaactgataaaggtcttccagggtcttatattccttctctttcatatggttcagaagctcatccatttttaaagttagctctgaaaaaaaaattttaataatgtcttcagaatgcctgaaatgataatgcagatttcccgcactgatattgagctcagctgcaatatgcctggtagtaatattattataccccttatcattaaataactccagtgctttagacagaatcttatccttggtcttcatagttcaaagataagaatatagagattgaaataaatcatatttttaaaattagaacagatgttctaatgtggtatatttgcagtaacaatcttatcatcatggaaggaaaacagaaattcgattacgaatcagcggaaaagatcgaaacagaaaagaaaacggatccgcaggaagtggtatcaaaaatcctgcagatcatccttggagttatcatggcagtgcttcatatataatgaaaagaagaatttcatattggtttttgctgggacttgcagcatggagtttgattatttttctgaggcggacaggaatttatattcctgttgtcaatgattattttacagattgtattactgttccgatgtattgttatctgatagaatatctgatgaatcctgttttaggttatgattggaaaccagacctgaaatttgtacttacttcagtcctttatctctcatttttgtttgaagtgctctgtccggcgttatccggacattttaccggagatttgtttgatgtactggcttatagtgccggcggaatggtgtattattttagaaagctcaagcctttggaaacaagataaaataaagccggtagcttcacatcgtaaagaagctgccggcggtgctatagtttttatcctgatttgtaatacttaataaaggtgaaggtttagttactgccgcctgcccggtttgattcttcaaatttcacctgcttggtagctcctttcacattattgtttccaaacttgtaggtaagagaaagatgaacatttctggtaatccctttgtactgaaaatcgatattataagaaggataatactcaatccctttttcacggttggtgttcagaatatcgttaagatacagattaaccaacagctttttttccataaatgccagtttcatacccgtatacaatgaagaactgttgtaataatatgaatttccaaccctgttaggaagactgccccaaagccccagcataaaagtgactgttttctctttattgaggaagaaactgttatcgatattaagattggcactgtatcctgcgggagcagtcaagatcgaaggatcatatgattttgattttgtataatatccgtttacaaataccgtagattccagccatttcagcttgttgtagttatagctgatattgatacctgcctgatcttcattgtaaaaatttttagcgactgtgtatctgtaatcgccatctaccatttgtactctgtcccagctatctttattgtaattgtaatataaagtgatattgagattattgttcagaacatatccgaattcaaaattatctgaaaacgtaggtaaaaggtaaggattaccggtgctgtattcatactcggaagtgtaatatttgaacggattcaggttaccgaagtacggacgtgaaattctgcgtgaatagttaagagaaaatgaatgattctcgttcggtttataactgatgtaagcagtagggaaaaacttcccgtaattgatctttgcagaggtatcgtcattcatggaaatcccctccaatcttgtatactcatagcggagaccggcttttgcatcccatttttcactgattttaaaattggtagaaaagtaaacggcataattttcttcattataaaagaatgtattggttctgcccgggttaagatcatactgaccattgttgatattgaaaaaattaaattcagaatcatttttaatcttagtatattttataccggattccgttttgattttagcgaaagttttttcaaaatcagcctgccctgaataaatgcggtatttactgatgggattggccattgtagaaatcgtttcagaagtaatggtattggaaaaatttctggcattggaattattcagcatcagattggcagtaatattcagcttacctcctgcgctgtcaagttttgtttcataaaatgccgtagcgttatggacatccctgctgttccggtttctgaagttggaaagaatattcagaaatccttcatcattggaccttacagcctggctttctcctttttccaaaggattactgtgcgaataattgtaattgattccgataagatttttatcattgatcttgtattcaacctttgcatttccccctttatatttgtagttattgagattttgagtatcccggttccagtaatctttattgttgctggcggaaaggtagttataggtagtataataccagtaattatctcctacggaaagattggtgctcagagacagcttttctccctgataattaaaagtagccccacttcttgctgatactgtaggtctgccccagaaatagttacctgaagtctgaacagatccgttccagcccagattggtgttctttttaagtataatgttgatcagtccgctttttccttcagcatcatattttgcaggtggcgtggtgataacttcaattttaagaatatcatcggaacgcaatgttttcaggtagttgatcagctcctggccattaagattcagcagtctgtcattgatcatcactgctacattactttttccggcaatgcttatagcgtcatcactggtttttaccatgggtgttttggcaagtgcctctatagcatcaattccctgagaggcaacagagttttcaacattaaagaccagacggtctacttttctttcaaataattttttctttgcagtaacggtaaccccttctattttctgttcagtgacaggtgcttctttgatttgcagatcttttctgtgtgttccctttaccgtaattttttcactattggtttttaccccgtcttttatgatttcgaataaatattctccgtcttctttcaatggaattttaaacatccctttatcgttcgtgatggctgaaaacttcacctcatttttggtaatcaggacttcggtttccaatgccggtttattgtctttgtctgtaataattccttcaacactctgcgcaaaaagaaaagacgaagaaataagacttaaaagaatggtaatcttccgattcatattttttagtttatatacaagacaattgttttgtctttgatattacatcggatggtgaagaatctttttattgctggtgcatattgagactttattttaatatttttgtacctgattcaacaagatattttacttccaatgtacgacaagcttttacaaaatatccgttcaggacatgactttagccatgaagagacagaagctgtcaaacattattttgagccggtcgcattttcaaaaaatactgtaatagaagaagccggtacagttccccggtacctttattatattgtgtcaggatacctgaggattttttttactgatcagaatggaaatgaagtgaccacgcatatcaactgcccgccgggattttttacttcctatcaggattttatcagcggtacggtttccgaaaacaatgtggaatgtatcacagattctgagcttctcagaatttcaaaagaaaatctggatgctctgatcagtgaaagcaaggcaatgaaagatttcagtatctctgtttttcagcagtcgattgcctataatgagaaccgttccagagaactgtcagtactcagtgctgagcagcgttaccttaagcttatgaaagattatccggaaattattcagaatgttcccgtacaatatatcgcttcatttttagggatgaagcctgaaagcctcagcaggatccggaaaaaaataattaactaacaaaagtcaagtggttccggtaaagagaaggtgaactttgcagcattaaaatgaatgcaatgacaaagaatcatgtaagtcttgtttccggggcaaacggacatcttggaactaatttagtcagatttttattgaaacaggggattccggtacgggccgccgtaaggaatatcaacaacagaaaaccttttgaaggactgaactgtgaattggtacaggctgatataacagataaagcttctttcgtaaaagctctgcagggtgtggaaaccttttattcagtaggcgctgcttttaaattatgggctaaagatcctgaaaaggaaatctatgacgtcaatatgataggtacccgcaataccatcgaagctgctgcagaagcgggggtgaaaagaatagtgtatgtaagttctattgccgcgcttgattatacaaacctgcctgccagagaaagtaatggctataatccggaccgaagggatatgtactataattctaaaaatgacggtgaaaagctggcctttgatctggctgcaaaaatggggatagagctggtttctgtaatgccttctgccatgattggaagcgaagcatttttaccgctaaatgtttcttatggagtattaaagctgatcctgaacaaaaaaattcctgtagataccaaaattaccctgaactggatagatgtaaaagatgttgcagaaggatgttatctggctgctgaaaaaggacgttccggtgaacgttatattcttgccaatgaaaaatgtatgaccattaccgatactacaattcttgccaacagactttatcctgaactgaaactggaaattccgcgttccgtacctaagggaattttgtttgctattgctgcccttatggaatttacagcaaagctaagtggtaaaccgccggtgctcacccggaaagatattgccatgttttcaggattacagcaggattttgatatttctaaagcaagaaatgagcttggatttaatcctaaaggccctgaaaaggcagtgaaagaagcattagattttcttataaaaaatcctgaattgctgaaagaggtttgaagaagcctttttttttattgctgttccagtttgatgatcggacctttgtaaaagcgggtcagatcatacaggtctgtaaaatgctgctggagatccgggatgaccttaccgtcaaattccttcacattacattggttttctgcaagcaggtacaaagattgattatccggtttcagatactcacagaggatattatcctgatgcttttctttattgagaatttctgtgagaaagatcccatagatcaggaactggttaaaattgctggaatccacaatataattcatgtcctgcttcaggagtttttcgtaatcagaaaggattttaagaaaattttcggcatgaacagttgtcggaatttcataaaaaaggtctataccattgatgaaaagctgtgttttggcttcctcatgatctgaagaatatactttggtaaaccattggaaaataagcaggagttcctcctgggtaagttcttcaacagaatcctttattttttctttaattgtttcaagggtgtttcttgcttcaggctgaagaaatttaagaatattctcttcttcacggctaagcttattgtacaaattaattttggcaatagttggattggttttgatgaaataaagttcttccgccatagttatttaccaaatagtctttaaaatggttatttaaagatacaaaatatgcctcaactttataaaaaaaataatatgtactgaatggtacagttatttttacgtttcaagggtacagtaaaatttttatctgtgtctttaaaaatagatagacttatctattttttgtttagatttgtaaaaatttttcgatgaaaaaggaaaaagtgcgtgacagaattatcagggttgcctcagatctgttttataagcaagggtttaattctacaggaatcaatcagattattgcagaggctgatattgctataggctcactttacaaccatttttcatctaagaacgatcttctgcaggcgtatctgatcaaacaggaatcggattggtttgaaggttttgaaaacagtacatccaaaatctcagatcccaaagaaaaacttttaaccctgattgattacaggaaaaaactacagcagacttcaaagtttgccggatgccattttattaagattgtttctgaaataggagaaggcaatccttccgtatctgattttgcccaaaagcataaagagaagcaaaaggatttgatcacagcccttgtaagagaatatggaatgcaaagacagatttcagatcctgatttgttggcagaaaacatttttttattaatagaaggagctgtggttacttccacaatcaggagacaaaatgattcttttgatcaggtgaaaaaaattgttaagggcttattgccttaatttttttgacttaaaaaaatagatatatctatataaaaatgaaatgtaactatttgaaattattggtaatattattaggtcagttattgataattatggatatttttatcattaacgtatctattccatctatacaaagagacctgcgtgtcggcaacggggaaattcagtttatgattgcagcttatctcatcggatttgcctcttttttgattaccggcggcagattgggtgatgtatatgggagaaagaagatctatatgatcggattaacagcttttatgctgagttcggtggcttgcggaatttccgtaggggcgggccagctggttgtttcaaggtttattcagggggtaagcgctgccatgatggctccccaggtactttcaatgatacaggtactgttctctgatcatcaggaacgtacaaaagcaatggggtggtatgggattaccattggagcaggaactattctgggacagttccttggcggatatttttcctcattaacaatgatggaagaaccctggcggcttatttttctgatgaatattccggtatgcctgccagcgatctttcttagtctgaaagtattgaacgaatctaaaacacctgtgaaacagtcctttaatatgagcggtgttgtaatgctttctgccggattgttctgtgctgtctatgcattaacaatgtctgaacatgcgggaattcaatttaaaaatgttttattgatgatggtttcagtaattattcttttgattttcattaaaaatcaaaagaaaagaatcaggaatgaacgctcttatctgattgattttgaattgttccgatataaaaatttcaaccttggaatcctggccgtttcatcattttttatcatgctggattcctacttttatattctttcacttttttttcaggatggattaaaaataaatcctttaaaagcaggtgaaatcattgtatttcaagggttgggttttattattgcatctgtcatttctgtaaaattgattttacgatatggaaaaaaggccctggttgcaggactgatgtttattattgttattcttatttttcagctattcttattcagaacggaaacaagttttccacttttctgtctgttattgtttcttcatgggttgggagtaggttccattattccttcgctggccaatattgcgttatccggcatgtctgaaaaattgataggaaatgcctcaggggtgtataatacctttcagcagattgctgccatcataggaattgttgctattggaagtatcttttattcttttcttggagagcaacctgcaatacagcattatcaaaaagctttttcggtaaccttgctgatcaatattttatgtttgatcctggtcattgcttctgtatttaaagttcctgatcatgttcttccggaaatggctaaaaaagtacattgacttatattcaaattcaggaaggttattttaatgcagaaataagtaacatcataggcctgcggagttcttccttcatttccggaatttcttttatcatctcttggctgggttcaggttctgtgacttctttgatggtgaagccatgttttaataaagtatttaaatatgacgttaaagtgcggtgatatttgataacattttctcccagaaaagtagtgtttctttttccctccagaaaataacggtccacaggccagctgattttttctccgtttttatcatatatccagtcctggccgccttcagctgtgaaaacagggtgttctactgagaaaacaaatgatccgccaggagtaagccatttgtaaatattatggaccaaactatcgaatgattctacataatgcaaagtaagtgagctgagtatcacatcaaatttttcagcagggtagtcaacatcttcaagggcttttctttcatattgaatcccttctagattgttgatttctttagctttggataacattctttccgaaagatcaattccagtcacggattttgctccgttttccatagcataacggcaatgccaaccgaaaccgcatccaaggtccagcacattcttcccatgaaaatcaggaagcatattttttaaagtatgccattctccggctccttccagtccgatttgagagcggagcatcttttcatactggtcaaaaaatgacgggttgtcgtatttattttctttcataatagcagagaatttatcattacaacatttcttaccgaaaataagagctatgtaaatttacaacaattatatcggaattctgagaggctctgactgaaaagcaaaagctgaatgtcccgcatccagctttatatcattgtttcccgatcaggaattttttagttcgtttccgtatactgttttaaattatcaagaattgcctgccagcctcctttctgcatttcttccggattttggttttcgggatcgaaagctatattcagatgggtttgtccgttattttctttaaaatcgacatgaacctctcttccgtcaggcatagtatatgtaaagtttttaccttcatttatttcattataaacagcttcaaaatcgaaaccgaaacttccgtctttcgcttccattctggctgtatattttcctccgactttcatatcattggaagcggaagggcactgccatgaaggatctgcaaaattccaccgtgtgatatgttccggattggtatagtaatcccatactttttgtgcatcggcattgatggttgcggaaactgtgattttatgactcatgtttattgatttaatgttaatagtaattcatcaagtttttcaagcgttgcaatcattccctgctccatgcccatttcgataatggtttccagatcagttaaggattcatagcttacaatggtttctacaagagtattttcatttttatctgtgaaagttactgtccattctgcctgtggaagaccggtgttgatctctcctttttcattgcagaaggaatcgcttgaagtatatgaatctattgggttgatcttatgatagcttacccaaccccaatattctgttccgttaggttccaccatggcataatgccaatgtcctccttcacggaaatccattgattttgttttggtggtcagaggtttcggggcaaaccagcggtcaagaagttcactttttgtataacagtcccagaccatttgtctgttggccataaattcacgtctgatagtaagagtgttcttttctttgtctgcaagaaaatcgaactgaagatgatgtttcatgatagtatttttatagtttgtttttgattttatgttgtcaaattttatttctgctggcttttcaatgtggccagtaaagtgtcaagctgttcgaagcggctttcccagatttttctgaactgttccagccaatgatctatttctttcattttatcaatttccaacaggtaataaatttctctcccctggtgattttgggttaccagttcgcactccgtcaggattttcagatgttttgaaaccgcctgtcttgtggtgtcaaaatgctctgctatggcatttggtgtcatggcctgtactgcaatcagtgcaataatggcccggcgtgttggatcagctatagcctgaaaaatatctcttctcatcaataacaatttttaaatgaaaccatatggttgcaaatatatgtgcaacttttcggtttcgcaaattttttctgaaaaatttattcctcagaaattaaaaatgataaaatagattatgtaagcgttttgtaatcagtagtttgattattaaaaagttattttttgttttgtctcatggctttaattaatttttcattccgtttatctgctctttcattttgtaaagaaagtgcagcccaaatggcagcagggagccagccgatcagagtgatctgtaaaatcagacagataatcccagtgaaaatttttccacggacaataaaggataagaagggaagtaagatagccagtaacatgatttgagttttaattaaactgatttttaacgcgattgaggatcaaaataggctttaaaagtaagaggatcttccattttatcctcagcttcttcaagatattcaagatactcttcctgatgttttcccatataaacaagcacaatggaaaggttgataaagaggtttttgtcttgagaacccagatttaatgccgtctttaagtactccagagccttttcattctcacccatatcagaataaacagcacccatattgattaaagcagaagtattttcaggctcaataagcagaatttcttccagctctctcaccagcagatcgtttaaagtatcccaatgatcttcattttcccatcttttagcctgaagtttttttacgttttctaatcttagtgttatactgttcattacttaaattacaaatgaatactattggttttctgcacaaatttagctctctctgcgacagatattttaatttttaacagaattaaaaaaagttatcctttaagtccatccaatattgctgctttcaggatttcaatgttgatctctttcaaagctttgaatttaatgcaatatcctgtaacactggctttacctattttttctccataagtttcaggtaaataggttttatcatcaatattcataacatagacagagatacccgtcgtattggcactcattccaatctgatagaagtccctggttttcccatcggcatattgtaatgtataaaatccatatccgatattgggattggaaaccgttttattttgactgtttttccatccagaaaccatagctggcattcggatataagctccagaatgatgcggttgagctcctgcacatcattacgttttttcaggctggctattgagatagtcctggatttgtttttgaatggtcatggataatatttttaatttattatatcaaagtatatttcatctatagaaatattattactaatttgttctaaagtaacatataaattaattttaatataatttaactccatcaagccctcggcaaaagagttgtaatggtactttttatcaaaccctatttcaatttcggcctctatctcttgttcaaactttataattacatctttgtttgacatttcatatacatagaaattttctgaattaccaaagaaaactctatttaattttactttaccattggcttttaaatcaggattttgtttttcaaaccaattgcaaatttctttgacttcatatacttcaaaactttctttaattttttctaaatataaatttttgtcaatattgatgttcaaccactcggaactaatggaatttatatgttttgaatgcttttctatgaaatctttaatattactaaaataataaatttttgtctcaaattttttaatttcttctaataataatggatgtaaattattcttattattttcatcagcaaaatctttagcattattacttataaatataacactatccttatatggatacattttaatatattctataattgattcccataaaactgcatctttaaagccgacaccatttattctaaaaggtcttttcttattaactgctctttgtattattttattaaacgatgaattttccaattcaaaaatttcattatattctgaaatctgaaatttttccaataagttatctttgaatattttcttttgcttttcaaaatctatatcttttgtctcgattggtccttcagctaataatctacttaattcgaagtttgttcttttaaagacatcatatttttcttttaattcttcttcatatagcttttcaatttcttgtaagactatatttaataaaactaaattagagtgagttttttctatataatcaaatatgacttcaaaatcttttgaattaagaaagaaatcagttctaagtatatttgtgtcaagaataatatccataaattaatttttaaaacaaccattttgaatgataagcatcagatctaatgtggaaatgtgggaaactattaatgtagaattgattttaagtttactaagtgactaatttataacaaaaaagaacagcgattgctgttcttttgtactttattatttttgatttactgaatcagttcttccaatgttttatccgttttcatcagctcaccctgtgggatctgatgatgaagataagtgaaaagcaaattggttacccaattgttttcaatttgatgaacagagtatgagcatattaaaccaaaatcatcagaaatataagccggaaggtcagaggaacctgtagttttgaagacagatacaaaaatttcctttctgatatcactgattctgtcttcaacctcctcatcagcaaccttctcttcaacagtgtgataggctttcatccatgcatcagaaaatgctgccgaatccctgttatcaagaatctcatcaatcttttcgggagtaataccggtaagtgccgttttcaaagcatcattaaaaatggcttccagcttattgattttttctgtcataatttgaatttatattctatccgaacgctcttttcaataaactttccacttttggctcgctgcctctgaaggctttatataattccatcggatctttggttcctcctgaagaaagcaagactttatatttcgctgcaatctcaggattgaaaattccgttttctttaaaatactggaaagcatcagcatccagaacttctgcccatttataggaataatatcctgcagaatatcctccctggaaaatgtgtgaaaaactcggactcatagctgtttctgaatgggaaggataaagacttgttgcttttgtgtatttatcttcaaactcttttacactttcattttccaattctttaacttttgtatggtagttcatatccagaagtccgaaacccagttgtcttaaagtctggtaaccctccatgaagtttttggattgctcgattttttcaattttttcgtcaggaagaacttctcctgttttataatgttttgcaaaagttttcaggaactcaggctcatagcagaagttctcaagaaactgcgatggaagttccacaaagtcccattttactgaagtacctgacagggtaggatattgggtatctgccatcattccatgaagtgcgtgcccgaattcgtggaataaggtagtcacttcctggaaggttagtaagctaggtgtgtcttttgtcggtttactaaagttgcagacaattgagatgtgcggacgtgagttttcaccgttttgcttatactgatttttatagctggtcatccatgcaccggctcttttcccttttctcgggaaataatcaacgtataacaaggatttataagttccgttttcttttacttcatacacttttacatcttcatggtatttcgggatatcgtttctctcttcaaaagtaagcccgaataatttacctgccagtccgaatacagcatcctgtacctggtttaacgggaaataaggcttcagttcctcatcattaagatcaaattttgccttacgaagtttttcagcatagtaggcgtgatcgtagctttgcatctcctcaattccatcggctttggctaaagatttcaattcttcaatttctttatccgcatagggctttgctttggttaaaagctcatttaaaaaatcaaaaacttttaccggagattttgccattctttcttccagaacgaaatcagcatagtttttatatcctaaaagttcagctttctgctgtttcagatgaagaagttctttaatcagattctgattatcaaattctccgccgtcgaaagattttttaccattggccagagccagttcctttctcagttcacggttttcagcataggttataaaaggaatataacttgggtattgtaatgttactacccagccatcaaggtttctttctttggcttcttcggcatattgatctatgatggcttcgggaattcctgcaagatcttccttattggtgatatgtttaaaataagcattggtagaagccagtacattttgtccgaactgtaaagattttacagaaagatccatacttattttctttaatttttctttgtcatcctcattcaataaagctccgcttcttacaaaacctttgtaggtttcattcaaaagcatttcctgctcttcattgagattatatttttccttttcatcgtatacctttttgattttgttgaaaagggcttcattctgagatatttttgaagaatattccgttaagatcggcgaaacttcctgagcgatctgttgaatttcgtcactggtttccgctgaatttaagttgaaaaaaatatttgaaaccacatccagctgttccccggaataagctaatgcttcaataacattttcaaaagtaggtgcttcaggattgttgacaatagcatcaatttctgcttcagatttttgaatcagttctttaaatgctggaagataatcttcatttttaatgtcactgaatggtgccgaatggtatggagtgttaaatttttctgttaaaatattcatttttcgatttttattataagtaaatgtaatgattcgccgggaatcacggctgaaatgctcaaaaataatgccttactggcaagttatgacaaaaataccttatctttaattaatcttgtcatatggaaagaaggagtgatgtgggaatatttaattttgggaacagattaaaatcatcattaaataatataaccttaaatatatagactatgaaaacactcttaaaaattattggtatcatcatcgtgctggttcttatatatgctgtaattgccgtgctggctttcagtaaagattatcactatgaaaaatctgttgttatcaatgctccgcaggataaagtatggccttatgtaggcacattaaaaggatataatcagtgggatcctttttccaaagctgataaaaacattgttattacctactcaggaaatggggataaagtaggcgattcctatcattggaaaggagataaaaatgtaggagaaggagagcaggctatcactgagctggttcccaaccagaaaatggctacaaaacttcattttataaaaccttttgaaggagatatgaaggctaatttcgtaatggttcctgaaggaaatggcaccaaagtaacatggatgattgataatgagctgactcctatgatgaagatcatgaaaccgctgatgaacggtaatatggacaaaatgtttagtcagggactcggagatctgaaaaaacttgcagaaaaataaaatgaaagccttgtaaaatctacagggcttttttttattttaaatccttttactgattcgattgagaagaaaagttattttatgccatgtcattgaaaattattttaaaaatattatctttatataaagaatcgattgtatggagaagattgtatttgaaaaaagtgatatcagagactttgtgaaaatgactatcgcagagaaaatagaaaagcttaaaaactttatcgaatttaccctggaagcaagccgtgacatcaaaaaaactcctaaatatgacagtatgagagaagaaatgcaggaggagatctaccagatgcagcgacagctgggtgctttgaatgatcttaaaagaaatatggcaaaagtactgaatacagctacccaaagagttcagcttggttcgttggtgatcaccaataaggcccggttctatatttccgtatcattgggagagttcttttttgaaggcgacagattctacgccatttctccggaaagcccgatggctaaaaagatgatgggaatgaaaccaggtgatgagtttaccctcaataaaatccatcagaagattgtagaagtgctgtaatgtgaatggtggattttccttgtaaacagatagctataattctgataagcacggcttcatattttattctcatttaatataatagttgttttaaatacagcagattgaattccatgttgtaaatttgcaggtatgagtaaagcaaccattttaaaagaaattatagaggagaggagaagtattttcccgaaagattatactgacacagaaattccacaggaagttttggaggaaattttgcacgcggcaacattggctccgaaccataaacgtaccaagccatggcgttttaaaatattcaaaggcgaagaaaaagctaagctggctgcagaaatgcaggcaatctataaagcaacccaacctgaacagctttttctggaaaaaaaatacaatgacatcggtttcaaaattaataaagctgatgtagtggtttccattattgttaatttcagcggaatggttcctgaatgggaagaaatagcagctacctcaatggctgttcagaacatgtatcttacctgtaccgccaacaatatcgggtgctactggagctctcccaaaattgtagatcacttgaaagactctcttactatcgaagaaaaccagaagtgtctgggacttttctatatgggtagtttgtcttaaaatagccctggtcgagcggcatgtctgagctctttttcttgtaaagaaaaaagcgagcagcgagagcaggttcccggctcctgagaaaaaataatcagaaattctaaaactttttgtccggagctttttactttcaacttttttactatctttgcactcttaaatatttaactgggacgagttcccataaaattcaaacattatgtcagtaaaaatcagattacaaagacacggtaaaaaaggaaagccttttttccacatcgtggttgcagattctagagctagaagagatggtagattcatcgagaaactaggaacttacaacccaattactaatccagcaactatcgaattgaatgttgattctgctgtaaagtggttaaacaacggtgctcagcctactgatactgctagagctattctatcttacaaaggtgctctttacaaaaaacacttacaaggtggtgtagctaaaggtgcttttgacgaagctgaagctgaaaaaagattcaatgcttgggtagaagctaaagatgctaaagtacaaggtaaagtagaaggtttagctacagctaaagctgatgctaagaaagctgctttagatgctgaagtaaaagtaaacgaagctagaatcgctgctgctgcacaagctgaagctgatgctaaagctgctgaagaagctgcaaacgcacctgctgaagaagttgctgaagctacagaaggagaagctcctgctgctgaaactgaagaaaacactgaagcttaagaacaaaccctgttatgcgtaaagaagattgctattttttaggaaaaatcacacgcagacatggacttgcgggtaacgtaatccttaaactggataccgatcaacccgagctttacaataaattggaatcaatattcgttgaaatcaacggattattggttccattttttattgaaaaaacatcatggagcaagcttgatgctctgaatattgcattcaaaaactcttctgaagcactggtagatcaggttttaggtaaaagcgtttaccttcctctttccacattgcctaaactttcaggaaaacaattctattaccacgagattatcggatttgaaatttttgatcaggatgatcataactgtggagtgatcagatccgtaaacgatcagacggcacaggtgtatttcattacaaatctggacggaaaagaagtggtgattcctatgatcaaagactggattcttgaagttgacagagaagaaagaaccatcaaaatggaacttcctgaaggtcttattgatgtttttctgattccttcgaagaaagacgaatagttttgcgataagctattctttctcacttttctcattactcattttattactgattattcattactcatctttaaggcgggtaaaagatattcctgtactattttatcggcttgctgatgagcataaggtttgttatatgccctggctgtaatcacaatcacaactggaatctcagtaaacataatgattttatttcctccgtttccgctggattgaaatgcttcaaagctgctatttccagcagtgtaaacttttctccagaataaatatccgtagccttcaaaatcagaatgatctgtaaaataattggtgaacgatttctttacccaatctttatataaaatagtttttccattccagaccccgttatttttatacagctgtccgaattttgcaaaatcgagagttctcatgcgtaatcctcctgccagtgaaggcttttgctgtggagtgaattgccattgataacgggtgattccaagaggctgaaacaactttttgtctgcataattttttaaaccttcaggaactgctttatccagaatatctccggttactacaacgcctgcagtgaaataactccattttttccctatttcattcccggacattggcagatccaatgcaaactttacccagttatccgttggatacatattttcttcattgccggaagattcggaatcatcatcatttccttcaaaaccggagctcattgtcagtaagctttttatagtgacattgtctttttgaacagagtaatttttaaattgctttaagtcataaaactcttttaaatattggttttcgctctttaaatacccttctttgaccgcaattcccgttaacgctgaagaaaaagatttgcctactgatcttgtatcctgcagagaatctctccctgaaccgttaaaatattcttcaagaagtagttttccgtcttttatgattacaattcctgtcagatctttaaatctgttttcagcaattttcctattcagggttctgatgatttcagtattaattttttctttggaaatcttccagccgctgttgggcagaacaggttgaagagcgatctgtttttccggaatgttttgggaaggaacagtgaggttaatctgcccttctgcaatgacaggtcctgttttgatgttgctcactttcagataaggacggatttcaatttttaaaatgtgatttcctgcagtcagcgcatcaattccgtcatgagccatgtaaaaacgcatccataaataccttccccatgagtcttcattcttactgctgagaagaggaatccgtaatgctgttttgaattttttattttccggggtaccggctccagtgttaagattttctgtgtagatgagttttccgtcaacatagaatgaaaactggtaattgccgtttttcaacaactcatctacagtcaagctgggttcaagctgatgaagataattaacaagtgaattgtcgaaaaaagcgtagatacccaaatccccattttcctgaaatagggaggaagtaagaatatccggatctttaaggttttccagggaaatagctttattgagaaaaataattttcccggaatattctttctggaggagattttcaattttttcaggattgacaatattgccgttttgcccttggtaaagacaaaatataaaaataaagatcaataatagaaatggtttcatctcaaagaagtatttaaacaaaaatagtaaacttcttcagggtaaaatagaatgaaattaacattactgcttacaaatcaaatctttaattgaaaagttttctgaattctcccggcgactgatttgttttttgtttaaaaagtttgctgaaagactgcggatgttcaaatcccagctcataagcaatttcacttacagacagactcgttgtgctcaaacgttctttagccagatcaatcaatttattttgaatatgctgttgtgtattttgctgcgtatgcagacggagcaaagttcccagatagttgggcgaaatattcatttgctcagcaatacatttcaccgatggaatcccgttttcaagaagattgccgttttcaaaatatcgggaaagaatatcttcaaacttatacaggagttcatggcttgatttctttcgggtaaaaaattgcctttcataaaatcggtctgaataaatcagtaacaattcaatctgggcaataatcagatcctgcgtgaatttatcgatattggccatgtattccctttcgatatttttaaggatatcaacaatcactttctcctctttatcagaaagaaaaagagcttccttcacctgataactgaaaaaatcataggattttattttcttggttaatgaggtattccacagaaaatcaggatgaattaacagtaaaaagcccgttggttccacttctacatcaggatcaatctccagacttaaatactgttgtggtgaaacaaagcacaatactcctgaatcaaaatcgtattgctgctgtccgtaattgaatttcggactgacattttttttcagaccgatagagtaaaaattctgaatccagcttaattcttcattttccacaacatagcggaccttgctgtaatctatgaggctgatcagcgggtgatcaggattcggaagaccacagaaagcatgaaaatctgaaatggtattaaaacgaacgggctgtttcataatagctaatttagttgtttttgtaaaaagtttaatgaaagacttcggctctgttttgattaagcagagccgaagaatatcatagtaaagctagatcgcagttgaaactgtcaggttttcccatttttcagcatctttctttaaaatatcaatcttattgttcagaaactccatggttcctactcctaataataaatgtacaggaggatttttctctttgctgatctggatcagaacatcggcagcttttaccggatcattcggctggttgccattgatttcattaaggtgggcctgttcagaacttcttgctgcttcataggcctgaatcggacttgaaggggttttcacagagtctttattcaagaaatcggtacggaaatagccgggataaacaacggtagcatgaactccgaagtcttttacctcttccgccagcgcttctgtaaaaccggcaacggcgaattttgtagagcagtagattccccagcccggaaaatttcccgaataaccgccgaccgatgaaatattgaagatatttcctgatctttgctcacgaagataaggcatcgcatttctgatcacgtttaaggttccgaaaacattcacagcataattttctctggcttcctcgtcggtaagctcctcaagagttccgatctgtccgtaacctgcattgttgaccactacatcaagtcttccgaaatgatcaactgttttttcaatagcagatctgatatcattgttgtctgtaatattgacgctgagaggaaggaaattttctgaagtttctccgattgaagagaccagggattcaacggtacggctggttgcagcaacctgaaacccttcggataataatttctttaccaactcgaatcctaagccttttgaagcccctgtcacgaaccatactttttttgtttccattgtaaatatttttttgtttaaatgatggtacaaagatggaaagtcaaaaagaggaaaatgtagccgaatcggggaatgatgtatccaaatcgtgaatgatgatttaatccgggaagactttaatagtttttcagaatattcctgtatttcaaaggtgtaatgccgaggctttctttaaagcaccggataaaatgactctggtccgaaaagccgcattccagcgcaatatccgttaaagaagaaggagagtggagaagtttcattgacttattgatttttattttccggatgtattctcccaggttgcaatggaaatatttatgaaaatctctgcttaaatgaacaggatggatattcagggtttctgaaattccggtaagtgtaaggttttcagcagcgttctcgtgtaaaatctcattaatctgatttacccagacaggttttctttctttacttcctttttcttgagtcagttcgctgaaaagatgcaacagaagctgattgacggaagattcaaaagaagtgtcattcattttggtttctttgaataactgccagatcaggagttttaaagccggattttttatggcaaagctgccttcggctttatttttcgggatatcaaactgatcaaaccaatcttgagtaatttctatgtggaaaccccgtgtaaaaatatcaggtttaatattataatgtggatcttcccaatgatgatatagcaatgttccggcagagcagccgtaagtttctttccggtttccttctgtcatattcccctgaagcagaaaggtaaagtaagcgttctcatgataatgccagtctacatagggatgtgtatattccgtatcagtaattgtcaatccatctaaattgatcatctgatgggtttccccaaaatattcgccgtttcgaagagtattcataatatattctgttttaaacggtcaatctgttcatacattttattaaaaaatattttcctttcccggtttccggattcattcagagattttgagtttttgatctgatgctcaaaatagctcagtgaatcttcacaggttatcttgtcattggtcatcatatatccgaacatactgaaagggacaaaaaaagaacactgttcttcatttttgaataaaatactgttgtttaaaatgaccaaatcattcacatagatctgaaaattagttttttccagcgttttaatttccaggctttccaatagttttttcagatcatccaggataagagctgcttcatttttcttcagtaatcccatttcattataaaacgaaatctgtctcaaggcactcataatggtagtgtcattccagatttcagttacgttttgtttatcataaagctctttcagcatttcattttttacagaatgatattccattttaaattcatggaacggacttaaaaacttatcctgattcagcagattcatccagacataaaacttgaaacgggacaggatagaatctgaaatggtatagaaaaaagggatgtcttttgcagaataaaatactttggaatcagcaatattctgaaaaacattcagaatttttaaagagttttcaaagtaattcaaaaggtcttctgtggtttttacaggctgtgttcttttgacaaccaactggttttctgttcccagaaactgatccagtgagatctgataatatctggcgagttctagcgcttcttcaaaactgaatttagctttcatagaagttcttctgtgcgctgcatcgtagctgatattaagaatattggcaatctcatcatttaaagatttttcacctatttttcttcggatttccttcaataaagcctcctggtgcatagttttgcgattttcacaaatgtagtgttttttgtggagaacgtttttgattttctgctttgaaggctggaagcctgaagctggaagaagggaagtattgaaagtcaaaaaaataaatagctgtttacgacatcaatgggatttataatcactattgctatttatcacttaaagtaacttcccgccttcttcttcttcccgcttccagcccgcttatattagttaacacttcatttcgttatctacatatttgtgattttcgcaaacaggataatttttttaattttttttcacattcggaactgtaccttctgccgataattttgaactgtaattttaaaataacgaattatgaaaacacgaattttaataacagcagttcttttagtccatggtctgatatacgcatcagacagtctgaaggttgattctttgaaaccaagattaattgcagcatcaccctcaaagaatgtcaggaatgtcaacgggattttatttaaatattttgatgaggaagatcattttaaaccaaagaaagtaaatggcttaggcatgggattcaattttgtgggcattttcttgccgccattgatgcttttcaatttacagccaccaggaaaccatgattatgtaattgttcctcgtaaaaagatgaataccattaacggactgcagttgtcaatcatcaacatggagcctactgtcacaaacggactggaaattaatgtatcgagtaatatcaatacgtatgcagtgaccaatggaatgtctgtttctccgttttttaatgtgcatcacgagatgaaaggtgtttctgtagcgccattagccaatatcgggcagaaatgccggggaattcagatcgggttgtataatcaatgtaaggatttcagaggaatccagattggcggatggaatgagaacggaaggagaaaacttcctctaatcaattggaattttaagaaacagaaagtaaataagaccctgcaggagagtaaccaaaatcagtttaacccttaaataaccgaccatgaaaaattataaactgatcttatttttattgatgttatctgcacgcattttttcacaaaatacaatgaatgataccttaaaaacaaatattgaagaacctttcgattataaaaaatattatgattgtgattttggagaagggaatgttttgattgtcattaaaaaaggaaatgaatttacagatcttacggatttaagaaaatccggaaaaggttttgccattaaaatggaagctatttatagtatggaatttgcggatggacagagatatgagtcaagtgtggtgaaaagtattacccaggacagtatttcaatcacgaattttttcaatgagaatgctgcgaagcttgcaggacagccctttaaattaattacttatcctctgtcatctttgaagtatgtccgttttattgatgacagaatgttgtccttgtatagcaaaagaaatatccagaagaacttcaatatgatggtgaagaaaatggaccgcgctaaaatgtgtcctgcagtaattcaatttaaagatagaaacaatgaaatgaaagtctgtcatttctatctgacctcttagggctatgatcttctctatgagaacaacggaagagtatattatatggaaggtaaaatagaatggaaataacttttgaagagagtgcattttcagcctgtactctccttttgtatttatcatcattaagtttaatgacaatattgatgaatacgttgaaaaaagcaaaagcaatggcacttgtactgaagaaaaaataatatttttgtaatatagctcggatgaatgatgaaaataaaatgtttaatactgttttttattattggaaatctgttttttcacgcacaaaccaataatttagaaaaaaatactcatgaaacacggtcttataaagaattggaaaaagaattctacagcagtcgtttcggagatgtaaacagtaaaagtattgcagaaagttatcttaaaaaagcaaaatctgaaaaaaatattactcagattgctgaaggatacgttatgcttcattttgaagagaatctgcccaatgcattaaagtatcttgacagcttacagcatattaccaggaattattccaaagaaaatatatatccggccagaatctatctcttaaaagggaatctgtatttcaggaatgataatcttcagtctgcactgaacaattatattttaggattgaaatatgccaaagaaaaaggaaataaaagacagattgccatggcacatatcagtattgcctatcttaataattatattgggaaacatgctgagacagccaaggttttaagacattatgcgtatgatgctgattatatgactcaggatgagaagaacggtctcaagttaaacctggctgacgcatacatagaaatcaataagatggattctgcctatatccttataaaagaaggcttactggattctaaaaagaataaggatgtttaccgctatcaccagaaccttggaatgttaggatattatcatctgcattcaaaaaactatcagaaagcgatcgatggtttattagagtgtgaaaaatatttctttaccaataataacggttctaaaaggaaccagcattatacttctttgtatctggggaaatcctacgccggtctcaacgaaaaagagaaagcggtagagtatttccggaagattgattctatggttcttaaaaccaattacatttatcccgagctgagagatgtatatacttacctgatcgattattataaagaaaacaatgataaagaaacacaattgtattatgtagatcggtttttaaaggtagatcatgttctggatacccagttcaggtatatttccagagaacttcccagaagatatgatactccggaactgcagcaggagaaagaaagtattactaatgagcttaccaaaagaaaaagtttattttatattgtactgagtcttctgttgatatcacacctgttgtttatcaacgtttattttaaatataaaaaatccgaaaagaactataaaaaaattgcccaggacctgattcagtctgttaatgaaaataaaataggcaaaaacaaactttcggaagccaaagaaattcttcctgaagtttctaagttagaaaatacagaacattctgaggacaaaacaccaagaacgatttccgaagatattgctcaaaccattttaaaagaacttgaaatatttgaaaacaaagatcagtttttgaataagggaattacgctgggaagtcttgctaaaaaaataaaaacaaactcaaaatatctgtcggaaattatcaatacctacaaaggaaaaaactttgccacttatcttaatgatctccgtattgattatgccatcaacagattggccaacgataaaaaattcaggtcttataagattccatttattgccgaggaactagggtataataacgaacaggcgttcactttagcgttcaaaaaacgaaccggtacaccactttctatctatctgaaagaaattgaaaatatgtcttctaattaggagtaatttattgattttcatttgtttgaatttataaattcatgattttaaatatatagatttatgaatctatagagcattcacttgtatcattcttcctcttttctgcatctttgcttcaggtaaaaacacaatgtttcattttgtatgtgcacattacaaaatatcaattccgggttgccggttaattaaaagaactttataacaaaattattaacgaactggtaaaaatgagaaaagataaccagtaaaaaacaatagctaaagaatgaagtaattgttcatagttcagagatgtaaaagagtggtgatcatttgaaaaatcattgaagtaattaaaaacaaaattcgcagaatccatccaaaagtgtttaaaagtgtagtatagtttaatttggattcgctgacctgtagttgatcatgaaattattgcttaaaaactaataaccatttcaatacataaaaactaattccatgaaaactcagaataaattaaaatttattctttctaaaagtgataaggttgagtgattcactccggtcagatgcgggtttatcttgaagttcaggacaatattgagtggaaatgtatccttacaatgaaaaagattgagcagcagaaaaaggtaaatttcctggactgaaagtttaaatgcttgttaaatgatttttaaagacggcgcaatcattaagttgcgctgtttttttgtaactttgcagacattaatttttatataaaaaatttatcatcaacaaatgaaaaagcaaacgatcaaagaaatcctgagggattacaagaaagtattacatcatgacattacagtttacggatgggtaagatcattccgtgctaatcgctttattgcgcttaatgatggttctacgattaataatttgcagatagttgttgatttcgaaaattttgatgaagcaatcatcaagaatatcagtacggcttcatccctgaaagtagtaggtgaagtggtagaaagccagggagcaggacagtctgtggaaattatcgctaaaaagattattattttaggggataactttacggaagaacttcagagtacaattcttcagcctaagaagcacagtctggagaaacttcgtgagcaggcgcatttaagattcagaacaaacctttttggagcagtgttcagagtacgtcacgcagtaagctttgcagttcactcattcttcaaccagaaccagtttttctatatcaatacaccggttattactggtgctgatgcggaaggagcaggagaaatgtttggagtaaccaactttgatctgaacaatatgccgagaactgaagaaggagagatagattttgcacaggatttcttcggtagaaaaacaaaccttacggtttcaggacaacttgaaggagaaactgcagctatgggattgggaagaatttataccttcggacctacttttcgtgcagaaaattccaataccacaagacaccttgccgaattctggatgatagagccggaagtagctttcaacaaccttgaagacaatatcgaccttgcggaagatttcttaaaatatgtgatccagtatgtattggataactgtaaagatgatcttgaattcttagacaagcgttttgaagaagaacaaaagtcaaaacctgaaaaagaaagagcaaaagaaggtcttatcgaaaaacttcagaatgtagtggcaaaacgtttcaaacgtgtaagctatacggaagctattgaaatcttactgaactctaaagaaaataaaaaaggaaaatttgcttacccggttgaaaaatggggaactgatcttcaatctgagcatgaaagataccttgttgaaaaacatttcgaaagcccggtagtattatttgactatccgaaagaaattaaagctttctatatgaaactgaacgatgacaacaaaaccgttgcagcgatggacgtgcttttcccaggtatcggtgaaatcatcggtggatcagagagagaggcaagattagatgttttaaaacagaaaatggcagatatgcatgtagatgagcacgagctttggtggtatcttgataccagaaaattcggttcagtaccacatgctggttttggtttaggactggaaagattagttcttttcgtaacaggaatgacgaacatcagagatgtaattcctttccctagaacgccaaaaagcgctgaattctagaacaataaaaaaagccttaatcacaagttaaggctttttttattctttaatagtttattatgttgggataagtaatgcaaaaatcatgctaaatgcgttttttatcaaataaatttattaaattcgtagaatatgttatgttaaaacgtaaataaagaatatgcttaaacaacacttacaactcaaattaggacagaagctggcccctcagcagatccagttgatgaagcttattcagcttcatactcttgaatttgaagaggagttggaaagagagttagaagaaaacccagctttggaaattgcgaaagaagattctaaggaagatgattattcttcccttgaagacgcttatcaggatgagggtacagaaagcattgaaacagatttcgacgtcaatgaatatatctatgacgacgaaccaagctataaaaccgcatccagcaactactctccggatgatgaagaatttgataacgagagtcttttaacggaaggacagtccttatatgattatcttacagaacagattcacctggtgaatatcagtgatgaagatctgaagattgcagaatatcttatcgggaatttagatacggacggctatctgagaagagagatcaaatctattgttgatgatctggctttctcacagggaatttacactactaaagaaagagtggaggatatcctggaaaattatgttcagaaacttgatccgccaggagtaggagcaagaggactgcaggagtgcctgttattacagattgaaaagaaagtcagctcagataaagcagtttctttggctgccaacatcctgagacatcagtttgaagctttgacgaataagcattataacaaaatcatccagaaatacgatattgaagaagatgatctgaaagatgctctggatgaaatatcaaagctatccccaaaagtaggagggaactttgatacacagacaattacgatcaatcaggaaattatcccggattttgttattcaggtgaaagacggtcaggtaattcctatgctgaacagcaagaatgcacctacattaagagtttctgaagaatacaaagacattcttaccacatattcccacgataaaaactcatcagaacacaagcaggcagctttatttatcaagcaaaagctggatgctgcaaaatggtatatcgatgccattaaccagcgtcagaatacattgttgcagacgattacagccattgtgaaatttcagaaggattatttcatcaccggagacgaaaaatctctgaaaccaatgatcttgaaggatgttgctgatattacaggatttgatatctctacgatttcaagggtggtaaaaagtaaatatgcagatacacctaacggtattgtatatcttaaagatctgttctcagacagcttaacgaatgatgatggggaagaagtttccaccaaggaaatcaaaacccatcttcaggaagtgattgataaagaaaataagagaaaaccgcttaccgatgatgcattagtggttattctgaaagaacagggatataatatagcaagaagaacgattgcaaaatatcgtgaacagcttaatattccggtagcaaggttaagaaaagaactttaatcagataataaaaaggtgaataagcttattcaccttttttatttcaaaaataattctgaggccattaagaaatcagaaatacctgatcgctgatctttttgaacagactgaatgtattaacctgttttcggtattcattgttttcccaatatacttttccattcttataatcattcagaagtacaaagattcctccattgatttttaagaaggcaatagcgggaaaactgagttcctccatatcctcccagtgatcaagtcttacgaccatacattcaatatcaaagtcattttgtaatatattataaaagctgtagaagttataatcttcgattggtaagttataatcttgtatttttcttgcttttttatgctgctgtacaaatttctttaacaaaaaattaaaagatcgtaaatactcacattttttaatcataaatgttgaaatttttaataaatatagtatgcattctctgttacacaattctttacattctttatactgattttgtaaggaatgttttctttatttttataatgaaattcaatagtactaatattctttttacttactcctatccattggttgcccttaaggttataaagaaaaaactgattataatgaaacatattttcaactttgttaataataatcagtttgtttttatcctgcggatagaaggtaatgtgggtttttccgattttataagactggtcttccaggaaattgacatgctgtttccgagtataagcaagaagtttagatttcaccagtaaaagcctgtaacgtgtattggtgattcttttctctatcttcctccggattttttttataggataggagatattgttagatctgtaatgaattccccgaggtgaaatggaaaatttaccctttgtatcaaacggatctataaagaaataaggattgtctttaagattgataagatgaatcagcaggtactgtttttcagtcaccgtattgaaaatattaccttccacccagtgatgggtggcatcggagtaaacgaactcctgaacgatgtttttgtgataatatttaatttctttctgaagttcaagcttccggacaaccagtgtgaagctttcaatctcagtcgggatatcagtgatatctttggtatgaacaagattaaattcaaaattacattcgtcaaaacaaaaatggcgggtattctgaagaatatgtgcatagtccttactctttttgaaaagattgatgcattgctcattgttcttcagtagagtgaaaaatccggccggatagtttttgtgaggtgagattacatcatatttcttcaatattttctctgtgataaaataccgtatattcccgaagataatatcaatgtcacaatatccccagaagtcgtattcctttaaatagtcctgaaatatcaggccataggtaggcttaaaatcacatagtttgtaaccgtccagaatgctgatagaaagattcagcttttcactggccattttactgaattcggcgagactgctgatcttggtaaaatgcacattcggtaaatgaaatggcgcttccagattggtaaataataaaaaatcaacatccggattgtatttgcagctgtataaaaaatgattgaaatactcaggccagcttttgccaaaataacagtttattaatgcgattcgggtcattttacgtcagttttttaatattcagcaatgagtcatagctcttgtgtaaaaaataatacagaatagactcgtggatattcggttttgaagcaaacattctgttgataaacatatgaatatagcttaccatcaatgatttaaccatttgctgagattgtagttctttaatctccgtaatataacgggcggtttttttagttcttatatccagaatttcagaaaactcatgtgtacccgtaagaagctccagggtctgatgcctgtgattcctgtatttatctttcaaagtctgtttagaattatcatccagcaagcttccatatccattggcaagctgttgcaggatgtctcttttttccgtcatcgtatatccgaaatcgtcaagaatatggttgatgcctgctacggcagctttccagactggagtttttgtgtatccagtttctttcagtaactggcagacacattcactgtcgaagtaaaaaatactttccatctgatctatcgtagtttcgccatagcgttcaatttccctattgtaagtatccagcataattttatgaataatcatttcccgggtcagatatttgtccagtaactggtaaatttggctggaaagtgtatgatcctgagatgtagtcagaaacctcactctgatatgcatgtccggatcgctgtaacggataaagaaccatttttttataattccttttctgacaagtcccttagcgaatttatagatggtatctttaatgatctggtccgaaacttttgtgctgcaatagatcttatagaaaagccattcgcttccgggaatgaaatttcgcacaaccgtattttttacaggaaaaggtgttagttttgatttcttttgactgcttacattatgccaggggataagaaattcattgctgtgaggattcccgtttttatctctggttaccgttttatattgatcggaaaggttttccagcactcttatctgtttctcttttaccagatgatcaaagagaatttccagcgaaagagaattgttggtaaataccggaagttccatatctttttcggtaaaaatacagacctcaggaatgtttttctcctttaaatactctttgaacacgtgaatatcaggtttctttcccttgaatattttctgatcatccaacagccatgatgctctggaaaggatcacattattgatcataattctgggcagaaattcgtaattcacaaacattccccagttccagttataagacggtgtcatatgttgatactgaagatcacacagaaaatgatacatcggtactttatgcaggttgtaattatgtgccgatgaaagacttgggattacttctttattatgctttttggaacggagaacaattctgtcattttgcaccgaaatcataaggtcatccagataaacaggctcgctgtctgcgtggtggcggttaatgatgggaatttcatattttcttagatgaggtctgatggtaatattcccgactctcggctgaggattgtgtaccacttcagcaatgatctgcccgtcatagaacgattcttcttccaccaaagcttcttgtaccaatttctccagatgttcatccatatggcaaaaacgtcccagataagtggaagacgaaggtccgtcactgaatttatgaaagataacaggttttccctcctcatcttcatagatgtgtgcaagtgatgacattgagaacgggatgtttttattctcctctgaaaatgaggaaacttcttcctgcgtaatctgtattacattctcattgttttttaaggcattaataagcttttctcctaaaaactgattccatttcagggatccctgaatgacattggttgtgttttcagacttaaactggattccatccgtcagatttgggttgtcattatccgaatgtaatggatagttgactcccgataacgggtcaagggccaacaatatcggaatttcctgctgatcatatcttgcaataaattctttcttaaaattctctagcgaatcaatattgtcggctgctccgatctgaaagactgttgaaagtaccttttttaaatctttaaaaatatttttatccagcctattgaatgttttgcccttcagtaagtcggtctgaaggatattttttttgtggtttttgattcctatggaatttaagatctcagaaatctgatcaaccgcaagaaatgtagtattggttttattggctttctgtacaatttcaaatatggtaattaaactgcggattaatgctgcatcttctttgttttcttcatccgcaggaatgttcagttcttttaaaaactgatagataaaatcctgaaaattcttgtcggtaacctttggtgaaagctcactgataagaatttttgagtctataagatcattaacatagtcgaaactgtcctcataagaaatgtcctggtttactaatatttctatgatggcagaaagcttcaagccgctcttacaggcttttatgacagaattcaggtatttgtttttttcggtggaaataatttcatacttcaacccggaatcccgtatggtgggctcaatatagcggtatttatttttggtgctgtagatcgtattgttggtatagaaatgacagacttttctcacctgcatattttcctccagttttaccgtaatatcatgcagcagctgcatatccagtcttgcaaatatcttatcctgatccttatccagaatgatttctgtacggtcactccattctcccttacttattccggcattggttccgaaggggatggttctgaaatgggttcttagccagtatttcaacagtgattttttgatcttatccgctttttctccggacagttttttttcttcccagttgatgagctgttcatacaaatccggtgatgacagataaatggtattgcgaaagctttctgtatggatatcctcttcccactgatcaatgcttttttgtggaagaagcggtgttcttagcaggtaaaagctcagtttttctatatcgttgtatttcatcctatattcattaagtaaattttatcccaatcctttgctttttcgggatactgataatccagcaataccattcctacccccgaaataccttccaatagccctgtatgttctacccattcgtcatttttaagatcataagggaatttggctcctttttccagctggtccagagtaagagacatccagtaattgtgtgcttctttcagctcttcgttttgaaatattctgtagaatttattgaatatatgtgaaattcccgcggttccgtggcatattcctgtgtctatgcagtcatttttctgactgtaaaatactccggatttgtctgcttttattttcgatacattcaatataaggtgatagcacattgctttcaggttttcatcctgcaaaacggtatacgctttccagagtccgattgcaactcccaggtcgccatagcaccatgccagtctctcggataactgtttttcacctgttgcaatattaagttttgaaggaaatatgtgctgtgcctgtttattttcttcgtaaagttcattgagaaaggtaacgcttccactgatcagttttgcacaggtttcttttttgcatcctctgtgatagcattcggctaaaaaagataggatagaaggctgtccgtgggcaagaccaaggtcaatgatgttctcttcttttactatatgatcaatccagaagatggattggtttctttcatgtttcagttggtctatatgagacactattttatctacggcatcgaatttcttaatttcaagaaagtaaatccccaatccgatcaggccggtaaataaatcgtattcttttttatctgcagcggcagaaagcagttcaagaaaaaattcaatagaatcttcttccagaccgtcaatatcttcatctgtaataatatcagcattgtgcaaaagcctcataaagtaaataatggctaagcttccggttgcaaatgatgagtaagaagcttctgaagccatatcaatgagatcctcaattttttcaatctctacatcattgttgtaaaataatgagtagtatccgtttcccaggctgaacgtgatgttttcacctttatcctgattacatttttctgaaatttgggctaaaaaaaagtcaattttatctttatacatattggcttaatatttcaatagctgttaaggaatctttatgtgaacgtgagatattgttaaacataaattcattatatccgtagagttctttaaattccagcaatttttcgtgaaagaaacttccgtctcctacaaggcttatattgcttatatcattgttggtactctttttagcaacattaatcgccttacgttttgttttatggcagcatccggaaaaagtaagtaccatggacggctcttttccgtgttttgctttatattctgttctgaagttttgcagctcttccttaagataatccttatttgattctccatgaaatatggatcttgcaaaattgagatcgttctccaaagcaacttttaaacctgagtgtgatgatcccatataccatacatccggaatattccctttgtaaggaggaatgatgagatctttttcaagaaattcactttcatctcttaaaaagctgagtgtagattccagtttaggaagaaatgaagaaaaatagttttctttatctacatctacattaaaatatttaagatcatattcaccaaccagaccttttacaaatccaaggtctaatcttttgggatataaactggataacagcttataattgtgagccactctgaatgggctttgcaagggaagaataacgcccgcaattcctattttgattttttcggttaatcctaataatatgggaatcagcatttcaggagtagaccacgccatgtcatgggcttttgaaaagtagttttcggtaacccaaaacctggaaaaacccagttcatccgctcttgtagcatagtcgatgatatcgtataatgatttcttagaattgttgagtgagttttctcttatgccaaattctaaaaggcctatttttaatttatttgccataatagagctattaaaagcagctaccccttacggagtagccacagttttttgtaaaatgtttctgattaggatacaggacaaacacaaaggttagtagatctgctgcttcccgcagtgcaagtccagtgtgaacaatcgaaaacagatgttactagctcttttccagcttttactgatttcatttcgtcagaatttaattgagataacttctcttttttaagagttaacttctttgtaagctttttgctcatggttaaaaaaaatttaatttgtacctactcgttagcttttcggtttccgcttttttatcaattaaattatatttttaaaaatttgatgacagatgtattgatggcatccggtttttcaagcggcacataatgagaggcatctggaacaatcagcagctgtgtgttagggatactgctattgatcattttggtatgttcttccctgatcacatcgttacttcctgcgataatcaagaccggatttttaatcccttttagctgttctgtactgatatgggggtgctgaaccattagtttgatcagcctctggttaggggcatcttttatttcaagctgttttttaaaagtatccagcgttttgggttctataccttccggatttgtattggctccgataacaacaagcttgtttacaagatcaggatgattaatcgtaaacagtaatcctgtaattccgccgtcactccagcctaaaatattaaatttactgatgttaagctcttttgttatggctaataaatcatcagaaaatgtttcgtacatgtaatcaccagtggaaagatccgtacttcttccttgccctcttgtatcgattgcgatgactttgaactgctttgcaagatcaggaatctgcttatagaaatctgatatgctgccattgtttccatgaagcaggacaagcggttctccgcttccatattcttcataatatattttagcgttcttaatatctatatattttcctgatttattctttccatagattgtttttctggcctgctctttattattgtaataatccaccagcgcctgttcttcagtgctgttttctgttttgcttatcgtgttgggagcgctcccgtttttatctttgaggtagctgatgtctatattggagatgaaacttcctttgccggtttcccattttccctggctctgataacggaaaagcaggtcattggataaggttttttttgctgagattccgaatacgaaatctacattatcctgaggtacactttcaacgagctgtaaggtaatggccagttgatcgagatcactataaatgagtttatacttttgaagatctatcgtttgccatcctgtagtacctgttttgtaaataatgttttcatataggagagattcctgcggaatattgtccttgacagaatagatattcagtttcaaagtaatttccttgaattttgaactcggaatgatataaaaattatagctgttaagttttgtccatttataaatgttgaatacctgaccctgctctatagtaggaacatttttatcaaacattttagagaaagtaagcataggccgttttgtgttgccaacaatttcatttttttgctttttccctgttaggttgatttcctgaatcgcattggtttttttacttaatttgatatgggcatctgaaataattgcctgcacggtaacttttttatcgtcatagccgttggattcgaaaataaggtgatcgcttttcttggtatcttcagggatttctattgagtagttcccatgagtatctgtaatggtgctgatatttacattctcaagacttactgaacagtaagaaattgcctggttgctttcatcggtaacttttccagatattttttgagagtaaatacttatactaagcaatagtgcgcctagtaccgatatgattttcatggttagtttttttgtaaatatattattttatttcaaattaatcacattttgaggaaaaaaataagaaaaaatatttgttaaatatattaatattgttgaattttcatgctgtattttaaattaattctaataatttgtgactttttaatacaaaatcttaatatttggagattgtctgtgtgtcgtatttgtcactgatttgtgttttaaataactctacttttcttgagaagtagagttatttgattttttcacaaaaaattatagcttatttttgatattgataatgccggaaatggtcaatcttgaattgttgtggtaccggggcattttaataatggttcttaatgttttccagcccaagttccctcatcgaaatctctcgcatctccacctttcttattttcccggaaatagtcatggggaattcatctacaaatttccagtattttggtactttataatgggctattctgcctttgcagtattcctggagctcttctgcagtgatggtaaatccttttctcactttcacccaggccatcacttcttccccgaatttttcactgggaacaccaataatctggacatcaagaatgttggtataggtatataggaaatcttcaatttcttttggggaaatattttctccgccacggatgatgaggtcttttatccttcctgaaatagtaatataaccgtctttatccattacggccatatctccggtatgcatccagcgggcgtcgtccagtacttttttagtattttcaggatcattccagtatttcagcatgacagagtaacctcttgtgcaaagctcaccatgttcaccacgctttaatgttctgccgttttcatcaataatttttatttcaaggtgatcctgaactgttcctacagtgctgacctgtttctccagcggtgtccctattaaagtttgggtagatacgggtgatgtttccgtcattccgtagcagatgctcatttctttaatattcatcaggttttccaccttcttcataatttccggaggacatacggagcctgccataacaccggttcttaaacttgaaaaatcatagctgtcaaaatcttttacggccagttccgcaataaacatggttggtacaccatacaaagaagtacatttctcatccgaaacagcttttaacgtgatttcaggatcaaaactgtcattgggaattaccatacaggctccgtgggcagtacagcagatatttccgatcaccattccgaagcaatgataaaaaggtacgggaatacagacacggtctttttcagaatattttaatcggataccgataaaataaccattgttgagaatattatgatgggaaagcgtaacacctttcgggaaaccggtagttccggaagtatactgaatattaacaggatcatcaaactgtacatgttcttcaaagctgtgaagcacttcatccgaaatttcctgcccgttattgacaaaatgttcccagttttcatcaaagaatatttcgtgctccagggttgggcatacttcttttgcgtactcaaccatttctttgtagttgctggttttaaagcttaaagaagaaaaaataaagcgaacttcggattgattaagtacataagttaattcatgagtccggtaggccggattgatattcactaaaatagttcctattcttgcagtggcatactgcaaaagtacccattcatagcggttggaagaccagatcccgattctgtcaccagcttttgctcctaaaaacaatagagcttttgcaacagcggttgtctgattataaaattcctggtaagtagctctgtaattctgatgaacgcagactaaagcttcctgatgggggtatttttcgaccgtacttttaagattggctccgatggtctgtcctaataatggaatctcagatgttccatacacataagataagggcatagtttaagatttggtggaataaaattaataattatatcccgaactatgcctatggatattaattttcctgagaatctatttctttaagctgtttcagatttttatcaagctttttaataatggtaccatataccagtctgtaataaagccagatcatagaaaccgcgagtaatgtgcttacggcaattccaacaataacaatggtaagattggagccgctgggctgtatattctgggaatccaatatataaaatataaaagcgaccagtacaaacgtgaatattaacagtaatacaatactgatcagaataaaagcattgacagttgttttgaatttaatgatccgggtaataagtcccttcagattttcctcgatttttattttccggtaattctgatagaatttcagcacgaaataagccgtaatcagcaagcttaagatttttatagccagataaacatgaccaaagttattttctgcttcaggagcttcctgtgcccctaatctctccagcattttacggaaactgtccgactcttcttccgggaaaaagtaaaacagtcccagtactgaaaagaacagtaattctacgacactgatccagaaaatgtatttcacataattgcgtgactttctgttcaacatctgaagaatctcggtgttgtcatatttatgctgtacaggttgttcctgccatgttttcttaaagctgtctaaatcaaattcaggcatatttttccatctgttctttaagggttttctttaatctgttcattttcacgcgtgcattgacttcagtgattccgaggttctctgcaatatccttatatggcagatcgtcaagatacatcatgacaatggctctttctacattaggaagagtcttgattacagtatacaaaagtgatacctgctgctgtttttcatcatcatcttccacaaaatccctgtggttgatgtccagctcattcgtaggaaggcttttgcttttttttctaaagagggtaatggctgtattgagcgctacacggtacatccatgtggaaattttagaattccctttaaaagaatcgtaacttctccagagctgtaacacgatttcctggaaaagatcctcttcatcttccagagaattggtatacaggcgcgatacttttataatcagtccctgattatctttgataagctgcgcaaattctttttctctggaatccatagatatataatggcacgaagataataataaactggtaattagggaaaattatcatgtaaaatagtaaagaggtgaaaaaacggaaaaaattgatcaatcaatatcgtttgcatggcactaagacctttagtcatttcaccatttgcttttttaccacaaaatttgcgtacctttgcctccgcgagaaaatcggcctgttgatttcccgttttacgggaggtaggaaagtccggacaccacagagcagcaaagcggataacatccgtcacccgtgagggtaggacaagtgcaacagaaagcaggtacagttcggctgtagtgaaaccaggtaaactctttgcggtgcaatggtaagtatatcggttcttttcagtaatgaaaataggggcggctcgtcctgaaaaccgaggggtaatcagctcaagtgttgcagcaatgtaacacgcagataaataacaggcgcttctccggaagtacagaatccggcttatagattttctcgtgattttttttaagctggaagtcagaggctggaagagtgacgttttttaaacgcaatgattgtaaaactccatcttcatgcttcctccttccaactgatttattcgctttccaattgttttttagaatccagtaattcttttctgtccttatcagaaagcgtaggatatttaagattcatcttttcaagagtatcaatgataatctgaatggcagctactcttgcaaaccatttgttgtcagcaggaagcacataccatggggcatgatcttttgcggtctcgttaattgctgtttcataggcttccatatactgatcaaataatgctctttccggaagatctcctgcagagaatttccagtttttttcctgctcgtctattctgtctagaagcctttttttctgctcgtctttggatacgttcaaaaagatttttaccacagttgtgccgttttgcgaaagatgtttttcaaaattacggatgctttcatatctgttttcccagaatttactgtcaaagtcttttactgaggaccacgttttttcactcaggttatactcaggatgcactttgcatactaagacgctttcataatgtgaacggttgaaaattcctatcatacctttctgtggcagtgccagataatgcctccatagaaaatcatgggaatattctttcgggcttggagttttaaagctcgtcacattacatccctgtggattcactcctccgaaaacatgttctatcatactgtcttttcctgccgcatccatagcctgtaatacgaccagcagagactggcttccgtcagcatataatttttcctgcagctcacggagcttttctttctcctgaatcagcatctgctctccttcttcttttgtaagctttcccttataagaggtcgaagttttttttattgaaaattttccgtttaccttaaagtcatctgagaaattggtgtccatatatttattaagattaaaagattttgttattaaaattcaataggggtgggttttagcccagccatttaaatgtaaataaatgtttaattaaaacgtcaatacatctattaccggctattacctatcatgcgcaacctaatccaacataaatgtaataaaaaaaccgcctcaatagagacggttcctttattttttgagtagagcttactttgcagcagcttttttagcaagttttgcagcttttttctcagctttagcagcttctttctgctcagcaggagtcaatacttttggttcaggagcgttagcatctacgttacctttgatgtagattacacttctgttgtttgcagggtcgttagagaaaacctcgatcattttgttgaaaggtccagggatcgctgtgttgtatccaactttaatcttagcagatttacctggcatgataggatcctggctgaattcaggagttgtacatccacaagaaggctttacatttgaaaggatcaaaggcttgtcacctgaattcgttactgtaaagaatcttgttccgtcagcgttaggcttgatagttccgtaatcgaaagtcgttttatcaaatgtaatagtttgtgcagatgcaagagcaaatgtcccgaatagtgcaattcctgcaattagttttttcatattcttgaatgttaatatgtttgttagataaattttgtgaaacaaagttaaaaattattttaattcatgcttaaaaatttttttctttagactatttttgcaaattgcaagccaaagaaatagaatttatgcagatttcagaaaagtacaatccacaggaaacagaacagaaatggtacaattactggctggaaaataagtttttccattcagaacctaatgacaagccaccctataccgtggtcattcctccgccaaacgtaacggggatattacacatggggcatatgttgaataatacccttcaggatgttctggtccgtcgtgcaagaatgcgcgggtttaatgcttgttggattccgggaacagatcacgcttcaattgctactgaagctaaagttgttgctaaattgaaatctgagggagtcaataaatcagatattacccgtgaagaatttttaactcatgcctgggattggaccaataaatatggtggaaccattcttgagcagctgaagaaactgggatgttcatgcgactgggacagaacccgcttcactatggaggataagctttcacagcaagttattaaaagtttcgtagacctttataataaaggactcatctacagaggctacagaatggtcaactgggacccggaagcaaaaaccaatatttccgatgaagaagtaatatttaaagaacagaatggaaaattatatttcctaaaatataagattgaaggttcggaagagtttctttcagtagctaccacgcgtcccgaaactatttttggggatacagccgtatgtatcaatccgaatgatgaaagatatgcacatttaaaaggtaaaaatgtaatcgtaccgatcgttgacagagtaatcccgattattgaggatgaatatgttgatattgaattcggaacaggagctttgaaaattactcctgcacatgatatcaatgactatgagataggtcagaagcatcatttaaaaatgattgatgcacttgatgatgacggaaaccttaatgaatatggtttacattatgctggtaaaaacagatttgatgtaagaaagcagatcgctaaagaacttgaagaaaaagatcttttgcttaaagcagaagattatgtaaataaagttggaacatctgaaagaacaggtgccgttatcgaacctaaagtttcagtacagtggttccttaaaatgtctgaaattgccaagccggctttggatgtcgtaatggatgatgaggtaaagttctatccggaaaagtttaagaatacttataaacactggatggagaacatccgtgactggaatatttcccgtcagctttggtgggggcagcagattcctgcttattactatggagaaggagatgaagactttgtagtagcagaaaccaaagaagaagctttggaacttgcgaaacaaaatacaggaaattcaggtctgacggcagaaaaccttagacaggatgatgatgcattagatacatggttctcatcatggttatggccaatgtctgtatttgatgggctacttgatccggaaaataaagatattaattattattaccctacttctgatcttgtaaccggaccggatattattttcttctgggtagccagaatgattatggcaggactggaatacagaaaagaagttccgtttaagaatgtgtattttacaggaattgtaagagataagcagagaagaaagatgtcgaaatctttaggaaactctccggatcctcttgaattaatggataaatacggtgcagatggtgtacgtgtaggtattctattgagttctgctgccggaaatgaccttctttttgatgaagatttaatgcttcagggaagaaatttcatgacgaagatctggaatgctttccgtctgatcaatatgtggaatcacgaagacaaaccagctgctgctacagataatcaggctattgaatggtttgaaaataagctgaacaaaaccatctttgaaatcaatgatcagtttgagaagttcagaatttccgatgcactgcatttaatctataaattaatttgggatgatttttgcggttggtatcttgaagcgattaagcctaattacggagaagggatttcaaaagaagtttataacaaaaccatctatttctttgaagagctgatgaagttacttcatccgttcatgcctttcttaacggaagaattatggcagatgatctcagtaaggaaggtagatgaggctttggtgattgctcagcagaaagaggcaggacagtttgatgaaagcattattaaaaactttgaaactgctgcagaattaatttcaggggttagaaattaccgtcagacaaaaggaatttcgccgagagaagccgctgaaatttataccaatgcttctgaatttgccaatgaagctgtagtaagaaaactggctaatgtttctgaaatccactttggacagaaaacagataaaccaagctttacattcctggtaggagcaactgaagtttctattcctttaagtgaaaacttagatttaggagaggaaaaagctaaaactgaggaagaactgaaatatctgaagggattcctggtttcagtagagaagaagctttccaatgagaaatttgttgcgaatgctaagccggaagttgtagaaggcgagcgtaagaagcaaaaagatgctcaggataagattgcgatccttgaagaaaaactgaaaagtttgtaaaatatagacaataaatttgtcagaaatctcaggctgggtacagatgaaaattgtatccagcctgatggtttaaaagaataaatacaatgacacatatagaaaacataaaaaaactattctcgaaagattttgtagaaagtccgttactggaaagttttgaagtgggaaagatctatctttccagcggaaagctggtggcctgtgatcctttgatcactaatgatatgcttcctttcactacagaatttccaaaaggagatttctctgtgatgctgcacaaagaacgagaaagtaattgtgtggcttatgccgaaattatattcagcaattctgaaattaaagaatggaagctggccactacggcagggcagcaaataaaagatctggaagaaggagaggtgtttggatatccggtagaaagcggtatgggatgttttatggatgttgatacccaaaacagtctcaatgaacttgaacaaagactgtatcaaaataaaggaggggattttatgggaatttatgaagaatttttccatgattacttctttgatgaaaacggagcgatagatcagtatgcctttctgaaaccggcaaaggaacatccgggaactatttttgcttttgaaacaggatatggcgagggtttttatgcaagctatgttgcttatgacaaagatcatcagcctgtgaaaataattactgaatttatagaaataagttaaattaaaattagttattttagagatctaattttatcaggtataaattttaaagctaatacaaacacaatgaatttctcatcagaacaaccccgtattattgttgtaggcagctcatctatagatttggttcttgaaaccgaaaaactccccttacctaacgagactgttttggctgtgaagtccgatagttatttcggtggtaaaggagccaatcaggcggtagggacttccagattgggagccagtgtatactttataggatgtgttggaatggaccctctgggccagcagatcatgagaaatctggtaagcgaaaatgtgaatgtaggatttgttcatgaaacagataaagaagctacaggaactgcttatgtaacaacttcccatgggaatgcagcgattgtggtggtaccggcagccaataaatatctcagcaaatcacatatagatgaagctgacaaatattttcacaccgcagatcttatactggtacagcttgaggtttctatggatgtagtggaacataccgttaaaaaagcaaaacaatacggaaaaaaagtaggattatatgcttctcctgcaatgagagtcagtgaagaaattttagaaaatgttgactttattgtggctaaaagcaatgagttatacattattttcggggaagaaaagcgagaagacatccttaaaaaatatttcaataaagtttttgtgagagatgataccaactccaccatttattttgatggtactgagatgaagtattacagaaacgataaagatgaaaccgtttataaaatgggaatgggagatgcatttacctcaggatttgctattgcactttgtcatgggaattctattgaggaatgtgtaaaattcgggaatgaagtttcttcaagagtctcaggagggaaaggttctcagaccggactgccgagaatctcagatttcttttcataaagctatttacgacatatcaaaaatctgaaacttaacataaaaatatcagtaaaatgtccacttttatagtggattttttcttttatactatggaaaaactaatattgaccacagaagatcatatttccctgactgcccatctctttaaaccgcaaaaagatcatggaaaactattgctgatcaactcagcaacaggagttaagcagcaggtgtacttttcatttgccagctatttcgctgaacaaggctttaccgtaataacttatgattacagggggataggactttccaaaccgaaaaatatgagagggtttcatggttctatgaggatctggggctcaaaagattataaagctgtcacccaatatatcaagacaaattttaaagaatacaaaaaatactgtcttgggcattctgtgggggcattgattttaggtatgaataaagattctgaaatgtttgaagaatttttttttgtgggaacccaaaatgcttttgtcggaaaccttagagggataacaaaagtagaagcctatctaggatttggaattgcacagccagtaactacttcattgttaggatattttccggcacattggttcgggcttggagaaagtctcccaaaaaattgcgcatatgactggagaaccttaattttaaacaggaaatcaaccaacagactgttggagaaaattgataacttctcaaaaaatttgacgcagaaagtatttgtagtccgcgctgaagatgatatatggctgacagaaaaaggcgtattaagcttattgaataatacctatcctaatcttaaacccacttacagactgatcgctgtttcagaatctgataaaaaagaaataggtcatatcaacttttttagaagttacaacagtaaactctgggatattattttaaatgaactgacagataaatgaaaagtacaatagataacaccgtagcatttgtaaaagaaaaattagaaggagcagaagcaggtcatgactggttccatattgaaagggtctggaagctggctgcccaaatagcagaaacagaagattgtgacaaagaagttgttgaattatcagcacttcttcatgatattgcagatcctaaattccataatggtgatgaaaccattgctcctcaaatatccagaacgtttcttgaagaacagaatgttccggaagaaacaattaaaaaagttttatttgtaatagaaaatatttcttttaaaaacagggaccaggctccggtaaatccacctgttgaacttcagattgtacaggatgccgaccgcattgatgccataggagctatcggaatagcaagaactttcaattttggaggttttaaaaataatctgatgtatcatcccgatataaaacccaaactgggaatgtcaaaagaagaatataaaaaatctgacggaacaaccattaaccatttctatgaaaagttattgcttctgaaagatatgatgaatactgaaaaaggaaaaaaaatggccgaagaaaggcatgattatatgctgaatttcctcgaccagttttataaagaatggaatgtggattagaaaattggccacaggtatagataaaataaagagaagaagtatctttgtaaaatatgacactcattatttttataatattcctggcttgtgttctttctttggtcctgtttaaggtcagatcaggaagtatcgccaggtgggcgaagctgtttcgtattgtaacagttgttttttcaatttctgtttttacctattggtttattaagaaaagtgctgtggcatttgtggataattctgtaggactgcaggtggtcaacaaacttccacagacattggatttttatctgatcaatgtgaataaaacagatcaaagtacagttcttgaaccgaagcatattggaaaaatacgtccggaatattacagaatagagtacctgaaaatggataaatccgatgaatattggattgcaggatatctcggaaagaaaaatcttgtatacttttctcaacattctgtaccgaataagaatatcgatcagattgtagaagtgcagaattacattaatcagagtatgaaactgtctgatgcagccaaaaaacaggtagatgcctataattatgagaatacaaaactgggtatctggataacattggatttcctgcttctgtttctcaatctggtattgcttctcagaaaaaataaataaaaaggtaatgagttcttatgctcattaccttttgttttctattaaggataatccagaatctgcatgatctgttctttaaattcttcaggacataatttgataagtttatccttgttctgtttactgatttctttgggattaagccattcacttttattggagttcagactatggttgtcatatactctttttatggtatgattttcataaaaaatatattcatcacccagccagttattggcaatactgattgtacaaatttccttttccatgatttatgttttaaagtataatgtttagtgaaatacattataccctaatatacgaaacttttcgttaataaaaaggaaatttgttacaagattaattaaaatcagcaagtttaaattcttatttctgcagcaagcttttatattaaatatattaaaaaagtgttcctgtactttcggtcgccatttgcggaatatgtatatcagttccccattcctcattcacttttttgatgaaataagcggataataacggagaggctttctcgatattctgatgaacaaaaaaataaagattttgcagaccctcttttttccactttgtaaggtgtttcaaccaatcatccagtctttcatagtcactttctgcattagctcctacataacggataaatgcattaggagttgtaagacgcatatggagcatgtctcttcttccggcagtatctacaataatattggtaatgttatgggcttcaaaaagctcacatgttgtattaaggatttcctcatcagtaaaccattccgtgttgcggagttctatagctaatggaacctcttttggccattcttttacgaatttttccagtctgtcataatctttaggcttaaaattatcgtgaagctgaaggaaagccattcccagcttttcatcaaaattgatgacagcggaagcaaaatgagttaccggatcggtaacatcaatcaatcttctgaaatgggaaactgtgttggtgatcttaggaaaaaatttaaaatttgccggagttttttctttccaggtttttacctgatctggagttggcatcccgtaaaaagtagcattcagctctatagaattaaactgggttgcataataggttagttcatccttagttcccttaggataaaatcctttgagatccgttttattccatttagcacatccgatagagatattttccagtccttttttatttagagccagtatctctttcgttctgggatgatctttaggtaatgtgaaatctatttttgaagggtcttctacttgtccgaatttcatatctgtagttttggtattaaacaataaacacaaatataaaccaaaaatcccagagcgtttggcgatttgtgtggaaagtatttaaacatcaaagattagtgattatgaaattttaagaaataggacccctttgaaaggcgccaagaatatgacttttcacattttgtttagaaaattttttaacacttttactacgtttctattaagttttttttaaggaaatattaaacattctgttacgtaatgttaattctgtgttaccacatttcatttttactagatctaattttacaccaagtttatagcgaataaaaatatgaagaaaaaaatcatctgtgcttttgctctgttatctttcgggtttgcattttcacaggaaaccagttctaaaatttttggtagattaaagggaatttcttccgaagttacagtgaaggtagtacatattcctaccaatagtacctttgaaacgaaaagtaacagcaaaggtcagttcagcttagataatcttcagccgggaggcccttataaaattgaaatatctgacggatcacaggtaatctatgaaaatccgaatctgcagctttctttaggaaataacgacttgcctgtagtagatgtaggaagtaaagagaaaacaattgatgaggtaaaaatcacttctaaaaagaccacagcaaaatatggagtaggaatcagtcaggctcagatttcaggtcttccgaatattaaccgaggcattcaggatgttaccaagctaattcctcagagtgccaacaactctttcaacggaaccaatttccgttataataacgtgactattgatggctctatcaataatgacgctattggtttcagcccttcattgggagggcagacagggacttccggaatgcccggaagcagtacccgttccaattctataagtctggatgctattcaggatgtgcaggtgtatattgcgccttatgatgtaaaactgggaaatttccttggaggaagtattaatgccgttacccgaagcgggagtaacgatgttacaggctcaatttatacatatggaagaaatgctgcaattaccggtagaaacagggtaggagataattctaagatgcctaaggattttgaagactttatctacgggggaagagttgggttaccagttgtaagagataaagtattcttgtttacaaacctggaatataccaaaagaacagatcctgtattctataatgccaatgatccgggagcattggtgaatgaacaggttgcccagcaaatatcagacttcgtacgcaataaatacggatttaatgttggaagttttaaccagtataataacttctctgaaagctctaaactttttaataagttagattggaaaattaatgataaacatactttatccattaaaaacaatactgtattttcacaggcgtccaatctggaaagagacggagcaaacttcagattctccagtatggatttcgttcagaaaaacacagcatctaccactacacttgaattaaaaagccgttttaatgatcaatggagtaataatttagtcttgggttattcttctattcatgattacagggaccctacttcgggaaatgcgatgtttccacaggtggagattgcttacaatggaggaacaatcctgctgggtaatgacagagaagccactgttttcaatatgaagcagaaaacttttgaaatcacggacaaccttacctataaaaaaggaaatcataccttcctgttgggaactcacaatgaattatacaatatcaactacggttttgtaaatgccctgaacggaagaatttcctataaaaacctgaatgatttttataacggaactcctgccagaataagaggaacttatcctttcaacggagacagcagacagaccctttttgataatccgtatgctcaatataaggtgaatctgctttccctgtatcttcaggatgagatcaattggggaagagtaagactttcaccgggagtaagagtagattacacagacttaccgaataaaccgcagttaagtccattagtaagcaattctcctcaggatccaaacgctggaaatacttacaataatactccgttaaaccagcttaccaacaactatctgaataagccgacattctcgccaagacttggatttaccattgatcttactgagaacaggtctatggtgctgagaggaggctcaggtatttttgtgggaagaattcctttcgcatggctaggatatgcttattacaatgacggggtaggcttcggaagttatgactacaattcaccaacacctgcacagcttgctgccaacggagatccgttgaacagtgccaatttcccgaaatggcagaattcttcaaaagttcaggtagaccttattgacaataattttaaaatgccaagagtttggagaagctctttagctttcgattatacgctggccggatataaattaaccttagaaggaatttatacgaaggtgctttatgacctgaaattccaacaggtaaataaaacagataatgtgacgtattacagctatgatgtgaatcatgaaatgccgatctatacaaccaatatcaacagtaatttttcgaacgcctatcttttatccaatacaaaagaaggatatcgttacaatttaacagcacagctttcaaaatcctatgatttcggattcaatttctttgtagcctacacctacggagatgctaaagatattaccaacggtatccggaactcaatggaaagtaactggcagatgaaccagtctcttactcctaacgatccgaagctcacaacatctaatttcgccatcaaaaacagagtagtggccaatcttggatatgcctttaatatctctgatatgaacagattatacaccaatgtatattttaatgctcaatcgggaaatcctttttcatggggatttgtgaacagtaccattgccaatacaggacaggctgccggacttgcgtatatctttaaagatgctgcagaagcctccaaatatatagttcctataaaagatgcctcaggaaatgttttggtaactgctcagcagcagattgctgattacgaaaactttattaacagtaacgactatctgaaatccagacgaggtaaattcacagaaagaaacggagattttactccatggaacattcaggcggatatcagaatcatggatgaaatcaaattgagcaagaaatctaagaataatattcagatctcattgagtatcatcaatttcaccaatctgctgaacaaagattggggtaaagtatattttgttcctaatactttcaactctacagcaagtgtcgggttgacaaaagtaggaaatgtagcagcaggactgccttctgcaggagatcctacctacaacttcaaaacaccgggactgccttatactattgatcagtttgcatcaagatttcaggcacagcttggggtgagatataatttttaacaacgcttttacattttacttcataattcttttcaaaggtccggattttctttccggatcttttttattaatcaataaatgatagattgctggctcaaaattacattttacctttattaaaattaataagtacattaacgcaatcatctgtgaaaatccgtgtgatctgcggttaatcaaagactagtatatataagtggtaataattcaataggaacgggctttagcccgtttttataaaataaacatattcatcggctttagccaaaacttattaatatcatagtaagatctgtgaaagtctgtgtaatcagctggcgaacaaattaaattgacctcattcaaatctattatgtgataaaacgacaaaagcacaccttgcggtatgcttttgtaaatatagcgtgtttattacttgatctatgcctcgcagcttgagcatgatacaaagttaaccatcatttcttttgaaactgatgaacttctttggtagtaaagtgttttaactccttttttccatgcttcaatataaaggtagttaacatcttttacaggcattgtagaaggaatctgaagattcagggactgtgcctggtcaatatattgctgtctttgtgctgcctgagagataatttccattggagaaatttctttgaatgttttaaatactgccttctcttcaggagtaagctcattcaggtgctgtacagatccatggttgagcatgattgttctccatgtttcctcgttatccagtcctttttcttccagtaattttgcaaggtatttgttcttacgcataaagttccctttagcaagacctgctttatagtagttggaagcaaaaggctcgattcccggagaagtttgtcccaaaattgcggaacttgaggtagtaggagcaatagccattgttgtggtatttctcaatccatatcctttcagtacttctggttcaccatagatgttggcaagctctcttgaagcctgctcagcctgttctttgatatgtctgaaagctcttgcgttgaactgagttgcttcaaaactttcaaatggaatcatatttttctgtaaatatgaatggtatcctaatactcctaatccaagggctctgtgacgcattgcgaaatttcttgctccctgtaggtaatagttaccctcagttttatcaatgaattcagataaaacagcatccaggaagtagatagcaagctttacagcatctgtatccttccattcatcatatagttcaagattcatggaagacagacagcagatgaaagactcttccatagtagatggaagcatgatttcagaacaaaggttacttgcatttaccgtcatccctaaatctttataaacctgtggcttatttctgtttacgttgtccgtaaagaaaatataaggaagacctttttgctgacggctttccaatactcttgcccagactttacgcttttccatatcaccgtcaatcatatcctgcatccagtaatccggaacacatactccggtgaacaggttctgaatcgggctaccgatatctttaatagataaaaattcttcaatatctccgtggtcaatatctaagtaagcagcaaaagctcctcttcttacccctccctgagaaacaacatccatagccgtatcgaaaagcttcatgaatgaaactgctcctgaagactttccgttgtcagttacagctgttcccctgtttctcaattctccgaaataccctgaagtacctcctccgattttagtctgcatgatcacttcacccattttgtgggtaattccttcaatactgtccggaatgtgaacgttgaaacatgagataggaagacctctctgagttcccatattagcccatacaggagaagagaaactgatccatcctttcgtgatcatttctttgaatgccggttgaagttcaggtttgtataacctttttgcagcagcagttgtgattctgtcgattgctccgtctaccgtttcacctttcaacagatatcctctgttaagcatctgctcagactcttcattgagccaccatatatttgaattttgctcttccatagatgttatattttcgaattccggaatgaagagatcactccggaattttgtttttttattgtattgattgtaaaatttctactttgtgggaaccgttcagtccgctttcatctcttaatctctgaaattctttaaaagacggaacattcaaaacctcatgctgaacttcttcattgatgtagtttgaataatgtacaaaagtaacaccatcttcctttacaaaaactttatactcaaaggtggaagaatctaaatttttgaaatcttccagaaacttttggatattagctttattgtttggaacaaagtcggagtttaccgtataagttactattacattaatcattcccttaatatttgtgctttatttaatgaactgcattcttgataataccagaaaagaattgttcctgatactgactgcactgacgctcgctgcgctcgcgcccggattaaaacaaatcgtttgctgtaatacttttatcgtgtttcgtatagtctacaggtcttttggcaaagaaatcatctagtgaattggcaaaaacttcctcctcgaaccataccatcggtctgtattgctcaggagtaatgttgtatcttgttttcatgttgattttcttcaagctgtcatctacacggtatttcataaagtttaacaggtcttctttggaaacgttgtcgatttctcccaattcaaagatccagctaaggatgtcgccttctcttgcgatagactcatctaccagagtatagatatcttcaatatcgctgtctgttaataagtcaggttgttcttcacggattttgttgatcaggtaaattcctgcattggcgtgaatctgctcatctactgaagtccatgcaatgatattggaaacattcttcatgaaacctttgaatcttgtgaaagaaaggatgatggcaaactgcgagaaaagagaaacgttttccactaaaatactgaataacaataaagcggaaacatattctttcggtgtagcagaattagcatgctttaaagcatttccaagaaactcgattcttccttttacggcaggaatttcgataacgttaaggaactcgtcgttatatcctaaaacctctaataaacgggaatatgcttcagaatgacggaactcgcattctgcaaaagtagatcctaatccattgaattccggctttggtaagtggttgtataaattcccccagaatgtctttacagacacctcgatctgtgcaatggctaacagcgcattcttcacagcatgcttttcgtgtggttccaactgcgaatgaaaatcctgaacatctgcagtaaagtccacttccgaatgtacccagaacgatttgttgatggcttctacaaattgaagaacctccgggtattcaaatggcttatagcttactcttttatcaaaaattcccatattaaatatctttataattaaataatttagatccttgtggataacgttccggaaatacttaagtttttgtttttctgcagcttgtgaattgaagttatccacttttgcaaatccatatttcttgtaaagaactaatagcaaagttcgaaaaaaagaactgattttgaaaggggtaaatactaatcggctgacttttagccggaaaagttttccacatttacatgaaacagcctcgtataataggctaaacagcaatcttgaggataaatacattgaaatgtgaagttacagttaaacaattttgtataaagtattattaataaagggttaatttgttaaacaaaaaaatatttgaataaatttttattcttgtaacaatttgaaaatatgatctacttattgggtataaaaacatacatcacttaatgttagtaattcaggatttaaataagtcatacgatacaggcaaaagcaaacttcatgttcttaaaggaattaatctgaatatttctgaaggagagtttgtttctattatgggaagttccggttccggaaaatctacattacttaatattattggaattctggatgaaaaagattcaggaacctacgaattggacggagttcccattgaacatttatctgaggtaaaagctgcagaatacagaagccggtttttaggatttatttttcagtctttcaatcttatcaattataaaacagctttggagaatgtagcacttccactgtattatcagaatgtgccgcgaaaagaacgaaatcagaaagcgctggaatatctggaaaaagtaggactggctcagtgggcaaaccaccttccaagtgaactttccggaggacaaaagcagagagtagccattgcaagagctttgattaccaatccaaaggtagtacttgcagacgaacctaccggagcactcgattccaaaactacccatgatattatgaaacttcttcaggatatcaataatgaaggaaaaacaataatcgttgtaacccacgaacctgatgtggctgcacagaccaaaagaaatgtagtcctgaaggacgggattattgaaagtgatgagtttattaagcagattgtactataagtgaatagtgaatggtcaattttgcttcgcaagtgaattctacaatgaggaagacaaataatttataatacacacaaatgaatatgaaaaaaaataaaaatgtttttaaatctgaaccattataagcttgatgtatatcaatcagccagagaattaagaatagaatgttacaaggctttatctaaaattcctgatcatgaaaagtttaatgtaattgaccagatacgaagagcttctacttcagtggtattaaatattaccgagggatgctcaagaagatctgaattagaaaggaaaagatattttgaaattgccagaggttcggttattgagttagattcttgttttgatattgttgtagagtgtaagtgtattaaaatagaagaattaacaaaaattggtaatttaataaaaacagcatttatcttgttaagtaaaatgttgaaaagtgattagaatgtaaaaattaattaggttcgtaactgaagtctgatgaagggtaaattgacaacaaggttgattgacttcgaagaaaattgagagcgcagctaattgacttttttacacagtaaaaaaataaaaaatatgtttgacctagatcgttggcaggaaatattcagttctatccggagtaatgtacttcggacggtgctttcagggtttactgtagctttgggactgtttattttcatcgtcctttttggaattggaagaggacttcagaatgctttttctgaaggatttgcaggagatgctaaaaatcttattattttttccacaggaaaagcctctttagcttataaaggtcttcagtctgaccgaaatataacaatgaataactcagactatgattttttaattaatacggataaggaaaaagcgggaccttccagtccgagatatagtgccagtttaatggtcaaatatggaaaagaaagtggtctctatcagattaatggtgctgaacctggtgaacaggtcattgaaaacagaaaagttattgatggcaggtatattacagcgaaagatctggaaagaaaattaaatgttgcggtcattggaagaatggttcagcgggacttgatcaaaaatggaagcccgataggaaaagaactcgacattaacggaacaatgtataaggttatcggagttttttccgatgatggtggagatagagatgagagacatatcacagtacccattaccactttacagcagatgaagaaaggatctgatacagtaaatatagcttatataacatacaatgagaaactgactccggatcaggctattaagtatggtgatgagcttaaagataaattaaaagcaagaaaaaatgtttctcccgatgacgagaatggtgtccgtgtctggaataacgccaaaaatatgaatgacacctttacattcatggcggtacttacagcaattgtaggatttatcggactgggaacattacttgccggaattatcgggatcagtaacattatggtatacattgttaaagaaagaaccaaagagatcggagtaagaaaagctattggtgcaaagccagctggaattgtagggcttattgttcaggaaagtgttgtgattacagttatatcggggcttgttggagtaggagtaggagttttgactttaaatcttatcgggaacagccttgaagagtttttcattaaaaacccaagtgtaggctggggatccatcattatggcattcattgcactgattttctctggactgattgcaggatttgttcccgcatacagagcctcaagaattaaaccgatagaagcattgagaacagaataatttgctataaacgaaagttgaaaaaagcaaaaaagaagataaacagattaatgggattcattatttataacttataatttagaaaggtgaatatcatatttaaaaaagacacttggcaggaaatttattattcattgaggaataataaactccggacatttcttaccatgattggcgtaggatggggaatgtttttgtatgtgagccttcttggagctgcaaaaggaatggaaaatggttttgataaactattttccggttttgctaccaattcaatcttcctgtgggcacagaagacgtctattccgtacgaaggatttcctaaaggaagagaagttcacctgaacctgaatgatatggaaatgctgaaaagaaaagtaacagccatagattatatctcaccacaaaatgccagaggaagctttaccggaacaccgggggaaagcatgtcaagaaacgggaagaatggaacctattcgcttaccggagattattctgtaggaaacaaaatttcagaaaagaaactgatcttcggacgatacatcaatgatgctgatgtttccgggaataaaaatgtagtcgtaataggagaagaaatttataaaaatttcttcgattccaagaaaaaagaaaacccaatagggaagtctatcaatatcaaaggactgttttttaatgtaatcggggttttccgtgtaaaaaaaggaggaggatttgaaaatgaccagactgcttttattccactttccacgtatacgaaaatgtataatgcaggagaccagatcgacatgtttgctattgtaagcaagcctaatgcaaatgttaatgcagtagaagaagatgtaaagtacgctttaaagacaaagaataaagtgtcccctgaagataccaacgctttcgggagtttcaaccttgggaaagaatttaaaaaactgacaggttttcttacaggaatgcagctgctgactattatcgtgggtacactgactatccttgcaggagtaatcgctatttcaaatatccttttgatcacagtaaaagaaagaaccaaagaaatcgggatcagaagggcattaggtgccaaacctgctgaggtaagaaatcagattttgctggaaagtgttgttattacgctctcctcggggttgataggttttatgtttgggatttttgtgcttatgattcttaatgctgttactcagggccaggactcattcccattctataatccgacagttaactatggaaatgtgtttgcggcaatggcagtaatggtggttttgggacttgttatcgggatgattcctgcacagagagctgtgaagattaaacctattgaagcattaagaacagagtaattaatttgaaaaatgaatcaatttgaaaataaagaagaacgattgatcaatgaacaatcaatcttttaatttttcaatttatttaataaaaaataaactatacatatgaaaaagaaattcacttggaaaaaagccatttatatagtgttggggcttttatttgcagtggcattattctcagggattggctatcttataaaatctaactctaacgaaggtgaggctttccttacccgcaagcctaccgttcagaatatggatgataaggtaatggctacagggaaaattgttccaaaagaagaaattgagatcaaacccaatattgcggggattatagataaaatcttagtaaaagaaggagataaagtagaagtaggccagttgattgctactgtgaaaattgttccaagtatctctgaagtaaatgcagctcagcaggaagttcagaatgcacagatccagatcagcaatgcccagatgaatgtaggaaatatgcagaagcagtttgatatgcaggaaaaactttataagcagggagttgcttctaaacaggagtttcttaattcccaacagcagttattctctcagcagcagactttgaaaaatgcacagcagcaattgaacaccgctcaaaaaagattgcagatcgctaaaacaggagcaactcccgaacttaaaggtcaggggttggcaactaccgagattcgttccaaagcttcaggtaccgtacttgaagtacctgttaaagcaggaagtcaggtgattgaagccaataatttcaatgcgggaactaccatctgctcggtagcagatttaaatgtgctgatctttaaaggcgaaattgatgaggcacaggcaggaaagttaagagaaggaatggatatgaatatcgtaatcggagcattacaaaataaaactttccctggaaaactgaccatgattgcccctaaaggaaaagataatgcaggaactattaaatttccggtagaaggtaacgtaagtaatcctaataatgagtatattagagcaggtttttctgcgaatggtgaaattgtcttgagttcccagaaaaatgcattattattggatgaatctttagtgcagtatgaaaagaaacaaggaaaagatgttcctttcgtagaaaccaaacaaaaagacggtaaattcaaaaaagtatatgtgaaactgggagcaagtgacggaatcaatgttcagattcttcctggatcaaatattacaaaagatactgaagtgaaagtttggaacccatcagataaagacaaagaagagctgaaagaaaaagccaataaaaaataataaactacactatacacttttaaactgtaatcctggaggaattctttttctccgggattttttatgtcaaaatttttaaaagagttaattcctatatttgaatcaaataaatccatggaaaatgtgtcgatacgctgggaaaacctataaatcacattatgcatgttttaaatgccggaaatcatttaagcaggcagatagtagtgatattttagctgcctgccagaaaactcttatagaggaatgccccggaaagaataacgaaattaaatattggtctgacaatattcagaaaataaaaactgaaattattggtaacaggtttgaaataacagtataacggaaaagaagtttaaactgtcttatctttgaaattccaaactactatacccatgaaaaaagactattggattctcgttctttttatcattgcaaaatttgctcttcaatattcattgataagtcctgaatatgaacttcacagggatgaatatctgcatctcgatcaggcgaatcatcttgcatggggatatctttcagttccgcctgtcaactcctggatagcgtggattattaaaatgttgggaaactccgtattctgggttaaattctttcctgctttatttggagcaatgacaatagcccttgcctgggaagttgttgaagaactgaaaggaagtctttttgctaaaatacttaccgcatcaggtattctattctctgtgcttcttcggataaatatgctattccagcccacatcactggaaattttcctttggctgtgtctttattacagtttgattaaatatttcaattcccaaaaagttaagtggatttacataggagcagtcatttttggaataggaatattgaataaatataatattgcttttgccgtccttggactcattcctgcatttctgttaacaaagcaaagaaaaatctttatgctctctcatgcgtattgggcagcgcttttggtgttaattattgtttttcccaaccttttatggcaatatcagaatcattttccggtcattcatcatatgaaagaactttcagaaagacagcttgtgcatgtagaccggatggattttatgaaatctcagattctctttttcataggtgtcatttttgttatcatagcgggctggggagcgttattgttgtataagccttttgagaaattccggtttttcttttggagttatagtattacaattaccttgttcttattttttaaagcaaaagactactatgcaataggactctatcccgtttatattgcctttggtgcagtttatcttggacatctatttgaaaaaggatggaagaggtttttgaaacccgtcagcattctgattccgatgcttttatttcttcccttatataatgtagcctttccgaataaaagtcctgaatatatagtctctcacccggatcagtataaaaaattggggctgcttcgctgggaagatggaaaagatcattctttaccacaggattttgctgacatgcagggttggaaagaactggctcaaaaagtggacaaagaatattccaaactggtaaagaccggaactacgatggtcttgtgtgataattacggacaggccggagcgattaattattattcaaaagtgggtgttgtagccatgtcatttaatgcagactatatcaattggatagatttaagcaggaaatacaaaaatgtaatcagagttaaagatgcttccgaagcaggaaaagaacttaatgaatccggttccttttttgaagttgcggaactaaaggattctattaccaatccatatgcaagagaaaaaggaacagcgattttcagccttcagggggcgaaaataaatatcaataaaagaattcaggaggaaattaacgaagttaaaaatgaatggaaatagtttcagtataaacgataaatgatcacttgtttacggaataaaactaatagataaaaagtattattgcaactatattgcattaattaattttgctttacctttgtattatcaattatcaattatcaattatcaactatcaactgaactatggaaaataaaaattttgatgttatcataataggaggaagctattcaggattatctgcgggaatgtctttgggaagatctttaaggaatgttttgatcattgataatggaaaaccttgtaacagacagactccacattctcataactttgttactcacgatgggaaaacaccgtcagaaatttcaaaactggcaaaaaaagatgttgaaaaatacaatactgtcagtttctataacggaaccgctgtgaaaacacaaaataccagcgacggttttaaaattgaaacttcatctggtgaaaaattcaattctaaaaaacttattatagcttccggagtgagggatgtaatgcctgacatccccggatttgcagaatgctgggggatttctgtgatacactgtccatactgccatggctatgaagtaaaaaatgaagtcacaggaattctctccaatggagatatggcttacgaattttcaaagctgatttttaatctgaccaaaagccttaccttgtttacgaatggaaaggcttcccttactgatgaacaaataaagcaactggctcagaataaaattaatcttaatgaagatgagatcgaaaaaatagagcatgataacggatctgttcagaaaattattttcaaaaacgggaaagaggtttctttaaaagctttatatgctaaaattccttttgaacaaaatctaaatgtatctgctgacctgggatgtgagctgacggaacaaggtttcattaaagtagatgcaatgcagaaaacaaatgttccgggagtatttgcctgtggagataacgtaaccatgatgcgttccgtagccaatgcagttgcaaaggggaattttgcaggtgtcgtggttaataaggagctttcagatgaagaattttaaaaacattttagtatcattaaaacaatcataatgttagatttattgatgaatgttttcattttttagtgtttaaaaatcatttttgctatagagaaatctcgacgaaaattccgtacatttggggtgaaaatttcaaaaactaaaagtaaaatggatattattttcgacctgattgaaaaggaaagacaaagacaaacccatggattagagcttatcgcatcagaaaattttgtttctgaaaacgtgatgaaagcaatgggaagtgtactgacaaataaatatgctgaaggatatcccggaaaaagatattacggaggatgtgaagtagtagatgaggttgaaactttagctatcaacagagctaaggagcttttcggagtagattatgtgaatgttcagccacattccggttctcaggcgaatgcagccatttatcttgcagttttgaaacctggtgataaaattatgggaatggacctttcaatgggaggacaccttacccacggttcagcagtgaacttttcagggattcaatataacgtagtttcttacggagttcagcaggaaacaggtcttattgattacgaccaaatgagagaagtagcgttgagagaaaaaccaaaaatgcttattgcaggtttctcagcctattcaagagatttagattatgctaaattcagagaagtggcagatgaagtgggagctactctttgggctgatattgctcacccggctggtttagtagcaaaaggattattaaattctccattcgagcactgtcatgtagtaacaactacaactcacaagacccttagaggcccaagaggaggaatgatcatgatggggaaagactttgaaaatacatatggtcacaagactccaaaaggagaaatcaaaatgatgagccaggtgctggatggggctgtattcccgggtattcagggaggaccacttgagcacgtgattgctggtaaagctgtagctttcggggaagctctggatgttcagtttgaaacgtatgcaaaacaggttaaagcaaatgctcaggcattatcaaaagcaatgatcaacagaggttttgatatcgtaagcggaggtacagataatcacctgatgctggtagaccttagaaataaaggagtaaacggtaaagaaacagaaaaagcattagtacttgctgatattacatgtaacaaaaacatggttccttttgatgacaagtcgccatttacaacatctggtatcagattgggaactgcagctatcacaacaagaggattgaaagaaaatgatatggatactatcgcgggactaatttctgaagtagtagacaatatcaaaaatgaagaagtgattggatctgtaagaaaaaaagtaaacgaattaatggaaggtaaagctctgtttaactactaacagactttccgatatcatataaagaatgggcagactgctcattcttttttttattgaatggaaaagaaatcttatactttcgaggaaataaaacagaagctggtcaattactgtgtttaccaggatcgctgtcatgctgaagtggaacagaagatgagagaattcctgctcatagatgaagcgaaggaagaaattattttatacctgctgaaagaaaattatctgaatgaagaaagatttacgcgcagctatatcagaggtaaattttacatcaaacattggggaaagaccaaaattaaaatgaatctgaagcagaaacagatttctgaaaagttaatcaattcatgttttgatgagattgatgacgctgattatgaaaaaactatcagaaagatgtttgatgattattattctaaacaaactggcttgaaagaatatcaaaaaaaaaccaagactataaaatatttgatgagtaaaggttttgaatatgagaaaataattgatatttttgattaaatatttaatgaattacaaaaacttgacgtatgacttttaggaaaaaaataaaaagttcattgaaaaagattgatatataaagatttaaaaattattttaaagaaaaacagcctaaataagaatttttatagataaatatctgctttataaagagcttttatggtatgatttttgtctgtgagtttagctgtatcataaatgaaattattagatttcataaacataacatcaaatttatttttgatttcagcatattgaaataaatttatttatttttgtgtgattgtgccaaaattatctttgattggataatcagatattatacattaattaaatatgaacaccaatacagacaatgtacaattctcttagaaaaacaatatttggaggggataatgttgtcaatctctcagacgtaagatatcttcctcgatggataattcttgtaatagacattattattctgatcatatctttatttctttccacttacattatcgcaaaaattaccaagcaggaatttatataccacgatgataaaagtttagtttttgcttttattattctggtgaatgctgtttttatgtatgtcttcaagacttatgccggtattattcgccattcaacatttatagatttatttaaacttctgatatcgtgcttttgcacaatgctgactatcggaattataaatctttcctatttctggatcacaggaagtaagtttatacttactccttatctgatactttactttgtaatttcttttatgggattattccttttcagattatatgtgaaagagtttttccatattgtaagggagtacagaagaagtgcactgaaaaaaaggattctggtattgggaattgatgaacaatctattgcgattgcccgtgctattctggataatccaagtttgccatatcaggtagttgggtttttaactcagagaaccgattctaaaagagcgtctctgttaggaaaacccatttatgagaaggaaaagatagaagagcattcaaaagatgatcttatggttgacggtgttctcattgttaaagagatgatggccagagatgagatgaacgcctgggtgaatttgtttttagaaaaagatctgaatgtttttaaagcaccctctgtacagaagttaagagacagtgatcttggcgggtctattaaaaatcttcaaattgaagatttgttaaacagaaaaccaattaaaattcagaatgagaaagttaaaagcagacattttgataaaacggtattggtaaccggtggtgcaggatctataggaagtgagattgtaaggcaggttgctctttttaatccttctttaattgtagtattggaccaggctgaaacacctctttatgaaattgaacttgaaatgagagagaaatttcctcatatcactttcaaatttgttttaggagatgtttctaaccatcacagaatggaatctctgttccagacgtataatttttcaatggtataccacgcagcagcctataagcatgttcctttggtagaagaaaatcctcatgaagccatttttgtcaatatattaggttcaaagattgttgcaaaattatccagcaagtataaagtaaacaggttcgtaatggtatctacagataaagctgtaaacccaaccaacgtaatgggagcttcaaaacgtgctgcagagctttttgtacagtcgcttcagaatgtagaaggtaatgtgaccaagtttattacaacgagatttggaaatgtattaggatccaatggttctgtaattcctcattttaaaaagcagattgaagctggtggcccggtaaccattacccacccggaaatcgtaagatatttcatgacgattcctgaggcctgtgagcttgtacttcaggctggaacaatgggagaaggaggcgaaatttttgtctttgatatgggggagcctgtaaagattattgatcttgccaaaagaatgataaaattatcaggattcgaacctaatattgatatcaagatcatctatacaggattaaggcccggagaaaagctgtacgaagaacttctgagtgatgatgcaaaaacacttcctactcataatgacaaaattatgatttctaaagatccttcaatgggatttgatgatatagacaggcttactaaagaaattaccaaggcttccctgcgaagagataaagtggaagtggtaaggattcttaaaacaatagtgccggaattccgaagcaataattcaatttatgaagctttggataaatagaaaaaatataaatgtatatttgcacaatttaacaaaataatgaaaggaaaaataatagcattagttttggtgtcctctttagtgatttcctgcaaagtgaaccccaatgctaagaatgatttaaattatatgcagaatatagaacaggtagcaatcaatgcatctgctaaaaattcagcaaatacaatccaggtaggagatcagttggttattctgatcactgcgaaagatatggatgttgtaaaaccttttaatcagaattattcttcctcagaacttatccaaaccaatacaatagccggaggaaatactcctaatcaaggaacaacagtgttatcaggacctacttatatagtagatgcaaatggagatattgacttcccaatattaggaaaactgaatacatcagataaaagtttgactgcttttaaagatgaactgagggaaaaaatgacaaaatatgttattaatcccacggttaatgtgaggctctcaaattttaaagttacaatacttggagaagtcaacaggcagggagactatactatagcaaacggacaggcgaccattttaaatgcattaggtatggctggtgacttgacgcaatatgggaaaagagaagatatattggttatcagaacagaaaatggtattgtttctcatgggcgtgttaacctacatgatgctaatttaattaactcgccatattataatctgaaacagggggatgccattattgtttcttcaaacaatacaaaagatgttatggcaaaacaaaatcccaatacaggtctttacctgaccgctatttctattgcggttacagcagttgccgttgtagtaagtttatttaataagaaataaagattgatggataaccagagaacttcacaatttttggaggaagaaacaaaattaaataaggttagtattaatgatgtaatcaaaccatatctaagaaaatggccatggttcatttttagtgcaattatagcattagtaatcagttattttgcaataaaatttattacgccagtttattacgtagagactacattacttataaaggattcaaaaaactcttcatcggctaatgatttaggcgttctttctgatttatcaggtctgggagggatgaaaacaaatagtatttctaacgagattgaaatactgaaatctaaaaaattaatgcgtgatgttgttgttaatcataatctccaaacaaccatcattgctaaaggcagaatcagaagtattgagctttacaaagaatcatcacctattgatgtaaagattgtaaacgaaaaatcatctaaaggctcaactaattatataaatgtagaattaaaaggagaacagattttaatacagtatgatgggcttaataaagaaattatatccagctacggtagaatgatcaatcttccttttgctaatataattattactaaaaataataaattcaacaaaaaagctgcacaaggagcaaatacaaataaattagaactaaaaatttcatctgttgaagcaaaggttaatagtttaactggtgctctaaatgtaagtctagctaataaagacgctactgtacttcggttatctataaattatccacaaacttcaaaagctgaagatatcctgaattctttagttgttgcttataataatgatgctattttagataaaaacttggaatctagaaaaacgttggatttcatcgaggatagagtgaaaaaactttctgttgaacttgggcaggttgaaaatgaaaaagaaagttttaaatccaagaataatcttaccgatcttgaggttgaagctaaaattaatttagagagttcagccacagctcgtggaaaacaattggatctcgatgctcagatcgaattaacaaattctttaatctctttcatttctaaacagggacaatatcaggctttaccttccaatattggcttaaatagtgctgaagcagcttcagggattgcatcatataatcaattgatattacataggggaagattattggaatccgcaactccggaaaacccaacggttgtagaaataagtaagcaaatcaacgtacttcgaaactcaattgttgagacacttcaaagaaataaaacaggattggaacttgcccgaaatgaatatgttggagaacagaataaagtttccggaaaaattgctaaaattccatctattgaaaaaatgtttagaggaatagaaagacagcaacagattaaagaaaatttatatctattattgctccaaaaaagagaagaaacagcaattgcgcaatccattacagcacctaaagcaagagttattgatcaggcttatgcttcagcaaatcccgttgctcccaaaacacaggttattctgctggcagcattatttataggtcttcttataccatttttaattatttatttctcagaattattaaataataaaattgtcactaaacatgatttagagaaattagtacatgcaccaataattgccgaacttccaagtcttgaaaagggagattctgaaatcgttaaaatgaacgatattactcctatggcggaagcattcagaattcttattaccaatatgaacttcatgctttcaaaagagaaaaaaggaaaggttgtatttgttacctctacagtaaaaggagaagggaaaacatttacttccgttaatctagctcttactctggcaaaccctaagaaaaaagcaattatcatagggtccgatatcagaaaccctcagcttcagagatataatccggcaagaaaagggcttgcaggacttacagagtatctttataatgatgagacgaaacttgaagatattattcatgtctcatcttttaatccgtatctggatgtaatttattcaggaatgattcctcctaatccgacagaactgttatccaatggccgttatgagactcttctggatcaactgaaggaaaaatatgaatacattattctggatacagcaccattgctgcttgttacggatactttccttattgctgaactttctgatgttactatctatgtatcaagatctaaatacacagaaaagtctttattagaatttgccaacagcaatattgatcagaaaaagatacgaaatgtgggatttgtacttaatgatgtaagcagggaaaatttaggatatagtaacaaatacggttatggctataatcagcattcagaacaatcatggtttcagaaaataacaaataaatttagttaatgataacagcatataaaatagcggttataggtcagggttatgtaggtcttcctctatctcttgagtttgccaatcactatcctgtatttggttttgatattcatacacagcgtgttgaccagcttaataacggaagagatataacgcttgaagctgatgttaacaaattaaatgacagactgaaaaaatataaagaatctaagggctctttaggctataaggctacaagccggttatctgatatctctgatgccaatgtattcatcgtaacagttcctacccctattgataaatataatgccccggatctgactccattaatttctgcttcaaaaatgttaggagagattattaaaaaaggagatattgttatttatgaatctaccgtttttccaggatgtacagaagaagaatgtgtaccggttcttgaaaaatattcaggacttaagtttaacgaagatttctttgtaggttattctccggaaagaattaatccgggagataaggtaaatacactaacaagtgttaaaaaagtaacttcaggttctacaaaagagattgctgaacaggtagatcaattatataagaagattattactgcgggaactcataaagcgccaagcattaaagttgcagaagcatcaaaagctattgaaaatgcacaaagagatgttaatatttcttttgttaacgaattggccttaatttttgatagagtaggaattgatacccatgatgtattggaagcggcgggtaccaaatataattttcttaaatataaacccgggttggtaggaggacattgtatttcagtagacccttattatcttgcacacaaagctgaacagctgggatatcatcctgatgttattttatccggcagacgtgtcaatgattccattgcaaagtttgttgctgctaaagtagtaaagcttcttatcgcaaaaggtggagtgattaaaaattctaatgctctgattttaggagttacattcaaagaaaactgtccggatgtcagaaatacgaaagtagtggacatctacagagaacttactgattacggagtaaatgtagatatttacgatccatgggcaagcaaagaagaagtaaaacacgaatacggaattgatattctggatgctctttatgaagggaaaaagtatgattccttagtgattgcagtatctcataatgaatttctggaaatggatctggatctgcttaaaaaagaaaatgctgtggtctttgataccaaagcatgtttagacagaaatctggtcgatgcaagattataaaagatcatgagctatgatatcatcatcatcggtgcaggtttggtaggattggctacagcctatcagactatgcttaaaaatcctggttctaggattcttattttagaaaaagaaaacgatgtggcattgcaccaatctggacataacagtggtgtgatccatagcggtatttattataaaccaggaagtcttaaagctagaaattgtattgaaggatataactcagtgattaattttgctgaaaagtatggaataagatatgatctttgcgggaaaataattgtagccacctcacaggaagaattaccacttttagataatatttataagagaggagttgaaaacgggctacaaaatttaaagtatctttcaagagaagagttccgtgaaattgagccccattgtgaaggcgtaaaagcaatcaaagttccacaaaccggaattatcgactatccgggaatagctcaaaaaataaaagaactttttgaagaattgggaggagaagtaagatttaacaatgaagtaaaaaatatcattgataaaggatctgaaattattgttactaccaatatttccgaatttaaaagcaaaaaactgatttcctgtgcaggattgtattcagataagataaccaaaatgaccaacaaagaaaatgatgtggtcattattcctttcagaggagaatactataaaatcaaagatgaaaaaaaatacctggtaaaacatcttatttacccggtacctgatcctagctttccttttcttggtgtccactttaccagaatgattgatggtaatattgaagccggtcccaatgccgttttggctttcaaaaaagaaggataccatttttttgatttcaatttcaacgaaaccatgcagaccatgctatggcccggatttagaaaaattgtagcaaaatacggaaaaacgggaatggaagaaatgcaccgttcactctctaaatctgcatttacaaaagctctgcaaaaacttttacctgaaatacaggaaaatgaccttgtaccaggaggttcaggagtaagagctcaggcttgcgacagaaatggaggattaattgatgattttgacattgtgaaaaacggaaatatcattcatgttagaaatgctccttccccagcagccacatcttgcctttctataggaaatacaataagtgagcttatcatgaattaagaaatatacctatacgtgtactcaaaaactcaaaaactaaaatatgaaaattcaaatggttgatcttaaaggtcaatatcagaaaataaaagaagacatagatgtaggtattcaggaatgcatagacagtacagcatttattaacggtcctgctgtaaaagaatttcaacacgatttcgaaagatatcttggggtaaaccatgttattccatgtgccaatggaacagacgcccttcaaattaccatgatggccctcaacctacagcctggtgacgagataatctgccctgctttcacttatgtagcgactgcagaagtcattggtcttttaggattaaagcctgtaatggtagacgtaaacgcagatacttttgatatacagctggaaggtcttgaaaaatatcttacccccaagaccaaagcaattgttcctgttcatttatatggacaaagtgcagatatggaacaaattcttaaatttgcagaaaaacacaacctttttgttatagaagataatgctcaggcaatcggctcagattatacgttttcagatggtaccgttagaaaaacagggactatcggacatattggctgtacttcattttttccttcaaaaaatctgggttgctatggtgatggaggagctttgatgacaaatgatgatgaattagcctccaaaattagaatgattgccaaccatggccaggaaaagaaatactatcataaagttttaggttgtaactcaagattggataccattcaggctgctatattaaaagtgaaacttaagcatttggatgagtattcagctgcccgaaacagaatggcagattattatgataaaaaccttaaggggattgctgaaattcagattcctaggagagctggaaattctacacatgtatttcatcagtatacccttagagtgaaaaatgaaaaaagagacggattacaaaaatatttggcagaaaagaatattccaagtatgatatactatcctttgcctctttataagcaggaagcttttcttcaatatgtagaagatggctttagtcttccggttacagagcaactttgtaaagaagttatctctcttcctgtccatacagaatttgaccaggaagtgctggatattattattgaagaaattaagaattattttaactaatataaaagcagatatgtctgatttttttgcacacgaaacagccattattgacgaaggatgtcaaataggaaacggaaccaaaatctggcacttttcacatcttatgacaggttgcattttgggagaaaaatgtaatattggacagaatgttgttatttcacctaaagtaattttgggaaaaaacgtgaaggttcagaataatgtttctatctatgaaggagtaacctgtgatgatgatgtctttttaggaccttcaatggtttttaccaatgtaataaatccaagaagtgcagtaaacagaaagaatgaatatctgaaaacacatgttggaaaaggggcctccataggagctaatgcaactattgtttgtggacataatattggtcagtatgcttttattggagcaggagctgtggttaccaaagaagttccggattatgcattggtagtaggaaaccctgccagacagatgggatggatgagcgaattcgggcacaggcttcagtttgatgcagaaaatattgccgtttgtgaagaaagcggagaaaaatacaaattagaaaataataaagtttcaaaaatttaaaacatacaaatgagtgaaaaaataaaatttgccgtagtgggctgcggacatatcggaaaaagacatgccgaaatgatctcaaggaatgatgaatgtgaactagtaggattaattgatgttaaagataaatctgtccttggaattgaaaattataatgttcccttttttgcttcactggatgaattcctgacttccgggattgatgtggatgttgttaatattgcttctccaaacggattccattttgagcagtcttacaaagtaatagacgctggaaagcatgtggtagtagaaaagccaatggctctgaaaaaacaacatgctgaaaaacttatatttcaggctttacataagcataaacaggtttttgcggtaatgcaaaacagatattcaccaccttctgcttgggtgaaggaaatggtagagagcggaaaacttggtaaaatatatatggttcagcttaattgctactggaatcgtgatgaaagatattataaacctgaatcatggcatgggaagcttgatctggatggaggaacgctattcacacaattttctcactttatcgatattatgtactggttgtttggtgatattactaacatccaggcaaaatttgcagattttaatcatgcaactcttacggatttcgaagattcaggttttgtgaactttgattttgtaaacggtggaatgggatcattaaattattctacttcagtatggaatcagaaccttgaaagctctatgaccattattgctgaaaatggctctgtaaaaataggtggtcaatatatggataaagtggaaatttgtaacgtgaaagattatataatgccggaattaccccctacaaatccagggaatgattatggagcatacaaaggatctgcagccaatcatcattatattattgaaaatgtagtagatgtattgaaaggaaggaatactattacaaccaatgctttggaggggttgaaagtggtagacattatagaaagaatttatgctctgaaaaaataataattgtttttattgttaaagcaatagttgctgaaattatataaatatgctaaacagtttggttactttcaacaaaaaattatgaatgataaatcgtttgaatagttttgaattttaaaaatattttaaatagtgtaaaatcgaattcttttttacaaaacgtagcaatactatctagtggaactgttatcagtcagctgatagtaattgcggcttctcctcttctttcccgaatgtattctgttgaatcatttggtattctttctgtttttacaagttttactgtttttttggcagtcctttcaaccggacgttatgagttggctgtcgggcttccaaaagaggatggcagagcttcagcaatatttaaacttattatttatattgctatttcaatatcattattatactttgttttgattcttttattgaaaaatgtttttcatatccatgataaaacacagtttctctcaaataatgaggtatatatagctcccttgtatattttttttggtgctgtttattctgcattggggtattggaaccagagaaataaaaaatataaaaaaattactttttcaaatgccatacaagtaattacttcttgtttattcagtgtaatattcggaatattggggtacaaaaatggaatgattgtagggatgatattaggcgtctttagttctatactttatttacttttaacagacagggaattaagaactttcttaaaatctcatcataatgagttaaaaaatgtagcaaaagaatactcttcttttcctagatatatgattatttctgatatgtctcttgctgcttgccaacaatttatcccaatattattttctgttttatataatactacaattgtgggttttttttcaatggcaaataggatgatcagactgccaaatatagttattactacttcagtgggaaatgttttcagaaatgaagctattgatgagattagagaaaaaggtaattgtaaagacctttacagatctactattaaaaaacttattttaatgtcatttccgatatatttagccatattcattatctcacctaagttattcgtttttgtttttggtgccaaatgggaggttgccggttattttgcgagaatcttgtccgtaatgcttttgatggagtttgttgttactcctcttaataccttattttatgtagtgggtaaacaaaaaatattaatgagactacaagttgtcaatgctttgttggtttttatttcaatttattcaggctattatttcttttcagattattatatttcactgatattattttctggagtttctatcttatcaaatattattttcttaatttttacaaataaattatcaaaaggtgtacattgaaaaagtaaataaattacaagtcgtttttttggttctgatgctttatgggtatgaactggtatctttttttcccagtttgctgaatatggaatcatcaagacctgtatctgtagcatacagaatatttgtttttttattggccagctgggtaattcttaaaaataaaatcagaataacaaataaacaccttttaatatatactttttggttcctgtatttattacggttgctttatgattcagcattgacttcaaaaatgatacagtctcctattgtagattattgggctttctctgtagggatcattggctgctcattggcatgtacaacaaatttcaatcaaaatacaatcatatcagcacgaaaatgggtggtaattgttttatatattgttaatttatggggactgtataataacatcacacaacctcaaatagtaccggatgatgttttgataagagcagatgccaatgctgctctcaatactgtatctttcggtagggcagctggtgttatgttctttgtttgttttactatatttttagaaaaaaattcaacctggcagaaagttttactaggcataggaatgggcgtcagccttttcaacttgtttatggccggttcaagaggtcccttgttacagttagtaatagttattattgtatttttattaagttccagaaaacttattaagccgaaatatattctcttatttgtaattatggtagtaatactgatgaccctttttcctcaatacttaaacatttcagaattagtttttgaaagatttaaagaaacaggcttttcttctaatgatagtgaccggtatagagcagaattatttaaatcagcctggaatcagtttcttgatcatcccatctttggtgactcgattgaaactgtttttgaaggtacttatccccataatctgctgcttgaatccttaatgagtattggttttgtaggaggaataatgattattataattaccataatagcattcattaatgctattagatatataaaaattccctattataattggctgggagcaattttattgatggacgtgatttcatccaattcatcaggatctattgccaattatttattgttctggccattattggcatttaccattaatagccatattacaaaacaacaaaacggaaaaacaatacagacatgaaaatattaatgctgtgtgatgcctactttatcaactttcagtatcaggaaaacttaattgcgaaaagctatattaaattaggatatgaagtggtagtgataacaaatacaaatgaaaaaattcttgactttattaatgatattcatgataattcacttcctgaaaaaattgaatatgataatggagttaaaatttacagagagccttatagtataaatattttacaccgggtaagacggttcaaaaatgttaaaagaattctggagcaggaaaaaccagattttctcttttctcatgatatacagtttaatatcggagatttggtagattataaaaagaaatataataccaggattattatggattatcatgctgatttttcaaactctggaaaaaattggatatcaattaacattcttcataaaattatacgaaaaagatacttctataaatataaaaagtatattgataaaatatatccggtagttcctgccagtgaagaattcctccataaaatctatgggatttcatataatgagatggaacttctccctcttggctgtgaatacgatgaatgtgaaaaatttagaaaagaaacggatattataaagcttaggagagaatatggtatttcacccaatgatattgtgattatcacaggtgggaaatttcataagttgaaacgtacagatttggctgtaaaggcagtaaaaaaaataaatcagaaaaatgttcatatgatagtattcggtacagcggataaaaatcatgaagagtacttaaaaactatgctggaagatgctgaaggtgctaatatacattttacaggatgggcagatagtaaaaaaatttatgaactaatggcaatttctgatattgctttatttccggccagccaatcagtactctggcagcagtcaataggaatgcatttacctcttattgctggcgatgctggagggcaggatatgtcttatcttaatcagaataataatcttataaaaatagatgctcctgatattaatgaagattttattaaagaaattttgttagatttaattctgaatcctgagaaaattgtatcaatgaaaaaaggagctgagaaaacagcgaaagagtatttagattattctattattgcaaaaagaactctaaattaaacagttgtcagataaatcttatgaaaatactacaaataagcagtgaagtaaatatcggatctgtaggcagaattgccgaacagattggagaaaacatcctgaatgaaggatggaaaagctatattgcttatggaagggaagctctttccagtaaatctgaggtttttcagatcggaaataaactggacatttataaacatgttattttaacaagacttgcggatagacacggatttggatctggaagagtaacaaaagaacttattgagaaaataaaaaaaattaatccggatattattcatttacagcacttacatgggtattttgtaaatattgatatattgtttaattttttaaaagaagccaatttgcccgtggtatggacttttcatgactgctggtcttttacaggacattgtgcctattatgagttggtagaatgcaataaatgggaaacacaatgtagtgaatgtccacaaatttcagaatacccaaagtctatatggaaagataattcaaaaagaaattatcttgataagaagaagctatttacctcagttccccgtatgaccattgtacccgtatccagttggctcgaaggtgaagtaaaaaaatcttttcttaaaaattacaatgtaagaactattcataatggaattgatattcaaaagtttgtatatatcgaaaatgattttaaacaaagatataatattgaaaataaatttctaatattaggagttgctagcccctgggataagagaaaaggattaaggtattttatagaattatcgaaaatcttgtctgatgattacagaattgtattggttggattaagtaaaaaacaagttgaagctctgcctgtaaatattattggatttgaaaggacaaaagacgtaaatgagctcgcccagctctattccgctgcagatgtgtttgtgaatcctactttggaagacactttcccaactaccaatttggaagctcagtcttgcggaacacctgttattacttttaaaacaggaggttctccggaagcggtcagcgccttaacaggaattgtagtagaaaaaggtgatgtttccgggcttgtaatggctattcagaaagttcgggaaaatacccgtgctttttattctgaaaattgcagaaaaagagtcttggagttatttgataaaaaaaatgccttcaaaaattatattgatttatataaagaattaataaccgagaattaaaaaaacgaataaatagtaaagccaaataggtatgagtttaactgtaaaaatacgatctgcaatcaatgcaatgaccggaaaaattactaatgtaaaaagaaatataaatataaaccataaatggtatggtaatgattacagtggcttttatgtatctccgttaaagcttactgaaaaatcggttatctactcttttggggtaggtgaagatatttcttttgacgaagctttaatcaaggaatttggatgtaaagtatttgcatttgatcctactccaaaatctatagaatggattaaaaatagaaatattcctttagaatttacttttttcccctatggtatagatgatcatacgggagtagttgaatttttattacctaaaaatgataatcatgtttcaggaagtgtgattaatcagatcaatgtggatgaaaagaaaactgtaaaagcaccaatgaaatgtctgtcagatattgttaaagaattggggcattcctatctagatatagtaaaaattgatattgaaggttctgaatacaaggttttagagagtatattgtctgctccggtagagatagatcagatattaatagaaattcatgaaaggtttttttcagatggaaaagataaaaccaaagagcttcttaatatgttggaccaaaaaggatttaaattatttgggatatcagattcaaaagaagaattgtcttttataaaagtatagttgcttatttcttttttaataattgtaaacagaaaattatgaaaagtttattatcatcattatttttactgttgatggcttgcacatcaacttcacaagttaaaaataaccagacaaaactctattacgcattgggtacaataggaaacaaggctgacaattattttaaacagataggggcggttgaagtgggctttttagatgaaggacagttcatttccaaaaccggagataagtactatctgaacaaagaattgctggagaaagaaatcaatagaggagttcccgataaaaatgcaaaaggtattgtttatatagacttagaaatgccatttgaagatatgaatggtaaggataaaaatcttgctatgaaaggcatgaattattgccttgaagtattaagatatgctaaaaaagcaagaccaaatataaagtggggcttttatggattcccatttaccagtgtttggggaccgaataaggaattttttgatgaacaaaacaaatttgcgctcctattgaaagaatgtgatattttttttccgtcactatatactttttatagtaatcctgcagcggttcttgctaatggtaattacctggaaaataatctgactggaagtataaaattaggaattgcttataaaaagcctgtttacgtttttatgtggcacagataccataacagtaatgagaaagatggtatgaaggaaatttcagataagatatggcaggaacagatggaaactgttgcaagtcaaaatgtaaatggtaaatttgtagatggaattttatggtggggagccgatgcctatttttatgagagacctgaagcggaaaatatgagaaaagaatttaaaggaaccctcaataactttatttctcataatgatgagtcgataataaggaaagccaagataataaaagacgttttacaaagtaaaaaatgatgaataaaagaccatatcagatctgtacaaaaactataatggacactacagaccctaacattatttttaatgaaaagggagaaagtgattattataccaattttaaagaaaatatagaacccaactggcatacagatcagcaaggatacgatgaattgatgaaaattgctgatagaatcaaaaagacatctaaaaataaagattttgattgtattattggtctaagtggcggattagacagttcttatgctgcttatatagcaaaagaagttatggggattcgtcctttgatttttcatgttgatgcaggatggaatacagataaagctgtggggaatattgaaaaactgatcaatggtctgaatctggatttatatactgaagtaatcaattgggaagaaatgaaagacctgcaggttgcatttctgaagtctcaaatctcagatcaggatttaccacaggattatgctttcttttctgccttatataaatttgcaaaaaaaaataaaatcaattacgtacttacaggaagtaatttttctacagaatgctgcagagagcctgaagaatggggaggctttcccgggattgacaccactttggtaaaagatattcattcgaagtttggtaaaagacctcttaaaacatttccgttggttgatattctttcctataaaattctctacaaatacgtatatggaatggaagtattcaaacctctgaatcttgttccgtttcataaaaaggaagccgaatctcttttagtagaaaagtttggttgggaacctttccaacataagcatcacgaatcaagatttacccgtttttatgaagattattggttgccgagaaaattcggttacgaaaaaagaaaggcacatttttcttcactgattcttaccggacagatgaccagagaagaagccttggacagagtttcaagacctgaactttcagaagaattcttacagaaagaatttgaatatgtcgcgaataagttagaccttaccaaagaagaactgcaacagatcttcgaaggaaaaaacaaaacatataaagactataaaaataaaatgggcattatcaaatttggtgctcagactatgcagaagttgggcttagaaaagagattattcagatgattacaattatcgattacggtgtaggaaacatcaatgcttttgtgaatgtttacaaaagagtagatgtacccgttaaaattgccagaacaaaagaagatttagaaggggcccaaaaattgattttgccgggcgtagggcattttgaccatgcaatgactcaactgaataattcaggaatgagagataagcttgatgatctggttctcaatcaaaaaataccagttattggaatctgtgtgggaatgcagatgatggcaaacaaaagtgatgaaggaatcatggagggccttaaatggattgatgctactgttaagaaatttgacgaaacaaaaattcagcaggtaaccagattacctcatatgggctggaatgacgtgaaacctgtgaaagatataggcctttttgaaggattacaggataattcaatattttatttcctccatacttattattttgaatgtaataatagtgaagatattatggcggttacagaatatggaggagaatttgcttctgctgcccatcatgaaaataaattcgggatacaatttcatccggaaaaaagtcaccattatggtgagattttgttacacaattttgcaaaactttaagagtctatgttaagacccagaattataccttcccttctgatacaagataacggacttgtaaaaacagtcaattttaagaatcctaaatatgtaggagatccaatcaatgcagtaagaatttttaatgaaaaagaagttgatgaacttgctatatttgacattgacgctactgtaaaaggactggagcctaactatagtttgattgaaagaattgccaatcagtccagaatgcctctttgctatggaggtggggtaagaactgtagaacaagcccagaaaatttttggacttggaatagaaaaaattgcactttcctctgctgttcttcaaaatcctcagttaattactcagattgcagaaagagtaggttcacaaagtgttatcgttgttttggatgtaaagaaaaaattgttcggtggatatgaagtttacactcacaatggcaaaaaatccactggaattaatccttttaaatttgcagaagaagctcagaaactgggagcaggagaaattatcatcaattcaattgatcaggatggtgtaatgaaaggctatgatatggggttaattgacaaagtaagagagaaaatttcattgcctcttacggttttaggaggagctggatctttaagtgatatcaagcaggtaatagataagcacggtattattggtgttgcggcaggaagcttattcgtatttaaaggagtttataaagctgtactcattaactatccttcctttgaagagaaagaaaaattaagacacaaataattattaatcatatgaaataattcttctgagattgctgcttgtttccctcaaagctttcttgaaaattatcaatgtgacaaggaaaaaaaatactatgcatataaaagataaaatacttcttattacaggcggaacaggctcatttgggacagctgttttaagaaagttcattaatacagaccactttaaagagatcaggattttttctcgtgatgagaaaaaacaggatgatatgaggaatcagtttaaaaatgataaactcaaattttatataggggatgtaagagattataacagtattgaacctgcaatgagaggagtggattatgtttttcatgcagcagcattgaagcaggttccatcatgtgaattttttccaatgcaggccgtaaagacaaatgtagaaggaacacaaaatgttattgatgcggctgcaaggaataaagtgaaaaaagtgatctgtttaagcacagataaggctgcctatccaattaatgcaatggggatttccaaagctatgatggaaaaagttgccgtagcagcatccagaaatttggaagaaactgttgtttgtcttacaagatatgggaatgtaatggcttcaagaggatctgtgattccattgtttatcaagcaaatcaaaaacggagatccgataacggttacggatcctaatatgaccagatttttaatgtctcttgaagaagcggtggagcttgtattatttgcatttgaacatggtaattccggagacttgtttgttaacaaagccccggcaggaactatcggtgatctggcacaggcattaaaggaaatgtttaaggctgaaaatcagattaaaataataggaacaagacatggtgaaaaactgtatgaaacgctatgtacccgtgaagaaatgttaaaagccgaagatatgggaaatttctatagaattcctgctgataacagagacctgaattatgcacagtttttttcagaaggggtagaggatatctcaaaaatagaagactatcattcccataatacagaacagcaggatgtggaagggatgaagaaactgttattaaagttacccctgatccgtaaagaagttttaggagaagatttactacaatatccagattaataaaaataaaatctaatgaatgtacctgaggttctcataggaggaaaatattcggatgaaagaggaagtcttttctttaataatagctttgatgcatctgaaattaaaagaatttactatatagaaaatactgatccgcagtttatcagaggctggacagggcataaggttgagcaacgctggttttcagctttgtcaggaagttttactataaggttaatcaaaattgacgactggtctatgccttccaaaagattagaaattttagaatatcatttagatgccgataaaatggatgttctccatgttcctgcaggctatgcaagtgctattcaatccggagaaaaagaatcaaaattattagtaatggcaaattattctttaggagaaatagatgatgattatcgtttccctatagattatttcgaaaatttataaaatgaaaagaataggaattacgggacagaatggatttgtaggatctcatttatataatactttagggttaaaaccagaagaatttgaaagaatcgaatttaaaaaggaattttttaataacccggagaaattagaccattttgtggagcaatgtgatgttattgtacatttagcggctatgaatcgtcatccggatcccgaggttatttttgaaaataatatcaatttagttaaagaattgatagcttctttagaaagaaccggatcaaaagctcatgttctgttttcatcctcttctcaggaagaaaaagataatttatacggaaagtctaagaaagaaggcagagaattgttttcagaatgggcaaaaaaatccggaggcacttttacaggtatggtcattccaaatgttttcgggccatttgggaaaccaaattataattctttcattgcaactttctgccataaacttactcacggtgaaactcctggtattgatattgacggagaagtcagacttatttatgtgggagagctagttcaggaaattatagataatatatataaaggtcaaaccgatgaattgtatgaagtttcccatacttctgtcaataaagtttcagaagtactggaaaaattaaaccactataagcagctttattttgaaaacggagaaattccggaattaaaaaccaagtttgatttaaacctgttcaatactttcagatgttattttgatgttaaaaatcattatcctgtgaaatttacacagcatgtagatccaagaggagcttttgtagaagtaattcgtttaggaatcggggggcagtgttctttctctacaacagttcccggaattacaagaggaaatcatttccataccagaaaaatagaaagatttgcagtgattaagggacaggcgttaatacagttaagaaaaatagatacagaggaagtactggatttttatctcgatggtaatgagcctgcttatgtagatatgcctatctggtatacccacaatattaaaaatataggtaatgaagagctctatactattttttggatcaatgaaccatttaatccggaagatgcggatacttactttttaaatgtctaatatgatcacgataaagaaaaattatattgagtatatttttattttttttctgacttttgggtatatctttttctactcactcgcagttccttttaatgccccgaatacactattttcggttccttttcgtgttattctgctctttataagtttttacatcatttatgtaaactttgacacgataaagaaaaggaaaaccaacattgtttttacgattcttttttggttgttctactttataaaggcagtttatagctttaaaacagatacttatttacagaaaacattaaataatgaacagcagatttatataagaattattggtttgaatctgataccctatattgctgttttaagtatcagtttttcaaaagaaattgtggtaaagctgaacagcttaatatttaattttttattaattatattaggaataagctgtatatataccataattgtcttccaggcttttgaaaaatcaagtgggatatttgcaggatattatattagtaccggacattatggcttatctttattgataatatcagtgtattattattttctttcatctcaaaagattaaacctgttttagggatacttataggggcctttactgtatttagttcctccgcaagaagccctatgctggctgcttttattattttatttataatcttattgtatgttaacaaattgaaatactggttgacattaattcttgctacacttctttttattataggtatatatgctttaaataagacatatttagctaattttgagtttgttgaaagaatgtatagtgctatttttgaaggaggaggatccggaagatcatattacttagcaaaaggctgggacgtctttaaaaataatatactttttggaggacgtattttatttgaagatggactgtatccacataatatttttgtagaagttctgatgagtatgggggttgtcggaatcattctgttctttttttattttaaagatttatggaagttcaggttgaattttattagtaagaatagatactacttaccatttattttgttttttatacaatattttgttcttgtcctgacttcctacagtctctttgccaacttggaattctggactttttcaacggtatttatatcaataattttattttgtaatgatgaaaaaattaaaagtaatgacagtcgtgggaacacggccggaaatcattagattatcaagagtattatcagcattagatgcatccgaagctatagaacatatcattgtccatacagggcagaattacgactatgagcttaaccagattttctttgaagatcttggattaagaaaacccgattattttctggaggcagcagggaaatcggctacagaaacagttgggaatatcctgatcaaaattgatccgcttttagaagaattgcagccagatgctttccttgttttaggagataccaactcatgtctctgtgcaattccggctaaaaaaagacaaattcctattttccatatggaagctggtaacaggtgctttgaccagagagtaccggaggaaacaaaccgtaaaattgttgatcatacatcagacatcaaccttacctattctgatatagcccgtgaatatttgttaaaagaaggattacctgcagacagaattatcaaaacaggatctccgatgtttgaggttttaaatcattatttaccacagatagaaagctctgatgtgctgaaaagattaaatctggaagaaggaaaatattttgtagtttcatcacacagagaagaaaatataaactctgaaaagaattttctgggattgatggaaagccttaatgcaattgcagaaaaattcggatacccggtcattgtttctactcatcctaggacgagaaatatgattgataaaatgaagatatctgtaagacctgaagtacagtttctaaaacctctgggttttcatgattataatgcacttcaaatgagaagttatgccgtattatcagattcgggcacgatctcggaggaatcttcgattcttaatttcagagcgcttaatatcagagaagcacatgaaagacctgaagcaatggaagaagcatcagtaatgatggtaggtttgtctcccgaaagaattttacagggactggttcagcttcagcagcaaaaaacaggtaaggaaagaaattacagaccggtatcagattattctatgccaaatgtttctgagaagatggtaagaattatccttagttatacggattatgtaaacagagtagtctggagaaaataaaattatggctaaaaaagtactcatccacagtattgtttttgctccggatgctgtttctaccgcttatctttataatgatattgcatataatttaaaagagaacggctttgaagtagaagttctttcaaccatgccgcattataacaaggttgatcagagcaaaacaaaatttagaaaaagatttctaggcctttattattccagtaattataaaggtatcaaagtatatcatgtgcctcagaaaaaatatgagagtgttcttttaagaggatttatgatgatttactggcatttactatcgttttttcttggaatgcggattaaaaatgttgatgttatcatcagtccttcaccacctcttactattgcggtagtatctattgcattggcaaaactgaaaaaggcgaagtttatctataacgttcaggaaatttatcccgacttttttgtgaaccagggcaaaatgaaatctcagtttgttttaaatattcttaaaaagcttgaaaagtttgtttataaacactcagattcattggtaacgattgatcagaattttaaaaatacattgattccaagagttgaaaaccctgataaaattgagattattgctaattttgtagatacggaactttatcatccaatagaacatccggcagttaacgctcaattatttccggccagtgataatttgaaagtaatgtatgccgggaatattggttttgcacaggactggattccgcttatagaaattgcaaaaaaaacaaaagcgatgcctgtcagttattttgttattggagatggagcctgcagatcatggcttaaggcacaaattgatacatataagctggataatataagtttaattgattatcaggcgagagagacgatccctcatatgattaattatgcagatctgcattttatctttatgaataaaaaattggaaaaagatggtctcccctctaaggtctataccattatggcctgtaaaaaacctttactggtaatcagtaataagaatacaccgctatatgatttgctggaaaatacagatgctgcgtttttgattgaaaattcgtcgaataatgttaatgaagagttatttaatgtactgcaggacgcattgaatcatagaaataagctgaagcaaatgggggagaaaggatttaatatggtacagaaagactataccaaagaaaaagttactgaaaaatattatgaacacatcaacagtgtaataaatagctaattaaaaaacaacgatgaaaataataataattactcaggaggattcctttgttgttcccaaaaatatagaaaagattctgcgtctggagaatgtggaacttttaaaagtaatagatattgactctaattacagtctcgttaacaagaaatcttattttattaaaggttttggattactgcagaccgtaaaaatgggtatgaaagtaatctcggccaaggtcttgaatagtatagatatcctcacgtcttacaaacttgctatccaacccaaaagtctgaaagcagtttccggacgatacaatatacaatttgaaagaataaaaaatcctaactcagcagaattcttagaagaagtaaaaactttacagccggaccttattgtatcctactctgcacctgtggtatttaaagaaactttgttgaagatccctaagcatgggtgtatcaatttgcattgttcatatttaccccattatgcaggagttatgcctagtttctggacactgtataaaaaagaaaaaacaacaggagctacagtacattatatggattcaaaaattgataatggagccatcttaaatcaacaggagattcagatttctcctaatgaaactatgttttctttaattttaaaaagtaaagaaatcggtggaaatctaatgtgtaaaaccattcgtgatattcaaaattctaatattagcgttaaagagaattttgctgaaaaaggcagttattttacctggcctacggttgaccaatttcaagactttactaaaaacggaggaaaattaatatgaataagtatgctgtgcttagtatggatgtagaagaatggtatcatctggactattttacaaaagaagaatgtgagttgaatcagtcaactttagatggattagatatttacctggatattttagatcaatatgatattaaaactaccttttttattgtaggagaacttgtagaagttttaaaagataagattaaatatataaaagctaaaggccatgaaatttgtcttcactcatatgcccataaaagacctcttcagcttagtcttgacgggtttagagaagacacaataaaagggattgattcattcagagaatttacagggcttgaagtagatggatacagagctccatgttttagtttagataggcctaggttggagattttaagagaattaggcttttcatttgactccagtaaaataaaatttgatgcccatgacttatatggaagcattaatcttgatgattttgaagagtttcacccaacgatatataagaaagagtcattttatgagtttgaagcttctactgtagaagtgctgggaaaaagtctgccggtttcaggtggaggatatttaagaatttttccctgggcactgacgaaaatgctcctgaaaaaatattttaaaaaaaatcaacattatttcttttatatccacccgtttgaattttctaaaaattataatattactgttccggaaaatacagattttaaaacaaaagtcagatttaatcagggaaggaaaagcgttgaaaataaaatgcataaactgattcaattgttgaaagagaataactataagtttgttacatttaaccaaattgttaaaaatgaaggctaagttgctgttgacaggagcaagcggatttataggctcacaaatatataaagcgctgaaagaggattttgatattacggctatttcttcttcttccttgggagaggattatacaacgcttaatcttttgaatgaaaatgagtgcaaaaattttttcaaaaataaaaagtttgattttattattcatgcagcagcaatagcccacggcaaaaataaaaatgatacaatgaaggtgggggaagccaatcttgtaatgacaaaaaatatttttaattctcttgatgtaaaaaatacaaaggttatttttttaagttcggtttcggtatacagctttaaaaacaataaagaaataatttcagtaaatgatcagccattaccggttacagaatacgggaaaagtaaattaatatgtgaaaatttgttaaaagagaaaaaacctgtatcattgcatattttacggttgaccccagtttatacagaaaataatttaaaagatttaggaaaaagagtcttcctgcctgtattgaagttccctttcattacaaagcaagcaagaatatattcattatgccatgttgatgtagtagttaatgaagtaattaactcaatgaatacagatcacgattcattaaagattgtaaaggatcctgaagatcatactcaggaagagctgttgtcattttttaaaatagaaaaaccacaaataattattaatcagaatgttgttaaaccattgttttttatattaagattgatccccgtttcgaagtcgaatattataaaggatatgtttactaagttattttattcggccttatatattaattaattttacttttgatgaaagaatttatttatttagtgataatcttattgctttttttggctgaattgatctatttcaaaatagctgataagtacaatattatagataaacctaaccatagaagcgcacatacgcaggttactttaagaggcggggggattatatttccgattgctttcattctttttagtttgttcaattttaatgaagttgtaaaagattactgggcttttggcttaggcatgcttgctatctgtatcattagttttatagatgatgttaagccattatcaaataaactaaggcttacggttcagtttatttctgttgttttactgttggattttataaatgcattcgctttgatgccattttgggtatggtccatcatgtttattgtgattgtaggaaccctgaatgcctataattttatggacggaatcaatggaatgacaggattatatagcctggttacagtttgtacacttatttatatcaatagaaatatttttcaatttactgacaataaatttatatactatccggccctggcctgtattgtatttctttttttcaattttagaaaaaaagcaaaatgttttgcaggagacgtcgggagtatgggaatcggcttctggataatagggcttattaccctattaatcatgaaaactcaggattataaatacatattattattatctgtttacggaattgaagttgttttgacaatcattgaaagaattatgctgaaagaaaatatttttgaagcacacagaagacatctgtatcagcttcttgccaatgagaaaaaaatcccccatttattgataagttttgtatattcctttttccaactgctggtaactgtttttttaatacattcctctttcccgttatggatcgttgctctcattgtgtttttacctgttggaggactgtatctgttattaaaatggagcattaagaaacaatataatctgtagatttttttagaaataaattatgaaaattaaagaaacaccgcttaaagactgctacatcatagagcctactatatttgaagatgaaagaggctacttctttgaaaagttcaacgaaaaaaaattcgaggaactgaccggaatgaacggacactttgtacaggataatatttctaaatcttcttatggagtattgagaggattacaccttcaaaaaggagaacatgctcaggcaaaactggtttcgtgtcttgaaggaagtgtttgggatgtggctgtagatcttagagaagattctcctacatttggtaaatggttcggaatagaacttactgctgaaaataaattacagctgtatgtaccgagaggctttggacatggtttttctgtattgagtacccatgcggtattttcttataaatgtgataatttttacaacaaagaatcagaaggcagcgtaaaattcaatgacccagatcttaatatcgactggaaagtagatgaaaaagatgccatactttccgaaaaagaccagaatgctcccggatttaaagaaaaaaacttttaaagtatattcctgaaaaccacttttataaagtggtttttattttttaatcttaactctctaatattttgtatctttgcagactcaaaatcaaaacgatgcgtacaaaatctgtagggaagaagaaaatcaatgtagtcactcttggatgttccaagaatgtatatgattctgaagtattaatgagccagctgaaagccaatggcaaagaagtggttcatgaagaccgtggggatattgtggtaatcaatacttgcggatttattgataatgcgaaagaagaatctatcaatactattcttgattatgttgaggctaaaaacagaggtgaggttgagaaagtattcgttaccggatgtttatctgaaagatataaaccggacctgatcaaagaaattccggatgtggatcaatatttcgggacaagagaccttcctgtactcttaaaacaccttggagcagattataaacacgaattggtaggagaaagattaacaacaactccaaaacattacgcatatcttaaaatttctgaaggctgcgacagaccatgttctttctgtgccattccattgatgagaggcgggcatgtttcaacccctatcgaaaaactggtttcagaagctcagaaactggctaaaaaaggaacaaaggaattaattcttattgcacaggatcttacttactatggtttagatctttacaaaaaaagagcattgggagaccttttaaaagaactggtaaaagtagaaggagtagaatggattcgtcttcactatgctttcccgagtggttttcctgaagatgtgctcgatattatccgcgaagagcctaaagtatgtaattatatagatattcctcttcagcacatcaattcagatttgttgaaatcaatgaagagaggaactacccatgaaaaaactgatgctcttttaggaaaattcagagaaaaagttcctgatatggcaatcagaactacacttattgttggatatccgggagaaacagaagaaagattccaggaacttaaagactgggtaagagaacagaaatttgacagattgggatgttttacttattctcatgaggagaatacaactgcttatgttttggaagacgatattccacaggaggtaaaagaggcaagagtagaagaaattatggaattacagtctcagatttcttgggaaaagaatcaggataaagtaggtaaagtattcagatgtattttcgaccgtaaagaaggaaattacttcatcggaagaacagagtatgattcaccagatgtggataatacagttttggtttctgcagaaaatacttacatttctattggtgaatttgcagaggtcaaaataacctccgcagaagaatttgacttatatggagaattagtatagctaaatgcttattaatcaattgaaaataaagctggtcgaattaatccattaacgaaaattaacatagaattttttctgtcccttctttttattgtattgaaaaccaaatgattaatattatatataattaggaatatttaattttttatctataaagcatataaaatcaaaaattatatcttaaatttgcgcagaaagcaatatttttaaatcatgtattgtcaataagttaatcattaaaatgaagctaaaattccattggaatagttatttgatcgttttttagtttcaatataatgttcacaagttgggatgcatcctttttggaaatattgatgaaaaaaatgtaattaaaaatctttaaaaacttatgaaaaaatttttattaacagcaattatgcttgttggcctttcggctctttctaaggctcagcaggggcgagtggggattaacacaaccacaccagccgcaactctagacgtagtagcaaatactactgataatgctagacctgatgccttactaatccctcgtttaacaagagcacaattattagctaaagatgcagcttatactgctgctcaaaatggagcacttacttttgttactacaattgacggtactgcaacccctaaaactacaaacgttacagcagtgggcttttattattatgatggtcagactacaaatacatggattgctttaggtggtggaggtacagttacacctgttgttcctactgtaagaacttcagcgacaggtacagacttatctgcagctgatttagatggctatgtatttcttacaaccaatgctgatttatcaacaattcctgtaactgcagcaactaagggaagaagtattacccttgttaaagtgggtggaggtacacttactgtaaatggtgcgagtgcagcttcagttaactctatgactgttaacggaagaggtcttggttttgtttatgatggaactgcatggcaatcatattcagctcaataatttattaattttacacagatttagtcatgaataaaaaaatattattagttcttgcctcttctttggcaatgtttcaatatactaatgcacaggttagaacaaatggttttgccagtggaaatatagctgggcaaggtgcctttttagatgcttcaggaagtaccggaggttttacggatagcgttaatgatggaaaaggacttgtttttcctagaactaatctaacgactttcacatttgcaactccagttactgatgaagataacttcccaactgcttatgatggtatgatcgtttataacactgctactggaacaacagtttccggtattgctactagtgttactccgggatactactatttctcgaatcctacagggggaactgcaaacggatttgctacttctaccggtagatgggtttccctttctacttcaccaaaagtaactgtaggaacaacagaaacaactacaaatactattatcaatactacagccggagataaacagctttatgctattaaaggaactttcacggcaagtggtacttctacagctgtaaatatccctgcacctgccggtatgtctgcaatgtatggaattacaatctataaagctggtacaaatacagtatatgatagaagcctgtattcttatacaattgctacaactgcaggtaatgcaattactggttctcctagtatgtctgtagtttatccttctggaacatatgattatgtactggaatatttaaaatagaaaaagtattaattacatattaaacaacccgatgagaaatcattgggttgtttactttttagagagaagcgttctattagtaattgatattaaagaatattgatttaatttttacatcatgatattatataattacaatcaatctgaaatttaacaatgtatcaggctgttaaaatctaattcagaatattgaatatggtaggcttaagcagcttattactgtcgtttttcttagatttagaatttaagacttttatttttttttaggtgttttttaattcatatcttaacattgttgattttgtaacttattgattattagtttgttttaaatagatgctttttaaattatgtgtgaattagttaattatgttaactttttaagcttttttttaacgttttttaacaatatagtttaaacgccctatttatagggttttgcaaggtttgttaacattttattagttttttgttaactgtttttaacatatggagtagggttttataaagattcctgatacatttgctccgtcaaaaccaataaaagttcaaaatgatgaaaagattcattctcgtaatcataatgatgatttcaaccctgggtgtttattcttttacgaataatgccttagatgcgaaaaaaacaagttatgcatcgtactaccacgataaatttaacggtagaaaaaccgctagcggagaaatctttgataattcaaagtttactgcagcaaacagaacgcttccgtttggaacaaacgttaaggtaacaaaccttagaaatggtaaagaagtaatagtgagaattaatgacagaggaccttaccattcatcaagatctttagacatgtctaaagcagcgttcgatgagattggagatatcaatcgtggtaccattccggtcgaatatgaaattgtcgattaattttatgatttaaattaaaaaaaagccagctgactcagctggctttttgtatagataacctttcttatatatccaattccaccaaagcaggacaatggtcagaatgtaatgcttcctttaaaataacagctctgctgagcttatcttttaaactataggaagtaaaattataatccagtctccagcccttattcctttctcttgaattttgtctgtagctccaccaggtgtaattatccggttcattgttgaagaatctgaaactgtcaataagttcacattcattaatgaagttggtcatccactccctttccataggaagaaatcctgaaacatttttcaggccaaccggattgtgaatatcaatagcctcgtgacagatattgaaatcacccgatataatcaggttggggatttctttttttaaattcttgatatactcaaggaaatcatagcaaaattgcattttaaaatccagtctctcaatattggatgcagaaggaacatagaccgaaatagcagaatatccgtcaaaatctgcacggataattcttccttcattatcatagctctcgattccgcagccgaactccacatggttgggttttatttttgaagcaattccgactccgctgtagccttttcttactgctgagtgccaataactatgatatcctaatttttcaaggctttcgatgtcaatctgatcgtttccggctttactttcctgaatacagatgatatccggatctgcagtcttcagccagcccagaaaatcttttgtaaaagctgccctgattccattgacattgtaggtaattaatctcattagttttctataaaaattttaaagttttcattgtacttcgacgggataaattctgtgatggcataatcagccacttcgtgaatataaaaaggatcttcagaaatgatctgctctgcttcttttctggattctgcgttggcgataataatccctcccgttctgggttcttttcttcctgaggcaatgaaacgtccggcttcataatgtttgtcaaggaaaatattgtgctgtggaataagctgctctaccttttcaatagaacttttataagtgagcgaaatgatgaacatgatttaatttttacgaagatatgaactataaaaaagaggcggaaaaaatcgcaagattttttccgcctttaaacccaaaattaaataaactatgaaaaaaactacttgggttctaaaatactgataggaataatacactcttccagtgaaattcccccatgctgataagtttctttatagtaattaacaaaatgattgtaattcttaggataagccaggaaagtattgtttttagcaaaaatatacttcgagctcaggtttccttttggaaggaaaagtttttcaggattggtaattgcccatacatcactgtcatcataagttaagcttttaccggttttatatctgatattcgtagaggtttctctgtctcccaccactttacttggttttttaacgtacactgttccatgatcagttgtaatgaccagtttgtatccgttttctgcagcggcttttataattttcattaatgaagagttttcaaaccagttgaacgtaagagaacggaaagtcttatcatcacggatcagctgatctacaatatggttgtcagtcttcgcatgggaaaggatatcaataaaattgtaaacaattaccagcaggtcattgtttttatgctggttaaaatcatcatagatctttctttcaaaatctgcattcagtactttaaggtatttcatagattttgatcctaggccaattctcttcatctgatcttcaagaaagtcacgctcaaactcatttttgtttccttcttcattgtcattaaaccatttgtccgggaaacgtttttcaatttcagatggcatgagtcctgcaaagaacgagtttcttgcatactgtgttgctgtaggaagaatactgtagtaataatcttcagatattttattgtaatattttgtaaataaaggttcgataaccttccactgatcataacgaagattgtctaccatcagaagaagaactttctctttttcaacctcaggctttactttctccttgaaaagcgtgtggctcatcatgggcttatccgaatctgtaagccagttttcataattcttctcaataaacttcgcaaactgaatattcgcttcttctttctgagactgcagaagatcagcaaattcattgtcggccactttatcaaacttgatttcccagctaaggattttcttatagtattcagcccattcctgatacgttctcaaataagaaagttccatagaaaggtttctgaattcctgctggtactgtaaaatagttttctgttcaacaagattatcctgctgaaggtttttctttaaggaaagtaatatctgattaggatttacaggcttgagtatatagtcggcaatctgtgagccgatagcctcttccataatatgttcttcttcgcttttggtaaccataacgatttttaaggcattatctttttccttgatcataggaatggcctccaacccggaaatacccggcatattttcgtcaattaacgttaaagcaaatttctctgaatccatgagttccaaagcctcgttcacattgttaacaggtgttacctggtaacctttcttttctaaaaatacgatatgaggtttaagtaaatctatttcatcatcaatccataatatcttttctgacataatttattttttacatggttattgtatcaaaatgttgaccaaatccttttaaaatctcacaaaatcgaaatattaaaagttaaatattagttaaatggaaatactcgggcagatttcacatttttatcccatttaatcactgttttgtatatactccaaagccttccaatactttatctttattaagattatcgtgctttctctcaaaggtaatcctttaatacaacagctgcaaaccgtttgtaaagaaaatctgaattgatgagcaaataactgagaaaatttttaagactggttgaagatattgggttaaataaaaagtataaggaatgcttggcccaatttttaatggtaatttaatagagggcccaattttaaaatgcctaactttgtttactaatattgaagtttcaatgcagaataagctaaaaatcatcaacgatcctgttcacggatttataaaaattccacacgaaattttatttgacatcattgaacatccttattttcaaaggttgaggagaatcgggcaaaccggtcttttgaatctgatatttcccggcgctacccatacaagatttcaccatgctctgggagcaatgcatttgatgtttacagccctggaaacattaaaacagaaaggagtgaaaatctctgaagaagaggaaaaaggagcgatgctggctattctgatgcatgatattggtcatggtccgttttcgcatgcgctggaaagtatgctgatggacgactggcatcatgaaaatctttcgttactgctgatgaacaagctgaatgaagagtttgaagggcagctttccatggctattgaaatgtttcaggggaaataccacagaaaatttttcaaccagctgatttcttcccagctggatgttgaccgtctggattatcttaaaagagacagtttttttaccggagtatctgaaggaaatattaatacccaaagaataatctccatgatgaatgtctgtgaagaaggcgagttggtcattgatgcaaaaggtatttattccattgaaaattttctgactgccagaatgtttatgtattggcaggtatactatcataaaacgtcggctttggcagagtttcttttggttaaaattcttgaaagagcaaaatatctggtttcccagggtgtggaactgcccgcaaccgataatctcaaatattttttatacagggaaaaaagtgctgcaaccgatgaagatatagaaaggtttaccaggcttgatgacaatgacgtgatccaggcaatgaaggaatggcagcattcagatgattttgtgctgtcatactggtgtaaatgtgtaattcagagaaatttgcctaaaaccattatttcgtcacatccatttgatgataaaataattgacgaaaaaataaaaaagagtaatgaatttttcggaatcgataatggtaatgaattggttcatgaaattaaaagaaaactgctgccttatcatgcagagaaacagccgatttatttgttgcagaaaaatggtaaaagaacaaggctgcatgagtcggaagatcagcttttatcagggttgatggtgaataagacaacccgctatatccttatgtttccaagagatatctccggaatggattcttaaagaatattaaaatttacgatctgaaactaaaacgtgtttgcaaattatagaatttcttatctttgcagaatatggaattcacagcttcgcaaattgcaagttttattgacggaaaaataataggtgacgagaatgcgcttattacaggagtttcaccaattgaaaatggggaatcaggacatctttcttttatagcacaagatcggttttctcattttttggatagctcaaaatgttctgttatcatcgtttcggaaaaacttctggagaaaaatcattataatcctaccttaatcgttgtaaaagatgcctatctttcttttcagattctgatgaatttatatcaggaaatgcaggggagaaaagaaggtattgaaaatggttcttccattcacgatacagctgtcataggagataaggcctatatcggagcatttacttatgtttccgagaaagctaaaataggggaaggttcacagatctatccgcatgtatatataggaaaaggagtaaaaatcggtaaaaactgtaagatagacagtggtgccagaatttatgattattgtattattggggataactgtgtaattcattcaaatacggtaattggcggtgacggatttggtttccagccaacagccgaaggcttcaaaaaaataccgcagcttggaaatgttattattgaagacgatgtagaaattggttcaaactgtagcattgacagagcaacaataggttctaccgttattggtaaaggaaccaagattgataaccttattcagattgcccacaatgtgaaaattggtcagaacaacgtaattgccgcccaggcaggaattgcaggttctactacaattggtgactggaaccagattggcggccaggtaggcgttgtaggacatattaaaataggaaatcaggtaaaaattcaggctcagagcggtgtaaattccagcgttaatgacagggagacattgtatggttcgccggcaatcagttataatgactatttgagaagctatgttcatttcagaaacctgcctggaatagtaagtagaataaataatcttgagaataactcaaaagataatactaatgagtgatatgcaaaaaacacttcagcaagaggtaactctttctggaattggtcttcacacgggtaaagaagtaaaacttaccattaagcctgctaaagaaaatacaggttttgtttttgtaagaacagacttggagggacatcctcaggtagaagcagatgtaaattatgttgtagcaacagaaagaggaactacattagaaaaattaggggtaaaaattaccacttgcgagcaccttttagcagcccttgttggttgtgatattgacaacgcaattttagaaatggatgcctctgaacctcctattttagatggatcttcaaaatactttgtggaagctatcgaaagtgttggagtagcagaacagagcgtagcaagagagtatcttgttgtaaaagaagttcttacttacagtgatccggctacaggttcggaaatcacgatcattccttcagatacttatgaagtaactacaatggtagattttgggactaaagtattaggtactcaaaatgccactcttaaaaatatttcagaatttaaagacgaaatctcatcagcaagaacattcagcttcctgcacgagttggaaatgcttttagatcacggtttgatcaaaggtggagatatttccaatgccatcgtatatgtagataaagatcttactcctgaaactacagaaaagctaaagaaagcctttggaaaagataatgtatccatcagaccaaacggtattcttgataatcttaatttaaactatcctaacgaagcagcgagacacaaattactggacgtaatcggtgaccttgctttggcaggtgtaaaaataaaaggtaaagttatcgcgaacaaacctgggcactatgtgaatacccagtttgcgaaaaaactaaaccgccagtggaaattgcagaaaaagaaaaacgttccggattttgaccttaccaaggagccggtattcgatatcaacggcattatgaagcttatgcctcacagacctccgttcttattgattgataaagttcttgaactttcagactcgcatgtagtaggtctgaaaaatgttacaatgaatgagccattcttcgtaggacatttccctaaagaaccagtaatgcctggagttcttcaggtagaagcattagcacagacaggaggaattcttgtgctggccagcgtgccggatcctgaaaactattctacctatttcatcaaaattgataaggtgaaattcaaaagaaaagtaattccgggagatacgctgatcttcaaaattgaattaatagagcctatcagaagaggaattgttcatatgcaggggtatggatatgtaggagatactgtagcagtagaagcagagcttatggctcaagttgcaaaaaataaagttgattaaatgattcatcaattagcagccgtagataaacgtgcgaaaatcagcaaaaatgtaatcgtagaacctttcactaccattgcaggggatgtagaaattggagaaggaacatggattggtccgaatgttaccatcatggatggtgcaagaatagggaaaaactgtaggatatttcccgggacagtaatctctgcaattcctcaggatctgaaatttgatggtgaagatacccaggtgattattggcgatgatacaacaatcagagaatgcgttacggtaaacagaggcacaaaagctctgggatatactaaaataggtgctaactgccttattatggctacttcgcatatagcccatgattgtgttatcggagatcacgttatcattgtaaacggttgtggtattgcaggacacgtggagatcggagattatacggtaatgggaggtttatcagccgttcaccaatttggtaaaatcggaaagcatgtaatgatttccggaggtactctggtaagaaaagatatcccgccttacgtaaaagtagccagagagcctatgtcctatgcaggtatcaattcggttggtttaagaaggagaggatttaccaatgagaaaatctttgaaatccagaaaatctacagagctattttccagatgaagatgaacgtttcccaggctatttcccatattgaaaaagaaatgcttccaacggctgaaagagatgagatcttacagtttattcaaaactcaccaagaggtatcgtaaaaggatacggaaccggtaaagagagtaactaagagaaatgctaaaaagcaaatttgcaaatctgcctgtttgcttgccagccaacacaatttaagtaaaaaaagataatatatattaatggcaacaagtaacgatatcagaaaagggctatgcatcgaatatagcaatgatatttataaagtaatcgagttccttcacgtaaaaccgggaaaaggacctgctttcgtaagaacaaaattaaagtcagtgacaaacggtaaagtaattgataatactttctctgcaggacacaaaattgatgaagtaaaagtaatcactagaaaattccagtatctgtatgatgatgagaacggattccacttcatgaacaatgatgatttctctcagttatacatcaacaaagaaatgattgagaattctcagtttatgaaagcgggtgaagaagtgactatcattttgaaagaagctgatgaaactccactttctgctgaacttccacaatcagtataccttgatgttatcgaagctgatccgggtgtaaaaggaaacacagcaaccaatgctcttaaaaacgcaatcgttgaaacaggagcaagagtaatggttcctttgttcattgaaccgggagacagaattaaagtaagcactgaagacggcagctacttagaaagagtaaaagaataaataaaatttacataaattcggtttgcatcagcactccgaattttgttttataagaaaatctattgttatgagattccattctccgcaaaagcttaaaaccattgcagatttaataggctcagcatttatagggcctgaagattttgaagtattggggaccaatgagattcacatggtaaaaccaggtgatatcgtttttgtgaatcaccctaaatattatgacaaagcattaaactctgcagccactattattttaattgataaagaagtagaatgcccggaaggcaaagcgcttttggtttctgatgatcctttcagagactttaataaaatcaatactcatttcaccagaatatataattttactgaagaacttcacgatgttgaaataggagaaggaacaaaaatccatccttctgcagtaattggaaacaatgtgaaaatcggaaaaaacacccttatttttccaaatgttgtcattggagaccgtacagaaatcggagataatgtgatcatccagtccggtacggttatcggtggagatgctttctattacagaaaactgaatggtaattttgaccgtttaatttccgtaggaaacgttgtcattgaaaacaatgttgaaattggaaacaactgtactattgacagaggagttacagattctacagtgattggggaaggatctgttttggacaaccttattcagatcggtcatgataccgtaatcgggaaaaaatgccttattgcttctcaggtgggaattgcaggatgttgcatcattgaagacgaagtgaccatgtggggacaggttggaattgcatcaggacttaccattgagaaaggcacagttcttttagccaaagccggagtgaacaaagacctcaaaaaaggaacctatatcggcctgtttgcagaagattttaaaggctatctgaaaaaagaagtaaaactgagaaatctcaaataaacaattccaaaggttttatccgaaatcaaagaaatttgagtaaatttgtgagcattaataaaataataaataaattaaaacaacaataaaatgtcaattttagtaaacaaagattctaaagtaattgtacaaggatttacagggaacgaaggaactttccacgctggtcagatgattgaatacggaacaaacgtagtaggtggtgttactccgggaaaaggaggtagcgagcacttaggaaaaccggtattcaatactgttgctgacgctgttgaaaaagcaggagcaaacgtaagtatcattttcgtaccaccggcattcgcagcagatgctatcatggaagctgctgaagcaggaatcaaagtaattgtatgtattactgaaggtattcctgtagctgatatggtaaaagtgaaatcttatatcgctgacagagactgcagattaatcggaccaaactgccctggaatcattacttctgaagaagctaaaattggtattatgccaggtttcgttttcaaaaaaggaaaagtaggtatcgtttcaaaatcaggtactcttacttacgaagctgctgatcaggttgtaagagcaggttacggtatttctactgcaatcggtatcggtggtgacccaatcatcggaacaacaacaagagaagcgttagagctatttattaacgatcctgaaactgaagctgttgtaatgattggtgaaattggtggaggtcttgaagctgaagctgctagatggtacaaagcaagcggatctactaaaccggttgtaggcttcattgccggacaaacggctccgaaaggaagaacaatgggacacgctggtgctatcgtaggaggtgctgaagatacagctcaggcaaaaatggaaatcatgagagaaaacggtatcaacgttgtagattctccagcagatatcggtgctactgtagcaaaaattttaggataacataaaaccacagcatatgaaaaaacttttattagcctcagctttgaccctttctgccttatcctttgcacaagtgcaatggaaaagtacaagatttggagtaacaggaggtttaaattactccagagtatctaatgcccataatccttcaggccctagatacacattccaggctggagctttggcattaattcccgtaggaaaggcaaaccagttctttattcaacctgaagttcagtactatggtgctggagaaacaggaaaggataaagatgctaaaggagtaagcggttatgacgcagtatatgcaaataactacctgagtgtgcctctttatttcaaaggctatttttctgaagcagaatcagaattctttggattgataggcccaagatttaactttttgctaagtcagaacgttaaagacgctcctgtaagcagaccttattatgacccggatgttaccgatcctaaccagccggcaggcgtaaatggaaaggcaaacagctttaactggggacttgggctgggagtaggatatagctacaaaagacagcttgaagttgctttaaaatatgacttaggtctgggagacacttaccctggtcttgctaaagaaaccaaaggtactgataagaaaaaatcagagcaggtaattgcccttactttaagctatatattcaaatagaaatatttcagaataaaaaaatcccggaaacaaagtttccgggatttttatttttatatctgtcggtaaatcgaacaattttcttagcttttttgctattttacgatttcgccattttggcatttaacgatttagtagctagcctttaatccatttccaaagctcttttaaagtagccttattgccgtacatcaaaattcctacacgataaatttttcctgccaggaagatcatgaaaatagtggttgccagcagtagtacaatagataatgctatttgccagacagggactccaaacgggattctggcaatcatagccaccggtgaagtaaatggaataatagacagccagaaacctagcggaccatcaggattattcattaaagaaaaacttccatacattcctaatgtcaaaggtaaaattgcaaataacgtaaattgttgtgtctctgtttcgttatccacagcagaaccgattgcagcataaatagagctatagaagatatagcctaaaaggaagaaaacgataaatacaaagatgattagcgggaagttcagttccagtaagctgtgagaaatctgagtggcaagctgtcctacatccagtttgtcagccagttcttcattccctcccggaatatttttctgaataggagaaaaacctgtatttaataccagtgcaccaattactgacattgtaatccagatcacgaattgtgtcagtgcaaccattgttaccccaagaattttacccatcatcagttcaaaaggttttacagaagaaataatgatttccacaacacggttattcttttcctcaagcacacttctcattacccttaccccataaataatgatgaacatgaaagtgacgtacatcagcaccatactcaatccggatttaacaccaaagataagatcagaatcctccttattgttatccgtaacattgatggtttttaaggtaaagcttttatccagattattcaattgaacttcctggatacccagctgcttgattttttcttttctgacaacattgctgatatcagatacaattctctgcttcgtgtcaaatcctattttgctgttgatgatcagtctggtctcattttcaagctgatcaaaattctggtttttcaattccggaagaataaggatgccgtccagagattcattacctttcaaattgttaatcttggatttttcgtcagctgcagagacaaaaacgtaatttaatttttcattggatttcagctggttggtaaacaatccgcttttatccaccacttctataatgctatgtgattcgtttgctttaaacattaatccgatcacagccccgaaggcaatgatcataataggagcaagcagggtcaatatgatgaaagattttttcttaacctgtgtaagaaactctcttttggtaattaaaaaaatattattcataaaaattaagaatggttacttacagcattaataaacacttcattcatactcggaattctttcgtcgaatgatcttactttacctacctgtaccaggtcaaggagaatattattctggctttcttcatttttcaggtcaaaggaaacaaggttgttttcattcgataaattgaaaatctcatacttatttctgaaattttcaaactgatcgttattgacttcagaaagcgtaattccgaaaatatttttcttgaatttttctcttacatcaaaaactcttccgtcaatgattttcttcgaattgttgatcaaagccacataatcacacatttcctctacactttccattctgtgggtagaaagaatgatggttgttccgttatttttaagatcaatgatctgatctttaattaaattagcatttaccggatcaaaacctgaaaaaggctcatcaagaatcaaaagatgaggtctgtgaagaaccgtaactacaaactgaattttttgagccatccctttagaaagttcagaaagctttttcttccaccattggtcaatattcagtttttcaaaccattttttggcttcgttcaaagcatcacttttggtcattcctttcagttccccgaaataaaggatctgatcaccaactgtcatgtttttatacagccctctttcttcaggcatgtagccaatgtctttaatatggttggggttcagtttctgtccgttgataaaaatatctcccgagtctgcctgggtaatttgattgatgatacggatgaaagaagtttttccggctccgttaggccctaaaagaccataaatactggcttttggaacatggatgctgaaatcatccagggcgaccttttttccggcattataggtctttttaatatgttcagcttttagcattaaattgttctttttacaattagtataaaaaagttccgaaagttacggaaatattaaaacagaattaatgtaaaagaaaaaatcctgatgattatcaggattttaatttattgtttcacgatttgagtaactttctgcgtgttgtcacttaatatataacggatcatatattttccgggtttcaatttttcaatattgatctctccggagttcatatttaccgtataattggcaacctgcatacccaaaatagaatagaaagtcacacttttgattcttaaagaagaatcttttgccttaataataaggaagtcctttgcaggatttggataggcaagcaatacaccatcatccgccttttgagtgatggaacccggctctctaagctgagctttaaaattgttggaaaatccaacaaaagtgcctacaaatagaaataaaagtaaaagttttttcatcaaatttataatttctcgaatatatataacaaatgtaatacattctgcaattgcatacaatagttttttgcagaacttatattaaatttgtagaaacttattcaaaaagtattccaaaatgatacattcaagaaatagaagacttagagttaatgaatctatcagaagtctggtaagagaaaatgtgcttacaactgatgattttgtaatgccgatcttcgtaatggagggcgaaaacaagcaggaggcaatcccgtctatgccgggaattttcaggcgcagtatcgatttaacagtgaaggaatgtaaggaattattttctttgggagtaaaagctgtcaatttgtacatgaaagtatcagaacatctgaaagacaatacaggaaaagaagcgtggaacaaagacggattgatgcagaagaccatcaaggctatcaaagatgccgttcccggaatgattgttatgccagatgtagctttggatccttactcgatctacggacatgacggaatcattgagaacggaaaagtgctgaatgacgctaccaatgacgcgctggcaagaatgtcagtatctcatgcagaagcaggagccgatcttgtagcgccaagtgatatgatggatggaagggtacaggttatccgtgaagcattggaagaaagcggatttacagacgtagggattgtaagttatgctgccaaatatgcaagctctttttatgggcctttcagaagtgctttggatagtgctccgaaggacaacatggaaattccgaaagataagaaaacctatcagatggatttccacaatacccgtgaagcattgaatgaggtatttaaagatatagacgaaggagcggatgttatcatgatcaagccgggactgccttatctggatattgtttccaaagtacgtgaagccattgatcttccgatcgcagtatacaatgtaagtggtgaatatgctatggtaaaagcagctgcccaaaacggctggctggataatgacaaaacaatcattgaaagcttaacatgcttcaaaagagcaggcgcagatatgatctttacttattttgcaaaagaagcggcgatcttattaaataaataagatgatattcattcaaataaaaatccggctgttctgatcagaacagccggattttccattattaattagttcattattttttataaccaaccctttctgccatacacatatgtgtcatcgaattgtttatcactcataaagagatataaaataccttcaataaaagggataatagaggcagctccaaaagtgacaacgttaaggaccagctgaataatagcttctttcttatagcccagataaaatttatttaaagccagccagccaacaaggattcccaataaggcagcagggattttcttttctgaacgataagggacaccgctttgctggttctgtacattttctgtttttgtgtaaccgtaattttccattgcctagtattttgtaattgattgatatgttttacaataagtagtttaaaatgataaaaagttacaagaagcaaaagagtggaaagccaaaattgcaaattcatttaattccccttttgctatttaccttttcgcctttttgctttttcgcctatctgcgagtttatatttttgatatatttgccctatgattttacgaggagaaaacttaatcaaggaatacggtcctaaaaaagttgtaaaaggagtttctgtacaggttcaacagggagaaattgttggtttgctgggtcccaacggagcaggaaaaaccacatcgttttatatgatcgtagggttggttaagcctacttcagggaaaatttttctggataagcaggagatcactaccgatgcaatgtaccgtagagctcaaaagggaatcgggtaccttgctcaggaagcttccgttttcagaaaattgtctgtggaggaaaatattatgggagtattgcagctgaccaagctttcaaaacgtgagcagcagatcaaatgtgatgaacttattgaagagttttctttacagcatgtccgtaaaaacagaggagatcttctttccggaggggaaagacgtagaacagaaattgcacgctgtcttgctacaagtccgaactttatccttttggatgagccttttgccggggtagaccctattgcggttgaagatatccagaaaattgtaagaagccttgttgataaaaacatcggaattctgattactgaccacaatgtacagcagactctggcaattaccaataaaacgtacattatgtttgaaggaaagatccttaaagaaggacttcctgaagaccttgcgaacgatccgcaggtacgagaagcttatctgggtgagaacttcgtgtatcagagtattttagataagcctaaaaagaaaaaatatgcctataacatctgggcaggaaactttgattcaaaagcacagctgcagggatttgtggatgaaaattttaaacattttgatgacctgagactcatgtatggcttcgaggatatcagttttgcttcattagccaactctgaaattgaacatatctttaatgatatcgtagataaaaatgccaataactcctttgttttccagaaaaaagaaatcaacagccaatattctttagaacaggcagaagcagagtctaaagaagccagcagaaaagaactgcactaccttacgacttatatgtatgaaggataaaatataaagcatttatttgctgaacatgataataaaacgtacctttttcttttgaaagcggtacgtttttcatttaaaatgatttctatggctaaaccttttaacagaaccgttaccttaatcggaatttataaacagcttgtcccgttcatcagaccttaccgattaatgatctacggaaccctgtttcttacatttctcggggctctggcagcacaggttaacccgatagttttgaaatacacggtagatgaggttaccgaacttacccatcttccacacccgatgtcagaagggattcatattcttatcattatttccgttattttattgggaaaggaactcttaaacatttttatcaacttcggacagaaattttatggggaaaagatcaggatcaatgtcagttctgtattggcacaatcagcaattgataaaatcttgacctacagagttgcctattttaatgacgaaaaccacgaatccggaaagttacagatcaggatagaccgtggaatagaaagcctgacaagactggtgcagaattttttcattgatatcttaccattattttccaatgcaatcatagcactgattattatgtatatgcagaatgtgtatgtggggcttgtctccactattattgttccaatctacttttatattagttctctgcaggctaaaaaactgagcggggtccgtcgccagcttagaaatcaaagagaaagaaaaacgtcaggacttctgaacctgatcaattcgattatggtgattaaaagttttgtccgtgaaaaatttgaaggaaagaaacaatatgatcttcagatggaactcatggaaagccagatggtgactagaagaaccaactttatttatgatggtttaaaaacctttattgagcagttcggtgtggttttgattatccttttaaccgtttatctggttcttgatcagcaaatgactattggtgcgatcatgcttcatattatgcttttcaacaacgtttctgcaccgatccgccagcttcacaggatttatgatgatatgaatgatgccatgatttatgccgaagggtatttcgatattttaaatgctgatgaagaaactgaaccgaacggaaattttgtagaaagagaaatcaaaggaacttttgaattaaagaatgttgattttacctatcccaacggtacaaaggctttacataatgtttccatgaaaattgaaaacgggaaaacaacagctttggtaggactgagtggtgcgggaaaatcaacagtcatcaatcttttatgcaaattttaccttcccgattccggagaaattcttttggatggtgtaaaccttaatgaatatgataatacttttctgagaagtgatcttggattggttcttcagaaaaatcatattttccagggaagtattgaagataatatccggtacggagatatgaatgcaagttttgaagaaattcaggaggccgcaaaaaaagcttatctgcatgagcagattatggatcttcccgaaaagtatcagcatgatgccacgcagctttcagggggacagcagcagagaattgccattgccaggctgttccttaaaaatcctccgatcatctttctggatgaaccgacagccagcctggacgccattgctacggaacagatcaaaaactctctggatgccataaaagaaggaagaacagtgatcattatttcccattccctgtcacagattctggattctgatatcatttatgtaatgaaaaaaggaagagtggtagagaacggaactcatgatgaactctacaataaagaaggtacttaccgtgaaatttttgatgcctccgcccgcagccttaatctcgataaactggtgaatacttttaaagaaaattaaataaaaaactcagccttaccgctgagtttttacattttttagaattatttactgagctttttcagaaacctgatatgctccaacatcagctccgaaggcaatattgattctgttgtaactgttaattgcaataacagccatggttaaatctaccatttccgtttcggaaaagtaatgacttacctttgcatacatttcatcacttacttctttaccatttaaagccgttaaagtttctgcccataataacccggctttttctttatcagtataaaaggggcattctctccaggcgcttaccagaaatattctctgttccgtttctcctttcgctcttaattctttggaatgcatatccaggcaaaaagcacagccgttcatttgggaaaccctgaaatacatcagttccagaaatgaattgtccagtgaagagttctgtacctgaaatcccatgttgtgaagggcatttacagctttgtttcctatcgcaaatgcgttgattctttgtgacataatatttgtttttgattaattatgtgacaaatgtagaactgtattttcctgaatttttttacaaatgataaataatatgaagaaagaagtttgaagctagaagttactattaggcagattatatatattcggtcttcaataacttccctcttcctgcctccagctttctttcctctaaaacttctgtgccctgattctgcttaaggaaacctgggtaatgccaatataatctgcaagatctccaaggctgatgcgttgaataaggtcaggtctttgcttcataaaattatggtagcgtttttttccgtcatcttccagcatctcgctgattcttcccatcatattgaccggagcctttgaatatagtttgctgaacagtgtttctgctgtgtgatactttttacacaatccttcaactacgtctctatgcacacgaagaacttcagtaggttccagagctacaatcatatattttgacggctgtcccgtaagaaaaccacttagttcagcgaagaacgcattttctgcaaaaaatgtcatgatgaaatctttatcaccattatcaaaaaacagttttactaatcctttttcaataaaatagaaatatctgcaggtttcatcagctttgagcagaaaatctcccttcctgtacgttttagtttcaagatgagaaacaagttcgtccatgactgtctgttccggtttcaaaattttttctatagactgaacaaaatgagtatgaagcataaagaaagtatctgtttttgcaataaataaatttaataaaaaaccagtcacatttataagtatacctcaaaaaagaattttagctttgttacataatgaacgatcactatcttaaaaaacttgatcgggtaacggctatccttacccagttacagtcgaaacctgttgtacgcgcacaggatctggctgaaaagttcgatgtaagtataagaaccatttatcgcgatgtgaaaaccctggaaaatgcaggcattcctattgttggagaagccggcaacggatattctttaatggagggttataagcttcctccgattatgtttaccaaagaagaggtcttaagttttattactgccgaaaagctgatgcagaaattttcccatcagagcctaggtactcattatcaggccgccatggagaaagtacggtcggtattgaaatattctgataaaaatctgatcaaaaatatagaaaagcagattgatgttttcagctttcatacagattcgggcgactcactgaaaaatgtgattcctattattcttgaaagtatcgcagagaaaacgcagctgattataaaatatcagacggtagacggaagggtgaaccatagaactattgaaaccgtcgggatgttttttgaatttaatttctggtacatcatggcgttctgtactttaaggaaagatttcagacagtttcgtattgaccgtatccttgaaatttcaaaaacgcagaatacttttttacaggaatatggacaggtaaatgattaccgcaaaaaatcaaatggaaataaagaaagagctaaacttctggtagataaaaaggtcatgtctcacctggtgaattctaagaaatattacggactcatagaagaagtagaaaccgaacaagggatggaacttacttttgaaacagaatggatcagtgacggtttcccccgctggctcattacttttgcagattatgctactgttcttgagccggaaagtcttcgcacaagattgaatgaactgctgagaaaaatgacagaaagacatcagtaaaaccccaacagatagctgttgaggtttaaagacttaattgaggcaataaatgaaatagcttgaagcgaaaaggcaaaattgcaaataagcagatctgttgtgtcgctaaaaatgatagtagttggtataagttgaagaaaacacaattaataaaatatgcagattttcttacaattaaggctttttgcaattttaccttttcacttttattagaatctttcccagaagaatggcggttcaatacctaaagctcttaggtaaacatatccctgaccgcggtggtggatttcattgtcaatgaaataaagaatattttcatacaccgggaattcatattgtccgaaaaggttgaatacttcctggaaacgctcttcagaaatctgattgaaatagtgattgatcacttctgtttcttcatcccatttttttaacagctcttctttagaagtaggattgaagccttcttcattataaccttccatatttccttcaatgattccttttaaagctggacctgcaatgctgatcatctcagtggcaagttttgcaaaaggtctcatccctccgacagaaaattcaaataattctttttcaggaaaagcttcgattactcttcttgtaagatttctgtgtccctgccagtcttttaataactgatctgtggtcataaattgcttagtggctgtggctgtagttgtcataatattattgttttttgtttgttgttgatacaaaggtaagatggagtaatgacaacagtttgtcaataggatttcagggattaaaaaaatatttttttctttgctaaaaatatcctggcctacttttccgttaaaaagaaaggatattaataaagaaattgctattattagaattatgaagacgtatattttgcctgctatcaccacttttttattagtatcatgcaataagattgaggagaaaatagaccagactgttcagaaaacaaccgaaaccgtacagcagaaagcacagcaggctgtagaagaaacagtgaaaaagacagtcaatgaatctgtgaattctctaattaattccgaagacgttaagtttaatactgtttttccgggtgcaggagcagacattatttccgaagagaaaggaaaaaagatcaaaattccgggaagaccggaaggttatatctttaaatacaaagcggatattgctgttttgctgccgtttttagaagcgcagcccacttctgatgaaagtaaatctgataaaactgcccgtaagattgacggacaaagtattatagataaaataagctttctgtcaaaattcctgcctgacaatacctttgatgccaaaattcttgaagatattaagtccgataaaaacatccggtattataagctgaaaagatttcctaacagtagtaccattatctacaacccaaaaaatcagaccatcatacaatacgtagaggtaaataaataatttggatatggccggtttctcccggccattttttattcccattcattgcagaccataagcgaagcaacctcagcccgttgaaaattacttatcagaacaagtaaaatcatatttatttctgatgttaagtaattgatttttttatacaaataagatgatattgatttattttttttcatgttattactaaatcacttgatgttttgtggattaattatttttttaacgaaatggtatgattttagcaaatatgaaatggaattattatcatatattttatttttatgattaatgttgatttttttattagatttattgaatacttaataatcaacatgaaaaagaatttatttaatggtaaaatttatgcattagtattaagcggagctggtgctatgggatatgctcaggacagcataaaacaaaataaaatagatgaggttgtggttaccacgggtagaaccaagccaagaaccatcattatctcagctattcctatagataatatttctgctgtacaattaaaatctacaggacaaactacttttgacaaagctttaacctatgctgttccctcttttaattcatctcaacaaactgtttctgacgctacggctcattttgacccggcagacttaagagggttagggccttccagaacattagttttagtgaataataaaagaaaaaatcaaagtgctcttatttatgtaaacgatacgccgggaaaaggtgaagtaggtacagatctgaaaagtattccttcagcagctttacaaaacgtagaggtcttgagggatggagcatctgcgcaatacggatctgatgctattgcaggcgtaatcaatattattcttaagaacagtgttggaaaaagcacggtcaatcttttttcagggattacttcaaaaggagatgggtttaatatcggagcagattttaatacaggaatcagggtagcaaaaaacggaagcctgaatcttacattaggtttttcatcccaaaataaaacaaaccgcgcaggttctgttaccaaagatgaactttttggagtggataatgcctggacgcaggctaatcccggtttagggatgatcattgggcagccggagacaagagtcgccaatatgtttgtaaattttgaattgccaaccagtgaaacgggtaaattttatgcttttggtggtacaacctacagaaatgggaccagttacggtttgtatagaacaccctattgggtaacttccgattttggtttgttaacaccaaaaggacagccttacaatggatttcagccggaatttaaaacagatgtatatgattataatttaacttccggatggaaaggtatgtttggaaaatggagttttgacggaagtgcaacatttggttctaatgcagtagattatgtggtaggaaataccattaatgtatctttgggagcaaattcaccaacccgttttaaagcaggcggccatcagttcagtaatattatagggaatatagatatcagccgggattttggctcgtttgttttaggtgccggagctgaagtgcgcaacgaaaactatcaggcgaaagcaggagaagaagcatcttacataggaagtggtgcggaatcatttccgggactgcagcctcagaatgaagtcaataaaaaccgtcagaatatcggggcttatataaatgctgaatgggatgttaccaaaaacctcttgcttggaggaactgtgagatatgaaaacttcagtgattttggaaataatgtttcctggaaaggaaatgcaagatataaattgctggatgataagttagttttccgtggatctgtttccacagggttccgagctccttcattacaccagatttactattccaatgttcagaccaaaattaccgggaatacggtagctaatcagggtacctttaataatgactcccaaattataagatctgatcttggtgtaccaaaattaaatgctgaaaaagcctttaatattaccggaggattagctgtaaaaccttttaaaaacctaactattacagcagattattatagaataaaaattaaagaccgggtgcttttttcgggagatatcggttacaaaaccggtgctccggggagtccggatctgaccaatcctgtggaagtcatattgaataataataaaataacttcccttaagttttttaccaatgctgtaaatacagttactcaggggatagatttcgttgccaattattatacttctgctattggtaaaggaagattaggaattattgctgctttcaattataacgaaactaaaatagtagataatattgccgttccgcctattttggctcaaaatggttactcagaaaacttttttgacagaaaggaacaatccagaattatctctgcaagaccaaaaacaaaaaccatcctcagtctttcatatgatatttcaaagtttaattttaatcttaataatacttactttggttctgttacctggcagcacgctactgatcctgccaaagatcagacgttttccggtaaggtaattacagacatagttttaacttataaaatcacgaatgattttaaagtttcaggagttgtaaacaatttatttaatatatatccggatgtaatagacagcaaaggggatgtagtaacagatttgggaggaaggttcagatatccatgggaagtaaaccagtttgggtttaatggaaccacttttcagctcaatgtcaattatactttttaatctgaaagaaaaagtaactcaaaagacataaaacctgcctatgcaaatattaactgacattaatttctaatgtcagttttatttttttcagatcggatagggatctattactacattttactttttacattgtataaaaaaaggtattttagtcctatgaaaatttatacaaagacaggagataaaggtcagactgcattgtacggcggaacaagagtttccaaagccagtgcaagagtagacagttatggaaatatagatgagctgaattcattcattggaatagcaaaaagtcatattgaagatgaagaagtgctgagacaactgaaaaagatccagtttgatttgtttacagtaggctcagaagcagcaacgcctgtggataagctgatgttggccaacggaaaatcacgccttccgatcatcatttcagaaacagaaattgaagaacttgaacaatggatggacgccttcgatgaaaagctggaaccgcttcagtattttattcttcccggaggaggaaaatctgccacttttttacatgcagcaagaacaatctgcagaagagcggaacgttcattggttttcctgaatgaatctgaagaagtacgtcctgaattgatcaaatatttaaacagactttcagattatcttttcgtgttggctagatatatctcaaaacttaacaacgaaccggaagaatactggaacccgaatgaaagataaagcattacttttcatcaacggagatgctccaaaatcattacccgatcttaataattatggattgatagcctgtacagacggtgcttttcactatttgaaaagaatgggatttcccatggacagactggattttatatccggggattttgactcgcattccggttctgatgaaaatatttatgacgaaaaatttatccacactccggatcagaatcaaacggatttttataaagctttggatataatccttgaaagaggcggaaataaagttgatgtttttggtggaagcgggggagaacaggaccattttctgggaaaccttacagttgcctacgcattcaaagatcgtatggaacttaaattttatgatgaatattcagaatattattttatccccaaaagctttaaagtagaaggagtacaaaataaaatgatttctttatatccctttcctgtagcagaaaatattgtaacaaaaggcttaaactggccgttaaaaaatgaaaatttatccattatttcaaggattggaacccggaatttcgccgttgaagacgaagttgttatcggatatgaaaaaggagatctgttgatttttataggaacggattatttataatttactgcaatctatcaactggctttagccaaaatttaacatttgaatacattcatcagaatatcagtttttactatttcattatgctgcattttatcctgtaaaacacagcattttgaaactccggaatatggaaaaaatgaaactgaaaaagtaattcaccttaagaaagtaaccaatttccggactgtaggaaatatcaaaaatacggaaggaagaacattaaaagaaggaaggttttacaggagtgcccatcttcataagcttaaaaagagatcttttgaccgttttgatgaattgggaatcagagaaattattgatctcaggaattcaaaggaaatcgctcagaaacctgatcagattcctgcagaaaacacatataagaaatattcagcgtttgaagatgaaggcgatcagctgtcccaggcaaaaaaactggtccttaaaggtaaagtgaacgcgtctggtgcggataagaggatgatcgatttttaccgtgaatatgttacggaaaatcccgaaaccataaaaacgattattaccgaagtgttggagtccaaagcccctgttctttaccactgtactgccggtaaggacagaaccgggattattacagcgttgatccttaccattttgaaatttgataaagaaaccatttacaacgattatcttttatccaacaactacagaaaagaccttgttcagaaaagactccgccttgccaacaggttacatttcctctatccgaagatggatttacaggtactggaaaagctgagttgggttgaaaaaagataccttgatgctgcttttgaagagatcaataaaaagtatggttctgcagatgcttatattcagcaggtattggggatttcagataccaaaagaaatgaatatattcataagtttacctattgattatcaggagcaaatttttctgagattcaatatcaggtgttaatttaaaattataataattttaacacctaaaaatgaaacttttttagcaattttgcatttcttaattcacttgtttagaaatgaaaataaagtactcggaacttattgatcagacattatattttcctacggaggaatttaatgtttctgagaacaatttgttgtttcacgatattccgttgatggatgtggttgaacaatttggcaccccgctaaagattagctacctgccgagaatttctcaaaatattcagaaagcgaaaggctggtttaaagaagcttttgagaaaaccgaatataaaaagaattatacctactgttactgtacaaaatccagtcatttcaatttcgtattggaagaagccctgaagaatgatatttcaatagaaacatcatctgcttacgatatggatattgtaaaatctctttatgagaaaggtaaggtagataagaatattgaagtgatctgtaatggttttaaaactgatgattatctggctaaaatctcagatatgatcaatagcggatttgaaaatattactccgattcttgataattacagagagctggataagcttacggaaagtattgattccacttttgatatcggaatcagaattgcatcggaggaagaaccgaagttcgaattctatacttcaagattaggaatcgggtataaagatattattccatattacagccagaaaattgcagaacacccgaatgcaagactgaaaatgcttcatttctttatcaacacagggattaaggatacagcgtattactggaacgaattgtataaatgtcttcgtgtatatgcacgtctgaagaaaatcgctccggaagtggattcactgaacattggaggaggtttcccgatcaaaacttctttgaatttcgattacgattatcagtacatggtggaagaaatcgtttcccagatcaagaaattctgtgaagaagaaggagtagaggaacctaatatttatactgagttcggaagctttaccgtaggggaaagcggggccaacctttataaaatcatttctcagaaacgtcagaacgacagagaaaaatggaatatgattgattcttctttcatgaccactcttcctgatacatgggccatttcaagacacttcatcatgcttccgcttaaccgttgggaagatacttatgaaagagtgttccttggagggctgacttgtgattcggacgattattataattctgaacagcataccaatgcgatttatttacctgttttcagtgatacaaaacctctgtatatcggattcttccataccggagcttaccaggaaacaatcggaggatatggcggagttcaccattgcctgatgcctcagccaagacacgtcctgattcagaaagatgaaaacggtgaattgcaatatgagattttccgtgagaaacaggaaccggaagatgtattgaagcttcttggatataaataattttatgagccacagaaatgggctttagcccgtttacaatcaataaaaaagtcaattggctttagccaaaacttatacaaaacaaaagctctcagatttttctgagagctttttatttaaaaatattttgaaattttatccagttctaattcttcataatcagaaactactgtgtctgccaaagtgtaatcctgattttttgaatgtgggcttctataagctgcacaaaagatttttgcacggtgtgcagcaagaattccattggtagaatcttcaatcaccatacagtttttaacaggttctccagccatttcagcggccagaagaaaaacttcaggatgaggttttgattcctttaaatcggcgccgctgattttcccgctaaaataaggttccaacccgaatttctcaaaaaccatattgatcgttaccattgtagcagaagacgccagaataagttttatcccattctcatgataatgctcgatcagttttcttactccgggaattaaatcaaattcctcatcattgtaaaaataatccttgaaatgagatcttttgattcctgcgattgtttcgtaagtctgatctaaattaaattcattaatcaaagtttcagaaactcttttggtagaagctccggtaaaagaggtatacagttcttcagaaactgctatttccagttcgtcaaatgttttgaaataggcttttctatgcaatggttctgtgtctactatgacaccatccatatcgaagagaacagcttttaaaggcatatcaggagttttatacaaaaataacttttaaaatttaaacagtaaaggatttaaaattgaaaagtcaggataaggttaaaaattcataacaaaccgttcatcacttataactcaggtactattttgtatctttgtggaatcatttaatctttcaatcatttaattttttaattaataattatatatgaaaacatacgcaggaattcccgaggaaaatgcaacgctagagaattcgaaagtaatgttggtaactgttccttacgatggaacttcaacatggggaaaaggagctgataaaggtcctgaattattcttaaatgcttctgaaaatatggagctttacgatatcgaaacacaaacagagccttaccttcagggagtttacttagcaggagaagtgtctgaaaattcttccccggaagcaatgacggaagccgtttatcagaaaaccaaagagcttttgaacaatgaaggtaaattatttactctttttggtggggaacactctgtttctatcggttctattcgtgcggtaggagaaaaatttgaaaatttaactgttctgcaattagatgctcacacagatttacgtcctgagtttcacggttctacttcaaaccatgcctgtgcggtttttgaagctaaccaaaaacataacttagtacaggtgggaatccgttctatggatgctgaagaagcacaatatttgccggaaggaagagtattctttgctcacgaaattgctaacaatgagaactggatcaatgatgtactggagaaagtatcaggaaatgtttatatcacgattgatttagatgcttttgatccttccatcgctccttctacgggaactcctgagcctggtggattacaatggtatccaacgttggaattattaagaaaagtatttgaaaaatgtaacgtagtagcgtttgatattgtggagttaatggattctccaatggctaagccaactgctttcttatctgcgaagttatattacaaaatgcttgcttattacgatatttataacaacaactaatattccgcaagaatcggattttttctgccgtatattctttggaaatttgtgaggtaaaatcataatacaatgtccacacaaagtcagatagattataacagaattgccaaagcgatagaatatatccggagcaatttcaggcttcagccaagtttggaggaagtggcagagaatattcacttaagtccggctcatttccagaagatctttacagattgggcaggaacaagtccgaaaaaatttttacagttcatcagtcttgaacatgctaagaatttattgaaggaagaaaaagcaagtttgtttgataccgcctatgagacaggactttcaagcaccagcaggcttcatgacctgtttgtgaagatagaaggaatgtctccggcagaatataaaaacggaggaaaaagcctcaatattcattacagtttttccgaaagccctttcgggaatatattagtagcttctacagaaaaaggaatctgctatatggcttttgaagacgataaagaaaaagcattcggggaactgaagcaaaagttccctaatgcttcttttattgagcagcaggatgctcttcagaagaatgcactgtccatattcgataaagactggacaaaactcaatactataaaattacacttaaaaggaaccgattttcaactgaaggtatgggaaagcttattgacgattcctatgggtaaactgtcaacctatggaagcctggctgaaaaaataggaaatcctaaagcatccagagcagtaggaacagctattggaagtaacccggttgcctttctgataccttgccaccgcgtgattcagtctaccggacatctcggtggatatcgttggggaagtgaaagaaaacagcttattgtaggctgggaaggatcgcatatttattcctgaaataaaaacatgttagtaagtttcggctaaagccgatggattaactttcattttattaaacggactaaagtccgcttctattgatataaaaattagtgtcattagtgaaaatattgatgtaatttgtgtttaaataaaagccataaatatattttacattctaccttttacaaaatacagcatttaaataaaaaaaccgatgatgagtctttttgaagaaatatccgattatccactcaatatccttccacacgatggaaccgttcattactacggcaaagttttctcaaaagaacaatctgatttttattatgattatctgctcaatcagattccatgggagaatgatgaggctgtaatatttggaaaactgattttaaccaaaagaaaagtagcctggtttggagagaaagcatttgaatatacgtattcgaaaagaacaaaatatgccagattctggactcccgaattactggaactgaagaaaaaatgtgaagaagtttctggcgaaacctacaattcttgcctgcttaatctataccatgacggaagtgaaggcatggcttatcacagcgatggtgaaacagaccttaagaaacatggagccattgcttctttgacctttggagcagaaagaaagtttttatttaaaaataaaacaaccaaagaaaaagttgaaatatttcttgaaaacggaagtttattaattatgaaaggaactacacaggatcactggcttcacaggcttccacccactacaaaagtgaaaactcccagagtaaacctgaccttcagaaccattgaagactagtttttaagagaaattttatccataacgtttgtcactccgaagaagtcccaatgatgttttatctaatggaaagccgtttacccagactttggaggattacgcttatcatatccatcaatagaagcgggctttagcccacctggacaaaagaaccaattcatccggctttagccaaaacctaaaataaaacttcagatcttcaaaaaataaaaagctgttcagacgaacagctttttcaatttattttaaaacatcagcttcaatggagctgtcattatacactttgatgaatgctttggtataatcttctttattggcaaaattcggattatccataaacttctgcgggttgaccgcgaaaagcgggaaccatgtactgctgatctgaatctggattttatgtccttttttgaacgtatgaaccacatcctgaagtctgaagttaacagccgttttctgattaggaaccagcgcttctcccttttctttcgtatttctgaaccttgcaggcataatttcacttcttaccatctgatgatagtttccgtagataacgccttctttcttttctgcaggtttgaaatcttccggatatacatcaatcagttttactgcaaaatcggcatctgtagaagtggaagcaatattcagtttagccataatctctccggcaaatgtaatatcatcagtcaatacatcggtagtgaatgttaatacatcaggtcttcccacagcaaatctctggtcttccgacatataatttctcggagtgaaaccattgaaatcttttaaatgatcagagcttaaaacaggattgtttggatcactgtaatattcggaataaccttgtcctgatgatttttttaaggtgttatccgctagatagaaattcactttctgagcattttttggagggtaagaagcaaattctttccattctttagcaccggtgtcatacatcagcgcttcgggaagtcctgcatcttctttagtattgcctttcagataatggttgaagaattttgtttcaatatttttctgataataggttgcaatactatctccaaaataggtttcactgtgaaaatgttttccctgctcctgagaccagccgccatgggaaaatggtcccattacgatggtgtttttggctttagggcttgttttttcgatggttttataaatattcagcgggcccgaaagatcttctgcatcaaaccatccaccaacagtcattacagcatgattgatattttttaaatgaggaagaagacctcttttctgccagaattcatcatagttggtatgattcataatttctgtcatgaagaagttattcttataatacttttcatatccgtctttcagggtacccatatctctgtagaattttaatccgtcctcagaagtttgcttgatgaaagaatccatataccatgcctgcttttcaggttgtgtcttctgaataccgaaaacaggaaatgttctgaaatagcccagcataaatcttccgttgtgaagaaaatcgtcattccagaaatcagaaataggtgcctgtggagaagaagctaccaaagccggatgctgtgacaaagttcctacagcagtataaaatccgggatatgatgtcccaaactgacctaccttaccgttgttatctttcacatttttcaaaagccattcgatggtatcataggtatcagtactttcatcaacatcttttttggttttacgttctacctgcggcgtcatattggtaaatgtaccttcactcatatatcttccgcgtacatcctggtacacaaaaatatacttgtctttcataagataggtgttagggcctacctttgttttatattcactttctccgtaaggagcaatgctgtagcaggttctctgcatcagaaaaggatatttgttcttgttggatatatctttcgggatatacacggctgtgaaaagtttcacgccatcacgcatcggaatataaaattctttcttggtgaaattgtctttaacgaaagtatctttctgttccgttttctgagcttttccaagaatgaaaaaaagaatacataatactgaaatatggattttcataaaaaaaatttgctgctaatttaaaaataaaaacagttttattcgtaaatcttgtttaaaaggttgctgtaagaaccaccccgtcaaaaattctttgaattttcaccacccatccaaaagaggggaatattacgtcttcaggtgtaatgaaattaagtttattcatagaaatagccgggaaatatccggccattatctaaaactatttataaaagtgtattattgctttattgcgtcttttttcctgcaaacttattcagtttcatgctgatggagaacatgatgtaccgtttcaggataaggtcttcacggtcttcaaaataagaatcagtgatggttcttctcacgctctgattttgatttaaaacatcatagattttcacttttgcggtaaactgctttttatagaatgaatatcccagactggtattccagaagtagaaatcctttttaaatcccggtgcaatattggaattggtattgtattcaaaatcatttccaaataccaatctcccttgcagcatataattggtcagctccagctttaaggattgattggctgtatttacatttgtcacattataattggtataatttgaaaaactgtatccaagtctgtaagaaggcttaatggtcattttatccttgatttcataggtgaaattaagtcccggattaagactgtatgagttgctggtaaaagcctgtccgtctataaaaccattattgtaagcatacaccatgctgaatcttgggttgatggtaagcttgttgtttttccacttcagggttttgctgaaacctccgcctgcgttgatgtttttatttccgcttacattgctgtaagtaatcacttgctttcctgtattatcataggtggaaaaattgatgatgtcattatttctgtacgtaaaaccaatattgaaatagtaactgaggtcttttaccttattataattattgaaatacaaataaagattgttgatccatgtatttttcagatcagggtttccctgataggtaatcaatggatttgactcatctttgtaaggagtaagctgctctgctgtaggaatattgaagttggagtagttgtaaacactcagatattttccttctcccatctggtagttaagatttacattatactggggcagtacaaaatttttctgcatatcatattgctgcccgttataaatagagtttactttcatgtctgagatatcaagattcatggacgcccagaaattcagtttctttttattaagctggtaggtaaactcaggagagatctgattgattctttgcttcatattgttggataaaagctgattgaatttagtgtaatctccggttatattatcaaagtcatttacatttctcaaatttctggcagacctggtttcatactttacttcaaaacttacacttgaagaatcggaaactggttctgtatatccggcagtgaaattaaaactgttgttctgatttttatttctggctaactgatccctgttgtctacggttggtccactgggttgatagaacgtgttttgagactggttcaggttatctcttttcgattcagagatggaactgctcatattcgctgaaatcgaacggccttttttcctgaattttcttgaaaaatagagataaggattaaatgaattactttccgaatcattacttgaatacgtattgctttcattcagaaggttcccgttatttaaagttgatgagcgtgaattattaaaattaaaactgctgttttttgtgaatcttggagaaagatagatgctggtcatggaatccagtttaattttggctgaagtatcaaaactgtattgcctggattcattttctccattactttcagaattggtctgaagcgtataattggggagaagggtagaccttgaaactttggatcttgtttccatattggaatcggaatgcatcagactgaaggaatcaagatcagcatctttccccaatttgtcactataatttaacccaatggttgttgacctttgaattccttttgtactgcctccctgggtgtaataagtcatatttcctaccgttgagacagttcctccctgcatcatccaggcattccgtccgttacccatactgtcaaaaacctcatctctggaaaatccttgtgaattgatgttattggaagaagctaacagacttatttttgtatctcctttaaaatagctggccagcccgcttgcttcatatcgcttgtcggagccgtagccaacagtaagcctggtcagcaaacctttatttttcttttcgtcaatcgtaaagttgatggtggtattctgcgatttggctgtttttccgctgagttcttcctcctttgttttggtagtggtaaactgaatatttttgatgatatctgccggtaagttctgaagggcaattttaccatctttatcaaagaagggtttaccattaatcatgatttggtctacatcttttccattcaccgtaatttttccctcattactgatttctacaccaggaatctgcttcagaagctcttctattttgctgtcaggtcttactttaatggcagcagcattgaactcaattgtatcttttttaatttttacgggagatacggtgatctttacctcatcaatagcatttaccagactttgtttttccagctggatatctcccaaggctaacgactgttctattttttcaaattttttggtgtaagaagataacttttcagcatcaattttaagaatagaaggttcttttacatcatcaattttcagagagaattttccctctttattggtagcggtgtaattaacgatagatgaatcttttacttttaaaaggtagacggtcgcattttctatcggtttcttttcagaatctgatacttttccgtcaatgtgtagtttttgggcgtgcagtataatgactgtgaacatcaaagtcaatagcaacagagttttcttcattagtttttttttcagagccgtaaaaatataaaaacatcccagttttgggatgtttctatgcgttttttgtgaaattttattattttttaataaaaattatgctcttaaatatcttgaataagcatatccttcctgaccgtctgcagttttcactttccaccagtcatcagaagtctgctcaataagcgttacagatgatccttttgaagctttacctactacggcagcttcagtagaaggctcctgtctgatattaaggttagactcttccgtagctactgttaaagaagctcctgaagcaagacctgcaacctgaacatcaatattgatatctgaagcagaataagtagaatcgatagctcccagagcattccatacagcatctttagccgcagtattggatgcatttccggaaacgtatagaattccgtcctgctcctgaacctgaagattagaaatccctgcagactgtgctgccgaaactacgcttgaatatttatcttgtaattcgctcatctttaattattttacgattagattgttgttatactttccgattttcaaagcatctacagattctttgatttttcttgcttgtaaggcagaaacatttcctgtaagggtaagctgtccgtttacaacttctacttttacagaagggaaatcttttaccgcatcctgaacttttttctgaacagcaggatctacagcagatgctgtttcaaccggtgctgcaggtgcaggagctgctaccgtagacatatccattacgtcttttactccgttgattgctttcagttttgcaatcatcgcgtctttagactgctgatctgcgaaagtaccgcttaagtgtgccacaccttcttttacttcaacagaagcattgggattagaagttactatagttgtagcctgagtctgaagatcggcatcagaaactttctttttacaagaaatagcaccgaaagatacagctacagctaatgcagccattgcaatagtttttttcatattgtatatttattttaatgttgttatacactcaaatgtaataataaaatttgtaccaaaagaataaaaattcaataaatgtttcttaatttttttacaatattttcgaaaccaggtttttaattttcattgattaaaaacttaatgtaaaattcacctctattgaagaaaatcttctgccaattgaaaaaccattatatttgcgcaaattgaactatatatatgaaaggacagaataaactttttatagcaattatcattgcactacttctgggagtaggaattggaggtgtggtacacgtaaactatccggatagtgcagaacccttttctaaaaatataaaactgctgggaacagtttttatcagattggtacagatgattattgcaccattggtttttacaacattggtagtgggtattgcgaaaatgagtgatatcaaaatgatcggaagagtaggaacaaaagcaatgctttggtttatttccgcttctctggtttctctttttatcgggttgatgcttgttaactggctggagccgggacatgtgacaaaactacctattcaggatgtggcttctgcagatgaacttcttaaaagcagcaaaagtttttccatggaagattttgtaaagcatatgatccctaaaagtttatttgaagcctttgccactaatgaagtattacagattgttgtatttgccgtgatgttcggcgttgcactggctaatttaggcgaagaatattcaaaacctgttgtaaaacttttcgatatcattgctcatgccatccttaaaatggttggatatatcatgtggtttgctccgcttggagtattgggagccattgcagcagtagtagccaccaacggttttgaaatctttaaagtatatgctatttatttaagagatttcttctttgcgatagctgttctttggctggttcttttactggtaggatatcttatcttaggaaaccgtctttttgatctattaaaaagaattaaagagcctttgttgattgctttctccactacaagttcagaagctgtatttccgaaattggtggaggaactggagaagttcggttgtaatagtagagtcgtatcattcatattacctttaggatattcattcaatctggacggaagtatgatgtatatgacgttcgcttccatctttattgctcagatttatggaatcgaaatgacgcttggacagcagatcacgatgcttttggtattgatgcttacttcaaaaggtattgcaggagttccgagagcttctctggtaatcattgtggcaacgtgttcaatgttcgggattccgccggaaggtattgctttgatcttaccaattgaccatttctgtgatatgggtagaagtatgaccaacgtgttaggaaatactttggcaacttcagcggtttcaaaatgggaaggacagttaactgagccattagacaaaatttaaaaacaattcatgagtttaaataacttagacaatcataaaagccatattcttgaatatggctttgctgttatcaataatgtgttttcaaagcaggaacttgaagaaatagatactgttctgcaaagtatagacacttcaaaagaaaatttcagaaaatctgaagatctgttcgccataagacagtttttaaaagaagttccggaaatcaaagacctgattttcaatgaaaatatcaggaaagtggtcaaggaaatattcggggaaaaatattttgtggtcaaaagtatttattttgacaaacctgagacttccaactggtacgtagcctatcatcaggatctgactatttctgtagataaaaagcttgaactccctggttttggcccatggacaaccaaacagaatcagtttgcggtacagcctccggtgaatgttctggaaaatatctataccatcagaatccacctggatgatactgatgaaaataacggagctttgaaagtggttccaaaatctcacgcaaaaggtatttacaggcctgaaaccatcgactggcctgtagaaacagaagaaatctgcaacgtagaaaaaggtgggattatgctgatgaaacctttaacgcttcatggttccaaccgaacgacgaacgcgaagaaaagaagagtcattcacatcgaattttctgatattgaacttccggaagtcctgcaatggtcggaaagaatgaattgataaataaacccttcttcaaaattctgaagaagggtttactttagcattaatcacaggaaatgacttcaccgtatgggtcatttatattctcgttatgataagataggaataacagggcttcttttgggttgggattccagaaggatgtcggtgtggagactttcatctttgttttcagtatatttccgatcatgctatccttacttccaaaagttgtaaaaggagtaatttcctgaatttttgatgtatcatctatttttactttatagatggcaaaaggttgcttaggtttgaatccactgatctttgataaatcagatctagattcagtttgggtttcatcatagcaacgggtaaactgtaaacccataaacctgaatttgtttttatctatgtaggtaaaagcctcggaaagatttttaagctgtaaattttcagcttttgtgggtttattttccagttttgattttggagtacaggatgaaatagaatacgtgttattgtatttatttaaaaagatcagatatctttcatcagggagtacattaatttcacaagctcccgaataggaatttccaatcaggccacttacattaattgttttgaatgcttttcccttataggttttttcaatttcaatatctgctttataggttctttgctcagtgttttcgtcatatactttcaaaattctgataatacctgcaaaatcagaattttgataattgtatgctaatgtttcatatacacatttacaggctgaaacgtttatgacacttaaaagtataaaagatagtattaataattttttcataattgcatttttatttcgcagaaatttcatcgataaaaatatacgcatcgcctccagctccctggtgccattccggaagttttccaaaatagtaagcttttactttgatatatcgggcttcagtagggagaattttagttgagaaatctttgatctggactttctcatctttaggatcaatatcattatcaatagttttcagaagaacaaaatcttttccgttcatagaagcataatattctacttttttaggcatcagaatccatgctctgctgtcctgaagataggtagaagacaagttggtgatctgctgaggtgatttaaaatcaataatggcttcaaaattttgtccctgatatccgtgccattcaccttttctccagttcacatctcctctgattccgtcaataagagcaagatttccggtagcactgtattgaggtgttacttttgacaggatattaatatcccaataattgggtcttctgttaaaataagcggttgtgacagaacttttctcaccgtttctttcagcataagccattacctgagtcgttttagtaatggagaacggccctttgtaagtgctgaaagtctttcttttattactgtcactttcgtccatcgtcatataatataccttgtcatttggattcagtggagtgatctcaactttggtagaaaaatcaaagattctgtcggcagcaattaccggtgaggctgtctgttctgtatattttaaatctttaacaggttttacgttttcgaaccctagtttcttaagttcagcacggcctgtagtttttgtaatcgtccttgtagtgccatcttcaagatgaattttaatttcgtcaaaataaggagtggtagtttcccattccggtaatcccggagttacagaataaattcccatggagcttaaaacatacaaggcactcatctgtccgcagtcttcatttccgataagcccgtcaggtgtgtttttataaaagttatcaaggatgtatttaattttagcatctgttttttcaggtttgtctacgaaattgtacagataagcaatatgatggctcggttcatttccctgagcatattgtcccatcaaccctgtaatgtctacctgttctcttcccgtggttttatcaggagctgtaaagatggcatcaatgaactgctcgaatttttctttccctccatgagctgcgataagccccggaatgtcctgctgtacggaataagagtaatgccatgagtttccttccgtataattgttgttgacttctctcggatcaaatggctcataccagtttccgttttttcttggctgcatgaaacctgttttcggattgtaaagatttttccagttctgagaacgtttcatgaaatactgataatcgtcttttttgcctaaaatttttgccatctgggcaatgcaccagtcatcataagcatattctacggttttggaaacactttcatgctcatcatcaatgctaatataattattctgtttataagcattcaaaccgaaaatatcctgcatggcagaaccttttgcagcctgaaatgccttctcgtaatcaaatccctgaattcctttagccatagcatctgcaatgacagaaacggagtggtagccaatcatacattctgtttcattggaagccagttcccataccggaagttttcctccctgctcgtattgtttaatgaaggtattgataaaatcagcagttctttttctgtcgattaaagtcattagcggatgagcgcctctgaaggtatcccaaagggaaaataccgtataataatcaaaaccattggcagtgtaaagtttgttatccctgcctctgtactttccgtcaacatccatattgatgttcggttgtgtgaaaacatgataaagagcagtataaaaaacagctaatttgtttttatcatcagactttacttcaatctttgaaagttctttgtcccagtcagattgagcctgtttttttaccgtatcgaaatctttcgtctgtccttctgccagcatattcttttctgctccttcataaccggttggggaaacagaaacctttacattaatcttttctccttttttaacattgactgaaaacgccagggcaagcttggttcctgtaaaaagattgttttcctgttttccgttaacttccttttttgaaattttcatcggctttgaaaattcaattctggcataaatatactggttggttgcccacgcttcacttcttctgaaaacctcaatagttttatcatcaatgatttttacctcaccttccaatagtttatctctgtggttaaggtccaggataatattggcatttcctgcattgttgaaagtatattcgtggtagccgactcttttggttgcagtaagacgaacatcaatattatttttatctaatctgacagcatagaatcctgccgttgctttttcatttttatgcgaaaattttgaagaatattctttactgttcagactgggatttcccatcgtaggcatcagcatgatatctccgtaatccgaaactccagttccgttcagatgggtatgagaaaaaccatagatcacagaatccgaataatgatatccgctgcatccgtcccaactgccgtcaattcttgtatcaggtgacaactgtaccatcccgaacggaacaatagcacccggaaaagtatggccatggcctccggtcccaataaacggattgacatattgagaataattctgtgcagaaataatctgggtaatccctatagaaaatgcaataagcgcttttttcatgtttttattttataaaaagcgaagatattgaaaaacagtaaaaacagagctaacaaatcatttggttttaggccataaaaatattctaatacttaagttgtttcttaagattcacgtcattctgaatggaacgaagtggaatgaagtacagaaaatttctacacttctccttcaaaaaaatccctgaggtacgcctctttgtctttgtctgcccgttcggaacccagatattttttccaggaccgggattcatgatagacaatacccatttcccatacacagtacgttggcagatgggttttgtttctgtcccatacttcaaatttgccggaaccatcataatatacgctttcccacagttcattttcatttcgccatgtgcagaccagcaaaagatagttttttccgcaacggtgcataataacaaatccgagatcatcaatgtttttaaaattttcgtcagcattgtcaatgcacttttgggcattttcaatgtcctgttgagaaatttcagcaggatcaccggccaggtcataccatttgaattttgtttttccaacggtaaaaattccttgtgactgtgcatatttggaaggataggacgttgttttcataccaattatttactgaagcttattatggtatcaggacataaaacaggaataaaaaatttttaacgatctgatttatcacctgatattatagattttattgattctaaattaccgaaaaaaatgcgtaaatttgtaaacaatttatatttatatgttgacgaaagaaaaggttcaggaattccttaaagaaatagaagtagacgatttggtgaataatcttcagattatgggtgatgatgtttatattgacatgactgctcattcgcctgcaatgcacgaaaagaaaaagctggaagctgccatgaaacaggcctttgccagtgagtttggagaaaacgttcatttaaaacttaaaatcgtttctccggagcctagtgaaattcagcaaagtcagatcaaaggaaaacaaattccggggattcaaaatattatcgctattgcttccggtaaaggaggagtaggaaaatctacagtttctgcaaatatggcagtaacgttagctaaaatgggctttaaagtgggattgctggatgccgatatctatggtccttcagtgcctaccatgtttgatacagaaggggagaaaccaatctctgtagaagttaatggtaaaaatctgatgaagcctatcgagaattatggtgtgaaaatgctttcaataggatatttttcaggcgctaatcaggcagtagtgtggagagggccaatggcttcaaaagcattaaatcagatgatcagagatgctgcctggggagaacttgatttcttattaatcgatcttcctccgggaacaggtgatattcacttatccattattcaggaagtaccggtaacaggggcagtgattgtaagtacacctcagcacgttgcattggcagatgttagaaaaggtattgctatgttccagatggaaagtattaacattccggttcttggtttgatcgaaaatatggcgtattttacaccggaagaacttcctgacaataaatattatatctttggaaaccagggagcacaatatttggccgaagatcttggaattcctgtattgggagaaattccattgatccagagtatcagagaagcaggagatgttggaagaccggcagcacttcagaagggatctaaaattgaagagatttacacagaaactgccagaaagatggttgaaagcttagtggaaagaaataaaaaccttcctcctactgaagccgtgaagatttccacaatggcgggatgctcgccaaaagcaaaataataataatttcaataaaatttgaaaaaaccgaattgaactgaaaaaatatggaaacaaacataacgcacgaagatacagtaacaagagtaatggaagctctggaaagcatcagaccatttttgaataaagacggaggtgatattgagcttattgatgtgaaagataatcaggtgtttgtgaaacttttagggaactgttccgggtgttcattgaatttttcaaccttaaagctgggtgtggagaatacaattaaacaacatgctccggaaatagaaaaggtaatcaacgtagagtaaaattatatctgagatattttaaaaagacaggcttttttaaggcctgtctttttatttgcattaatacaataagtttggccagaaagcttaacccaacctgacgggtttttaaaacccgtcaggttgggatgatacaatcagttccaaatgaactttttcattagaattaacactgatgaggtctaattaatccagatatttaacaaaatatacttattgttttacaaccttattttccactcccgtaatagaaacatccggttttccggattttgttcctgaagtccgataatagaccatattgtcaccatcttccatagaaattttgtccactttatcgatgtatactttattacccgttcctgaaaccataattttctgagcacttcctttgactgttaaagtattgccacttccttctacttcaacaacacctccattaagagaataattgagtttatgccctacaccttctacatgtacaaccttactaccttcggttttctctacgccattgacagattctgttgttctggattgtgcgaaaactgttcctgttcctgataacagcaaagcaagaatcccggcaattttaatatttttcattgtgaattggtttttgttgggttaaatatagatataaaatgctttcttaatgcatctcataagttaatcatttttaaacaagagtctttacactgtatatttattatagattccaataaaaaaagctccggaaacccgaagccttagatagaatgatatattgtactatatgattactttacaatgactcttttgatttgtccttcagatgtttttacaagataaacaccggcagaaagattggacgtatttattgttaatgcatttttttcctttccaataagttttccggacatatcatacaattcgtaatcttgttttctgttgaagtagagcgtatttcctttattcacaggattagggaacacattgaatgtcgcctgctcagcttttatctcaccagtaccaagtgttgccggcgaagctacttcaaacgttgatagcgttccactgatttcattggcaacaatcacgtagcctttattggttgttgtattttctggggcaatgtagataattccttcagggccattatcacctccgtaagcggatgtagaacgggaatgcttataatcggtgaaagtagggttgttaggatctgtgatattatataccataacaccgccggttctttccagtgtgatgaaagcgtaagtctgtccgttaatttttcctagtgccactccctctggttcaggtcctttcgcccggcttctgtttttaattacattcgactcattatccgcattgaaaattaaaggatgattggcggcaatatatctctcaaactgatctccgctgtcataaacgatctgtttggtgtctgcattgaaaatagagaatgagcgtgctcctaaagctgctatttcttcaaactcagcatctccatccgtatttcccgtagcagatgaaaccctgaatcttcccagattatgtgaagcttttaaaattgttgaattcgggaacaatacaggatccaaaatataactgtttgcacctacagtagttctttcactgaaacctgaaagatctttttcatctccttcattggctgttacaatataattggtgtttcctaccttataattctgtacggcatcaggaacataataggcttttaccggccagttggcaataactacttcaccgttattgtcggaagcatcaaaaccattccccggcaggctcatgtcttttttacccaatccccagattcctgtgatggttttagtgatcaggttaatttctgccactgcattattctcctgaagtgttacccaagctttctggctgtctgcactgatggtaacatattccggctccagatcctgggaaagcgtattgttggttcttacctttcttaaaccagtcgcagttaatgcagccagttgagattcaaaactgttgaaattaagggttgtcacattagtctgggaaagatttgcaatacctcctgaaatatcaatgatgctgattgttccttcaggatctactgtgtatgcatcatcaggctcaccttcgttggcagtaacgacttttgttccgtcaggggagaatgttaccatatccggtaaagcgcccacagttacctgtttcaggaagtttccgttaatatcaaagaagactacagaaccgttttgctgaggatctgcattcggggaagctgctgcaataattccattttttacggcaatacttgtaattccgccgtaaggagccatgttgactgtttttactacagacagcatttccggattactgaaatcgataatgtcaaaaacatccgtaatggagctgattgtaaataaacgttgtgtggttgcatcatgaactacaatttctgtagagctgttattgcttcccgaaggatcaaaacttccaagataattgagttggatctgatgcgaaggagcaggtgccggtttatcattatcgataatataaacggatgcagagttgtctcctgaaattgttgctccaacaggattttcaaggcttaccacaaagtactcggcctcctgttctgccactgtatcattaataatcgggatattaacagtgtagctcgttgtagatggagtaatgttaatggtctggttagctaaagtaaaatcattagcatcagccgtattgaaaggggccggttttacaaccaggtttacagttgatgccgaaggattgttaatattgattttaaaagcaaggcttcctgcattttcattgactttaatgaaattcttttccagagaaattgttgttcctgcagtagtaaatgtactgtaagtaaccgctgtaattccattatcactgaaatcttccactgtattaggcttcagtgccaggtaatacgtttgtcccggcaccattccggaagtaggaatcactgtgatcgtattgttgctgaaagttgtagtaaagggaacttgtgtacctgaagaatttcccagacggaaatcgataaggctttgtgcattagaatcgttgatcacggaattatctgttaaccttatattttcgttaaaagataacgttggatttacagtagttgaagcattgttggtattgttggccggaagataagtaactgttggcggcgtggtatcaataccccctgcaggagtagcatctaccgtaaagttatcaaaacggttatttcctccggttccgcctcctgttgcggagaattctacttttaatttaaaatcaggattgttgttagctccctgaatggcagaaaaatcaagagtaatcaattggggatcgttatcctgaggatttacagtctggaatggtacaaatgtaatcccgtccgttgaataagaccatgtctgtgtccctgctccctgtgcggatcttctggtagtgaacttaacaattatattattgtatcctgttgtaggtaaattaaactgtaaggctccaccaatcggattattgaatcttaagtgggtgccggatatatcaccgtttcttgcatttaaattctgcaaactaaaattctggcctgtaccaccagtaaaatcaattacactggttcctcccgctatggcagtaagagaaccattcaccaaagtggaagatggtgaggtaatagctgctgcagaagtattattattaaaattccagtaatgaatcagtgtctgtccgaaaagtccgctctgaaaaaagaatgcggcaatcacagaccctttgagtaagtagttgttgatcattttttgcttttattagataaatgcaaaaatgaactttatgtttcgcaactattttaatggaattttaagaaatgtttaaaaaataggtctattccgataaaagataaattatattcaaagagtatttttataattcagctattttcctgacttgcctgaaaaatttaaaacctttcctgatttatttccttccagaggatgtttctgcatataaaaatatcctgaaacggcagttacaagcaagagtacaaaaataaccagaacaattctttttaacatgtctctcatatcgctaaatttttaatatctctaatttctaaagtagatgtagggtaccctttttgtgttacattgatcattgctctacccacttcctgtaaagttaaggattttgattgaaaaaatacgggaaaaatccaaataaaaggtttaaaaaaccattttacatttaattgaccttcaataggtttcataaatccgggacgaaaattataagctcctttgaaactcattcttttcaaatcattttctgttctgccttttacacgcgcccacatcagctttccgctctccgtactgtctgtaccagctcctgaaacatagctgaaaaccatttcaggattctggtttaacaccgcttttgcaaaatgcagagtggtatcgtaagtgattttagtgtagtctttttcattcatccctatactgctgattcccgcacagaaaaaacaggcatcataccctttcagcttttcatcatgaagatctattgtcagaaagtcagggacaatatattctttcagtttagggtgtgattttcctgatggcttccggcttatgcttagtatttcagaaacaccagggttgtcaaggcattccattaaaacaccttcacctaccattcctgtagcacctgtgagaattattttgattggcttcattgttttgctattgatattggtatgacggatagggatgaagttttactttaaagtttttagataaaagataaaagataaaagataaaagataaaagataaaagatgttcctttaaatatctgaattcaataggggagggctttagcccgccttaacaaatgagctaccttccattggctttagccaaacttaatatgagaagagagattgcttcgtcgcttatgaactatgttcgcaggccttcagcctgttcacaatgacaaggcaatcaggaataaaagtctctgaaaataaaagccagctcaaaaatggctggctttcaataggtttgtaaaatgttattttttatcctgcagctgactgtaaatattatgaatcaatccatctgctaccgagattttcggaacaaaaattctgctgatgtcagaccaggacatgacattgttgaaaatactcaatgcatgtaccaatacatctgcccggtcttctctgaggttgtattttgtcattctttgttcaacagagagttcattaaactctttatacgtttttttcaggtgagacagagacattggttttccgtctttggttttgctcatggagaatactttgttgatatttcctcccgacccgatagcgacaataggttttttgctaacgatatttttcttgatttcgtccttcatctctttccagttatccattgtcacaagattattgagaagacggatcgttccgatgttgaaagatttttcgtaaaccatcttaccattttcgtagaaggtaagctctgtagagcctccgcccacgtcaatatatagataggcgaattctttgtcaaggccttctgcaacatgattttcatagatcagggtagcttcttcatcaccggaaatgatttcgatattgattcccgatgtttcttttacctggccgataatttcattgccgttcgaagcatcacgcattgcactggtagcacaggctctgtaatgatctactttgtatattttcatcaggtcactgaagattttcatagaatcaatgaccattttttctctttcaggcccaatctttccaatggtaaagacatccattcccagtctcaggggaattctgaggaggttcagtttgatgaattcaggttttctgttattgatctttacttcattgataagaaggcgggctgcattactccctatgtctatcgctgctatcttcattttttgcttgttttagcttttaaatatttataggtttctatctgtgaacggcactcttttttatcatttcttacatactcattactcagctttttatctaaaattctggctttcacattatccctaagctgaatatcaagaatatcttttaattctttcttaaggtttttgtctgtaattttagcagcagcttcaattctgtaatccaggttccttgtcatccaatctgcggaagaaatgtacatatcctcggctcctttattataaaaatacataactctggcgtgctccagatattcatctacaatactgatggcttttattttctctttgaattccttttgattgacggcacagtagattcctcttacgatcattctggttaccactccggcttttgcagcttcatatattttttcaatcagtgcacggtcactcattgagtttacttttacgatgatttctgcttttcggcctgccttggcttcctcaatttctttatcgatatggtgaacaatcttttcacgcataaactgggggcaaactaataaatttttacatgttttcaaaaccggaaggtaatcatctttcggttttttcagtacattgaaaactttattgatatctgccatgatgcctcgatcggctgtcatcagcaaatggtctccatatattcttgctgttttttcgttgaaattccctgtgcttacgaagccatactgaatggttttgttatgggctctctttttgataacacaaagcttggcatgcacttttttattgggaagccctatcagaacggtaattccttccggttccagcatatctttccattcaagattggattcttcatcaaatcttgcctgaagttcaagcattaccgtcacttccttaccatttctcgcagcatagatcaatgcattgatgatttttgagctgctcgcaaggcgataagcggtaatctgtattgattttacatccggatccatcgccgcttcacgaagaaggtcaatcaccggattatatttatgataaggaaatgtaagcagaacatcttcttttaagatgacatccgtcactctttccccatgttcaaaggcctgatgggtaaaggaagttctttcctccggtctctcatacttttcaaaaacatcaggaaaatccataaaatgtttgaaattatgaatttttcctccggggatgatactgtctttcttagttaaattcagttttctgataaggagttccagcaaggctttatccatatctttatcaaaaacgaaacgtgtaggcttcccttttcttcggtttttgagtcccttttctattttttctgcaaagttggttctgatatcattatccagatccagctcagcatcttttgttactttaaaagcattggcggcaaattcatcatacccgaaataagaaaatatatggggaagattaaaagtgatcacatcttccagcagcattacatttttttcttccggatcttctgttggcagcaatacgaaacgtcccacaaagcgggaaggaatttcaatgatggcataattgctggagtactgccagtctttttttctcatcgctacacccagatagagacttttgtcccgtaaataaggcatgggagtattttcatgaagaagaatgggaattacattcgattctaccacttcatcaaagtattgtctaacaaattctttctgctttgcggtgaggtttttagcatttttaataaaaactttgtgatcagccatttcggcctgaatttttttccaggttttatcaaagttcagctgttgctttatcaccacttcattgattcgctgaaggattttagatggcggctgatagaaagattcggcaatcactttttccttgaaatccatagcacgctttaatccggcaacacgcactctgaaaaattcatccagattattggagaagatgccaaggaaacgtattcttaaatgcaagggaactttttcgtccatggcttcctgcaaaactctttcattaaaggccagccatgtaatatctctaggattaaagtgtaatgacattctgaatgtgtatattttatcaaaaataataattagtgaagattcttcctctatttcttaggttaaactttgattaattttgaagatttagtgaattattctttttaattattgtgttttattataaagtagttggttttcagtatatttatatcatgaatagcctggttttgcccgggatgttttatttttttgagaatatttcaaggaattataaaaactttttaaccatgaaaaaattgataaccatacttctgctgcagttatctggattgatatacagtcagtatgtagaggttctgaaaaaaggacaaccggagaatttatcacctcagaaatttatgattcctttacagaatcatgagaactataaatctgcatttgtagggcagtacaaagcacattatcccaacacttatctcgggcacttatttacagccattgctgatgaggcaaaaaactcaggggcaaatgcttatcacattgtgagttttaaagaaggagattctcaaaatgaatctgaactggtattggatacttactccattcaggattctgatatcaaatatcaaagtacactgattgaaaagaataaaatttatattatcggagaacctgttataaacagtggaaatacttcaaaatttaaagtaaacggggagaaaaaagaagtaaaagacaatacatttgccaccatagctctaaaggaaaacgaagaagtgaaaatagtaaaaggagggattacaggaatggcagtctgggcaaaatggaaaccggaacagtttaataaattctacagcttttcaggaatgggtatagatggtgcaggttttggatctaatggaatgggtgttgccattaatacaggaaggatataccctgtagatcctgatctgggatattttttaattcaggttttaaaagagagcaaataaaatctcagattggatggactaaagttgacatatctgtgctcagaaaaatgatattttttcctgaaagcaacttcaaaaaccccattataaagaggtttttatttttattgtgtcattttgtcataattcttcaaatggtacagatattgagaaattgagagtgtaaattaaattttaaaatagaaaaaaatataaaatattatgagtaaaataattggaattgacttaggaacaaccaactcttgtgttgctgtaatggaaggtaaagaccctgttgttattcctaacgcagaaggtaaaagaactactccttctatcgtagcttttacagaagatggagaaagaaaagttggtgaccctgcaaaaagacaggcggtaacgaatccaaagaagacagtatactctataaaaagatttattggaactcattttaaagaagatgctcaggaaatttcaagagtaccttatgaagtggtagcaggaccaaatgatactgtaaaagtaaaaatcgacgatagagaatatacaccacaggaaatttcagcaatgactcttcagaaaatgaagaaaactgctgaagattatcttggacaggaagtaacaagagcggtaattactgttcctgcatacttcaacgatgcacagagacaagctactaaagaagctggtgaaattgccggtcttaaagtagaaagaattatcaacgaacctacagctgcagcgttagcttacggtcttgataaaaaccataaagatcagaaaatcgcagtatatgaccttggtggtggtactttcgatatctctatccttgatttgggagatggtgtattcgaagtattatctacaaacggtgatacccacttaggaggtgatgacttcgatgatgtgatcatcaactggatggctgatgaattcaaagctgaagaaggtgtagatttaaaagcggatgccattgctcttcaaagattgaaagaagctgctgaaaaagctaaaattgaattatcttcttctcctcagactgagatcaacctaccttatatcacggctacagctacaggtcctaagcacttggtgaagactttaacgaaagctaaattcgagcaattatctgcagaccttgtaagaagatctatggagcctgttgccaaagcattaaaagatgctggattatcaacttctgatatcgacgaagtaatccttgtaggtggttctacaagaatcccgatcatccaggaagaagtagaaaaattctttggtaaaaaaccttctaaaggagtaaacccggatgaggttgtagcgattggtgcagcgatccagggaggtgtattgacaggtgatgtaaaagatgtattactacttgacgttactccgctttctttaggaatcgaaactatgggatctgtattcactaaattaattgaagcgaacactacaatcccaactaaaaaatctgaagtattctctacagcttctgacaaccagccagctgtaagcatcagagtagggcagggggaaagaccaatgttcaatgataacaaagaaatcggtagattcgatcttacagatatcccgccggcaccaagaggagttcctcagattgaagtaactttcgatattgatgctaacggtatcttaagcgtatctgctaaagataaaggtactggtaaagagcagtctattaaaatccaggcttcttcaggtctttctgacgaagaaattgaaagaatgaagaaagaagctcaggaaaatgcttcagcagatgctaagaaaaaagaagaagttgaaattttcaacaaagctgatggattgatcttccagacagaaaaacaattgaaagaattcggtgagaaactttctgctgacaaaaaagcggcaattgaaacagctcacacagaattaaaagcagctttcgaagctaaaaatgttgatgacgtaaaagctaaaactgaagcgttagatgcagcatggatggcagcttctgaagaattgtacgcagctggacaacagccgggtgcagatgcaggtgcaggagctcagaatcctggtggaaacgccggagctgaagatgtacaggatgcagacttcgaggaagtaaaataatgattgtttaataacaattaatataaaatatagaaatccctataagcatttgtttatagggatttttgtttttatattctgatttctttttttagttggaatgaatttccttgacttaaaaggaaatgtgtgctttcatctagactgccgaaaaacaattttatttatggaagtagctggatttatccggaatggcaagtatattatgcgaaattctgaaaatcatagtttaaataagtgcagctaaaatgtacttatgagtttgattttcagtaaataattatacttgtacttaagcttttcaataaaatggatatttttgtaccgcatactttagtttatgaaaagcctaaaatattttttcttccttttattagctttattagcatacaaccaatattattctcaaaataaagttttaattgatactttgtctaagtatgactatttagaattagaagaaaaattctacaattacaaaaacaacaataaaattaaagaatctaaaataattgctgaatactatttgaaaaaggcaaagaaagcaatgattattaataatattgctgaagggtatgtgttcatgcagtataatcaaaatttagctgtctccctaaaatacatagatagtttagaatccattagtaatagactgcatgataatagatatcctgctcgtatttatctgctaagaggaaaattgtattttgattatgataatgaaaaattagcgttggataattttgtaattgcgttaagccatgccaaagaaaataacaacaaacgacagattgctatcgctgatcttcaaattgcttatctaaatggatatattggaaaacataaagagactgtgaaggtactggaatactattacggaaatcctgaatttttaactcccgaagatattgaacacattcaaataagtctggcagatgcatatattgatatttatgagtatactaaagcattgaaattaatagaaaaaggactaaaagatgcatcaaaaaataatgaaataaaaagatacaacaagtatttaattttgttgggcagatataatttggaaactaaaaattaccccaatgctatatccaacttagaaatttgtaagaaatattttttaaagaataatcttgattttgatgctaattataccatgttgtatttaggagaatcatatttaaaatcaaataaaaaagataaagctgtagaaaattttgttagaattgattctattattcaaaaaacgaataatacttttccagaacttcgtgatgtttacacttttcttgtagattatttcaaagagaaaaaagacaaagaaaaacaactttattatattgaaaggtttttgaatgttgataaaactcttgacttccaatttaaatacatatctagagaattaccaagaaaatatgatgcccctaaactcttaaaagaaaaagaaaatattatcaacgatttagaaaaaaagaaatattttttgttttctggtctaggtgttttgtgcctggcactagttgctgtaggttttttcttttatagatctaaaaagtcagaaaagaaatatcgaaaaattgctcaagatttaataaaatctattaatgagaagaaatcagaaatagagaaaaaagaaaaaaaaagagattttccttctaaaatcgagcccacttcaaagattaagaaatctgtaattagaaatatttcagaggacactgtacaaaagattctcaaggaattagaacgatttgagaataacgaattatttttacgaaaaggtatcactttaaacagtctagcaaaagattttaaaactaattctgcttatttgtctgatgtggttaatacctataaagaaaagaactttgcttcttatctcaatgatcttcgaatagattatgccctgaacagattagtacaggataaaaaatttcgttcttataaattaactgttgttgctgaagaattaggttataataatgaacaggcttttgccttagcttttcgaaaaaaaacaggaaccattttgagtacttatatcaaagaaattaaccagtctcaggaataattcatcatttttataaaaatttcgtgtaaaataatattctttattgagagaatgtgttgggcgtgattgccacaatggaactggaaaatgaaagttaaatttttacaggaagaaaattggtaggttatcagtaataatgaattatctgtttctaagaaaagtaatgtgccggtatctattgtgatttatatttacaccgaagtttttaagtgatatttttgtaaaattgtaatctaattataagtagcaaatgaatttgaaattatcctttattttggttctgttttttgtaaatattaatgcacaatcaaaaaatgatttaaatcctaaagaaaaagaatacatttcaaagtttatatatcctataaaaacttttaatcctgacgaaaaagatggcagtgatttgctcatcttaaacagactcattggaaattctaaaatagttggattaggagaatctacccatggttcgagtgaggtatatcaaatgaaatacagaataagtaaatatctgatcgccgataaaaatttcaatgtcttttcactcgaagccaatatgcctgaaagctttttaatgaatcaatatattcaggaaaaaaagggaaatcctaaagatattctaaagggaatgtatttttggctttggcaaacagaagaaactttaaattttgttgaatggttaaaaaaatacaatgaaaatcatgattcaaaagttttttttgatggttttgatatgcagtatgctaaaggagcaatagatcagattagaaaaacatatcaggaaaatcagttgcccgagcaagagattaatgacctggaaacagctttaaagcaaaataacagaggtttcagaacgtattctaaaaaaggccagaaaattatatccgagtatttgtttttaataaaacaaaaaggtatctcaattaaaaatccagatgaaaaattgcgtttcctgcaaaatgtagatattattagacaatacattcaactcaattttattaggagagacaaattcatggcggagaatgttaaatggttaaaagaaaactatttgaattctaaagtaattgtttcagcgcataattatcacattgcaaaattaaattcagatagaatgggttattggatcaatgaaacttatgctgacgattttgtaaatttcggatttgctttttatgaaggtacttattctgcaagtattgatgggaagattggcacctataattcagaacaggcttgtccgggaacattagaatataagcttaattcactcaatattccaatttttattctggatctaaaagcaatcagaaaggataataacaaacttggcaattggatactgaaagatattctatttcgcaaaacaggatcaggtacagataaaaatgaatttttaaaaaccaatgttgctaactcttttgattatttgatatttataaataagtctacaaattcaaagcttttaattagtaaatcaaaataaagatattcagccaacgtgatttaaaatatgtatttgtctgaatgtaaacactaacatttaattataaattaacccggcagcaaacaaagtttgctgccgggttttattttacaggatattcattgtacatcagaagtatggtgcaaattttagttatcttttttatcctccagaatcattttaccccagtcattgatatgatccagtaaagggataaatgaaacacccagatctgacagactgtataccactttcacgggaggttttgtcccgaagactgtccgtgttattagctgatctctttccagttgtctcaactgaatactcaaggtagtttctgtaataaaagaaagctcttttttgagctcaccaaaccttttatctccgttttttaaatggcagataataacgcctttccatcttcctccaatgagatccatgacgaaacttacagcacagggataagatttttcatcaacattgatataaggcgtctcacattcttttttcatttttttaatagtatctatatggatagttatttcatgctaatcgtgcaaaatttatttttacacaatattaatcagaataataaaaatagaaaaaatgtaccagttagcacaaattaatgtcgccagaatgatcggagccaacattgaagatcccataatggaagagtttgtaagccatcttgattcggtaaaccagttagcagaggaaagtgatggatttatatggagactaaaagatgaagaaaacaatgctacaagctttaatccattaaaagatgagcaggttatcatcaatttatccgtatggagaaatatagaatcgcttgaacattttacttataaaacatttcacgttgagttcctgagaagaagaaaagaatggtttcaaaaatatggaaaagcttactatgcactgtggtggattaaaaatgatgaatatccggatatagatgaagcattgaagcgcctagaacatttacaggagcatggtcccacttcctatgcatttaattttcagaatgtttttcaggcattatagctgtaatgtaagaccttttatctgatatttttatggggtaatggtgaaaacttttgcaatcagcatgttaataaagctatctttgtacagttcagtattttattgaaataaatgaaagaaagatatattgcttttctggcgcttgccggaatcatatgcttactaagttatacttctaatgaccctacaggatatactgtggaagagcttcgtacattgtacagcagcggagatcagagtaagtggccggttcctcatttatttgatgaagctaaagaaggttttcaggacatcgggcctttgcctgagatgagttttcctgaagataatccctattctgaagataaagtggaactgggaaaaatgttattttttgatccgagattgtcaggaagcggacaaatttcctgtgcaagctgccataatccggaaacaggatggtcagacggaagcagggtttctgttgggcacaataagcaggccggaaccagaaatgcaccttctttgatcaacataggatatgccaaatcattcttttgggacggtcgtgccacaactttggaagagcaggtgaaagcacctattgaaaacccggtagagatgaatcttcatatgtcgatggcagcaaagaacatcagtaagattgaagaatataaaccttattttgtgaaagcttttggaaatggcgaagtgacagaggagaaaattacaaaggctattgctacattcgaacgttccctggtaagtccgccttcaagatttgatcaatttgttacagagaagaaagatgctttaacagattctgaaatcaacggccttcatttatttcggaccaaggcaaattgtatcaattgtcacaatacaccttacttttctgatcagaaatttcacaatcttgggttaacatactatagaacgcaatatgaagatcttggaagatatttagtgactaaaaaaaatgaagatataggaaaattcaaaacacctgcgttgagagaagtttctcataacaaaccttacatgcataacggacttttccctgaactggcgaacgttgttatgacgtacaatgcgggaatgataaaagaaattccaaaagaaagccagcttaatgattctaaatttcctcacaagtcaggaatgatacaaaagctgaatctgacagatgacgaagtttttgatatcgtagcatttttgaaaactctgaacagttacaaatacaaaatgcaacctccggtgctgcctaagtcataaaaactcttccagtcggaagagtttttgatttcttggaatcaatcgtttttatttaatcaaaagataatgctgttttcagtatagcatctgatattgggattcgtatctggctgacttttatccggaatgaactggaactgacgtattaaacatctgactattaatgattttattaaaatttattaatgaatgattagtgtagttttaatttgtatatttgattttatttagaataaataaatataaatctaaagaatataactataatttaaccatttaattcacatttccactaaaaactatggaacaacaaaacaaaagaatccttactctggatgtaataaaaggtataagcgtcattggaatgatcattattcataccttactggtgtatgccaatgtaaaatcacaatatgaaacagcaattggcagttttattgtttttctgggaaggggaacctccattttcctgatctgtatgggaatcaccttcatgacttccagccaccagagtcttaaaagcgcaatgaaacgaggtgttttacttgtattggcaggtctattcatgaattttatgaaatttatgatccctgtatttttgggttttgctcccgataattttatccagaaatacgggtggaatgcacctattgagcagcaatatgtttatctggtattgctgggtgatattttacagctggccgggatgtcattgctgttcgttggttttattagggaatatgtgaaaaataaatatgttattcttgctataggattattcgctgcactggtatccagggaagtaagcggaattaatatagattaccctgtcattaattatattttagatcttctctttaataatgactatccggcttatgtttattttcctgtatttccatggatatcttttatcatcatcgggatgtttttcggtaaatggttccaggaactgaactatgacagcaaaaaactgttcagaaatatgctttatgtaggattggtatttgttgccattggagctcctttggtttttttctacagtgaatacaactacaacggcttttaccatatgggacctggaggcgtagtttattttgcaggctggacattaatttttctgtggatcatctatattcttaccgcaaaaatcaatgaaaacaaggtcattgcagtactaaaatactgcagcaaaaatttaacatcaatgtacatgatccaatggatattaatctcatggggaaaaggaattttcggatacagacaacatgaaataggctatgtatctgtacttatcgtattgtatattattctcaccttttcagtacagactctggtggatatcataagaaagaaaaaaacattaattaatttcaggccggtatcccctgataaaacatttttgaagcagtaattcctgattttattttttaaattataaaaaaccacagtacaagttactgtggttttaattgtcttaaagaatttccacttcttccgggaccacaaaaagaatggtacagccttgttcggatttcacagaatgtttaaaattaggcggagtatacaggtaatctcctttttcaagtcgggcacctgcaatatcggcatcaccttccatgataaaaagttcttctccggcagggtgattgtgataaggatagctggctcccggttcaaattttaaaagaatactggtagagcgttttttttcaggatcaaattttaatgattttacaaaaataccttcatagtgaatccctttttcaattaaaggctgccattctttttgctctgtttttacgatgtaatcgtggatgttggtgttcatgatctataaattttaattgttattgatattaaactgatctaagctccatacgtatctggaaaaagtactcaatagaaatgctccggcactgaatgcaaaaaccgaataatccagaggttctttaatgccataagaaatactcatagcaacagcgaataataaagtaagaatagaagcgcacaaagctgtttttttcacctgatatcccagaaggagaagaattcctattgaaagttcagctgtagtagacaatacggcaatagcaggtgcccaggattgaggtaaaaacgaatttgtatcagcagtatactctacaaattttttccagccggaagacttggctccccaaagactaagtctgcttgcgactgcagataaaaatccaaaagctaaagctattcttaatagaaaaacggccatatcctgttgagttttcatacgtataatttttttgttttaattacagtacaaagttcagcaaaagccgttgcctaaagaatagacaattccgggaaaagcatgtaatatttaatgaagaaggatggacgctggaagctggaaatgatgatgtataaaacaattctgaacgagcctcaaatgctgtagagaattcagtatatggacatttagctataaattataatacagctttaatcacatgcttcatcagaatcgattgaatatcgattcacttctttgctcacttaagataaaacgaatttgaaaataaatctttgcgttataaattcagagtacagatttctccaacttttaagactgattcggaatttaattcagacgcaaagttttaagaaggtgatatcatatttttaaggaggcaaaggtagaatatcaatgaaattgattctttctaagcaacagggtaggcatattgcttcatcaatggattactgcattttttgcctagtctcaactttttacccgatatccatcctgatttcttttaaatttcctttactgttttctgatagtctttgggagagcgtgaagtatgttttttaaagaaattcgaaaaataaaaaggatcattaaagccaagttggtaggcaatttcttttacggtcagtttttcatacatcaaaagtctcttggcttcagaaatggtaaggctgtagatcacattctgtgcggttttattggtgtgaagctttgaaacctcattcagcttggcttcagtcgttcctaaaagatcagcaaagtctgagacctgataattgtttttaaaatgatcccttacgctttcaaggaattttaagaataaagcatccggtttccagatttcatcaccattggcaattttactgcggttgatttctaccagaagcaattctaccagtgagtgggttgagatcagatattggtaaggctgttcctgaatctctttttcaatagtattcagggtttcagtaaaaaatgaaggatgccgtacagtgatcatttcattcattccgaaatgacagaagagtccgttgtggaaaataagctcaatatcactgtcgcttttacagaaaaaatccagggtaaattccagggctgtaagctccccttcaacagattttagttgatgaaactgccctgatgtaatggttacagtctgaccggtcttcagagtaaaagtattttcgtcaatcaggatttcagcacttccctggctgcaccagaacaaggtatatctgatgacccggcgtggttcaggatatcctggctggttggagtattttcttatttcaatcattttgggaaattggagcttatcattgactaaattacaaaatgtttcaatatcaataagaatatggaattatattattagagaaaatatctaaattcgtatagattttaaataaaaattcagaatgaaatattcaaaaattattatcgttgtaaccctgttgttatttcagttgggtacagctcaggaaaaagcagatgttgtggtaaataaagctattacggaagctaaggctggtaagaaaaatgttttactgatattccatgcttcatggtgcaaatggtgcaagatgatggaaaaaaatatggattttcctgaaaccaaacctatatttgacaaaaggtttgtcacagcatatatagatgtgcaggaaagaggagataaaaaaagccttgaaaatccgggcggacaagagctgatgaataaatataatggcgaaaatgcaggacttcctttctggctgattctcaatccgaagggtgaagttctggcggattcttttgatgccaaaggagagaatctgggctcaccggcaacaccggaagaagtagctactttcattgccaaaattgaaaaatcttcaaaattaaataaagaagaagctcagataatagagaaagtatttgtgaagaaataaagaatataagtctttaaagaaattaatttccagaagatatcattttcttgtaatactcaatttatataaaaggacgaaaacaatgttgtgttttcgtccttattgttttttaattattttccaaaatacatctgatcctgcttctgctgttcattataaatgatctggaaacttacaggcatatattgataaagaagtttccagtgctggatctttgcgtgttttttgaaactttcaaaagatcttacaaacagattttcaatcatggttcttacataggaattcccgtttctgtaaagccagtccatcagcttgatgtgatgggcaatgatattgatcttcgattcctgcagcaggtttttcagataattcacggtagcctgcatgattccggcgaaattgtcctgtacagacaactgtgtgatttcattgcgaagtggcggatagaaaaattttaagtattcaacagctattttttgattaatagtttgcatttgtactttcatcataattaagaatttttcaaacactttgtatggcagcgaaatgtataccaaaatttaaagacaggctgcaaaaacaaatactcctacaattacagcgatgtgggtgagtaatatctctgcattgtgtctgttagtcgtggttttccaggttttccagtctgaaattcttctgattttatttttcataatctattgattgtgagttatttttatttttgtttaatttaaacactttgtaatgaaacggataaaaaatgtaacaaaacctttatatgccgtgactgtaaatttgtctcgaatacactttctgaaggttggcagaaatatgactaaaaatcacttttctgtatccctcactgcagaacgcagtacaattgtccagagaatagataaaagtggtctcaatagcattcttcaataccgtatctccgtcagtgtaaattttgtccattttctgtaagcttctgaagagcaggtttctctcattctggcggatcatatttttaatacgctccgtgaaggtacggataatgctatatgagttttgaattttgatttcttttacttctttttcaaaatcgggaaccacatcagtgatttcctttacggcctgtaaatagttcataatatgatattttaatttggattgtgttcaagcattttgatgatggcaccaaagatgaaaacggttaaaaaagcaaaaaagagcagatgataaggtttcagccatttgggagtttccgggcctttgctttttaatcttccgagcttgtcgagtctgtttaaagtctttaagtccatttttctatgttttaaaatcatgatgccaatggtattccgttgaaaataaaatgtgatgaatatgttgatagctagtgttttgtgattttattgccagattttttaaacaaaaaaacgtgtcaaaatgataaggtttttatcaatttggaaaagtggaaggcaaaagactatgttacctgccataacaaatgaccgactgatcattcccctcccttggagggatggcggaaattcaaagaatttttgacggggtggtcaaaagagagtactacaaaatgacattttttaagtttcgcagaaaggataagaatgaatatctttgcagtccaaatattcagaaaaatgttttcaaaaataatagtacacagagtcggaaataagattaacggagattccctgacactttcccaggaagaattgaagctggaagaaggaatggcagagttgcttgaagattactttttaggatccttcaaatcggaagaaacttttcatttttacagtgacacttatcttgtgaataatccggtttacagtgctgtttccgaaatttttgatgataaatccaaatttatctgggaatctgagaatattgccaaacatctttttgaagctgcagaaaacccaagggttcagagtggtgagcttttcatcgtactttttgaagatgaaagtgatcgccctgacaaagtggataaaatcgggatctttaaaacagagaagagagaatctttcctgaaaataaatcctgcagaagaaacatttgatattgaaaaagatcagggtatcggtttatccaaaattgataaagcggctttgatctacaacaataataaagaaacaggatatgtactttctgtggttgacaacaacaagaacggggatatgtattactggttcgaagatttcctgaaagtaaaacagcgtgatgatgaatatttccacacgcaggaggctttgatggtgtataaagattatatcaccaaacaacttcctcaggaatttgaagtttccaaagcagaccaggcagatttcctgaataaatccatcaatttctttaaagaaaaagaagaatttaagctggacgaatttgccaatgaagtactgggtgatgaacatgtaattgaaagttttgtgaactttaaaacagattacgaacaggatatgcaggtaaatattgctgaagaattcccaatcagtgaagcagccgtaaaaaagacacagagacattttaaaagtatcattaaattagataaaaacttccatatctacatccacggagaccgacaaaagatcgagatgggtgaggatgataaaggaaaatattacagactttatttcgaaaaagaagtataaaaaagaagtctccggttccataataatatcataactttattgctgattacaaaataacagctatgaaatttctgatcattttctggggaatctttctcttttttttctgcgctccttttcctattttattgtatatgttgaatgaggagctggcaacagaaccgagaaattcattagcggtaagctatgggtatctcggtttttctttgttaatatggggatatgtgattattttctttatcaataagcttttcattacaacttttaaagagaaaaatacgataaagtatattcttcggaacggaattccaagagaagccaaaatcattgattataaactcctcaaatacattgctaagaaaaacatgaacctcattcaggttacgctttcatttcctaatctcagcaatacgttgatagaacataaaacgatgtttcatgattctaaaccatacgaaaaaagatttgatgcaggaaacaaagtaaaagtactgctgaatcctcaggcatcaaaggagccttactttattttaagcgatcagaaagtgggattcaacacatccggaatgatgttaagaatcgtatttcttgtattactaatttcttatgtcattggcttatactcttatttctattggagagagtcctttgattttggctggaggtttctgacactcatgcacccgattcttttcagcggggtgatgaccattatatatgtcttggtttttcagttgatttttggcagacttttaaaaaatacaaaagaagaacgcattcttttttcaggaagaaatgctgaagccaatatcatcagtgtaagtgagacaggtcttcttgttaataatcagccacaaatcatgtttcaggtaagttttaaagatttcagaggaactgaacatattgcggtctataagaaaattgtcagctttctaaagctctcttccattcctaaacagggaactattgagattatgtatgatgagaatgacccaaagaagattatgattcccagaggggtttagggagtagaaaggtgaaatagcaaaaagagaaaaccgctaaatatgataataagatatcagaacaattaaatattttttagatgtaaaactctgttttgtaattgactatttaacatataaaaaaatacctgaattcatttttttaataaactcatttttgtttaaataataaggtgaaatcaattcagttttatacggaaaatttttaagtaaaaaatatgtttttttcagataaacaactacttaacataataaaaaataacctatagataggagttagttgtatacatttgagacttattaaaaaaaacatatttatgaaaaaattaaaaaaaatgactcgtgaacatcttaaaactgtaaaaggtggagaaaaacaagtttggattgcagaattttgtggtcaaactgctactacaactcaagattggacggcagaacaagcaaatcaatggcttgctaatcttgaagcaaattactgtaattaatatttgtttcctattaattattgcacttatggccttataatgttataagtgctttttttttgcaatcaaaaataattctatgtattactataaaaaattatttcaattattaactttattttttagtgtcttatttttttctcaattgcataaaaaagatagtctgcgtggtgaatttacctatttattaaaagctaaattgaatacatcaactcctgattatagacacgaagaatttttttcattacagataggtaatgaacgtgctttttttgcgagtattcagtcactgaaaagagattcagtattccaagcacttccaataaaaactttagaaaatggagcaaaactgttaagttcgaagggagtatccatcccaaaaacaaaattttcctttactataatacaatcaaatgaaaatatacagtattttaacttagttggaatgtcaatactcacctataaagaaccgatcattaaaaattggaaattgagtaatgatacaaaaataataaacaccattaattgtaaaaaagcggaagttacctttaaggggagaaattggatcgcttggtactctcccgaaattccattaccctatgggccatataaatttagcggattgcctggattgattgttaaaataacagataataaaggagaatatgattttgagcttgtaaaatctacacctgcatttaaattaaaaggtaaattaataaagataaacgaaaatagatataatgaagcttttgaaacgactcgaccgaaatttgaaaaagcgttaaaagatgctaatgcaaatttaattggtgtacttcaaagctctgaaaccactattatacaaggacaagaaataataaggcaaagacaaaaagaaagggaagaaaacaaaaaatacgaaaacccattagaattagaaaaagattagtaatagctaatttttttttaaatgaaaaatatctccttatgcattatcatagaaaactaatacaaatattgattttactttatggtatgttattttatgctaaatcatataagcaggacactttacgtggtaaatttacctataagttaaaggctaagtttgatacacgaaccgacaatccatatcaagaactattcactttacaagtagttaatcgtcgggctttttttgcaagtgctgtatctctgaaaggagattcagtaatggcaaattcaggaataatggcaaaaaaccctgatggaagtataactttaggatggaaagaaggtatatcgattcccaaaacaaattttcactttactataatccaatcaaatgataaaatccaatattttgataaagcttttatgtcattacttatgtataaagagcctgtaataaaaaattggaaacttatagatgaaacaaaaataattaacacaattaattgtaaaaaagcagaagttacttttaaaggacgagattggatagcatggtatgctcctgaaattccatttccttacggtccgatgaaatttagcggattacctggattaattgtcaaaataacagatgataaaggagattatgattttgaacttgtaaaatctgtacctacttctaaattaaaaggtaaattagttaatattagggaaagtcgatatattggagctacagaaactacacaagcaaagttgaaacaagcaaaacagaatgtagaatctaatgtcgctggtgtactcgctagttatggaacaactattatacaaggacaagaaataataaggcaaagacaaaaagaaaaggaagaaaacaaaaaatacgaaaaccccttagaattagaaaaagattagtaatagctaatcttttttattttttaaatggaaatttataatttccatttaaaaaaataacatctttactagaattgaattagaaaacctgaacttttaaggatgcaaattagctgtttttacctttttgcccttttctcatttcccttattcgctatctttgtgttcttagctaaatcatatgaaaacaaaaattgtcgatctgacaaaacctatccaatacaatgcaggagatccctggttcatgagggttaaaattaaacataaagctcaccgaaaatcacattggctgattcgtctggcattgagacttccatcaagactttttcctaagaactggacaggatgggcagatgataccatcaaaaatatgggacttcatgctactactcacattgatgctccgtggcattacggtcctgttgtagagggaaaacctgccaaaaccatagaccagattccgctggaatggtgttatggagatggtattgtgatcgattgtacccataaagaagattttgtagccatcaccgtagatgatctgaaaaaagatcttgataaaaacggaattaccattcaggaaggaaatattgttctgatcagaacggatcgtgacaaaatgatgggcactcctgattttgtggaaaaaggaacaggaatgagtaaagaagctacagaatggctgattgatcaaggtgtaaaagtcatgggaatcgaccaatggggctgggatcttcctctgaaatatatggctcagaaagccaaagaactcaatgattctgaattcttctgggaaggtcatcgcgtaggaatcgaaaaagaatatttacacatagaacaacttaccaatcttagtgcattgcctccatgcggatttaaaatctgtgtatttccgcttaaaatcgttggtggctctgcagctccggcaagggtagtggccatgatgaatgaatagaacataaataaaaaaagaaagagcaaacctgcattgcagatttaccctttcaaacattatcatttttagcgttattgtttattgagctaagcttttttcctgaaaaataaagccctgttatattcaaaattcattctggcaatattcagtacagagattccctgaggacattccacttcgcaggcttctgtattggagcagtgcccgaataattccgtatccatttgggttatcatatccagtactcttttgtttcgctcttcttttccctgaggaagaagtgccatatgggtgatttttgcagaggtaaacagagctgcacttccgtttttacaggtggcaacacatgctccacatcctatacaggcagcagaatcaaaagcttcttcagctgtctgatgggtaaccggaattgctgtagcatcaggcgcctggcctgtattcaccgatacaaaacctcccgaagatataattctgtcaaaagcagaacggtctacttttaaatctttcttcaccggaaatgcttcagcacggaatggctctatcaaaatcgtttccccatctttaaatgatcgtaaatggagctggcaggtcgttgtattttttaaaggaccatgggcaataccattaatcatcataccacattgtccgcagattccttcacggcagtcgtgatcaaactcaacgggttcatctcctgcaataatcagtttttcatttaaagtgtccagcatttctaagaaagacatgtggggattcaatcctttcaggtcgtaagggaccagttttccttcactttttctgtctttctgtctccatatcttaagatgtaaatccataattttctgtttttatttgtaacttcttaccgttggctgaatttcttcaaagattaaaggttccttaatcagttcaggttctccattttcacctttccaggcccaggcagaaataaattgatattccgcatcatttctcatcgcttctccgtccggagtctggaattcttccctgaaatgagctccgcaggattcgttacgggttaatgcatcgtagcacatcagttctcctatttcgaaataatcggctacacggccggctttttccagttctgtattcatttgatctccctgtccggaaactcttacatctttatagaattcctgttttagttttctgatttcctgaatggcatacttcagaccttcttcatttctggctagtccgcaataatcatagaggagttttcctaatgttttatggaaataatcaacggttttgcttccttttatattgatgaaatcgttgatctgatctttaactgctttttcagcctgttcaaattccggagtattcggtgaaatttttccggtatgaatttcatccgccagataattggcaatggtgtaaggtgcaatgaagtatccgtcaactgaggcctgcagaagagagttggctcctaatctgttggctccatgatcggcaaaattagcctcgcctaaagcaaacagtcccggaacggtggtcatcagttcataatccacccaaaggccacccattgagaaatgggcagaaggggagatcatcatgggttctttataggcatcatatcctgttattttcagatacatgtcaaataaatttccatatttttccttgatcttctcttttccctgttcctgtattgcttttgaaaaatcaagataaactgcatttttcaaaggtccgattccgaagccggcatcaattctttccttggcagcacgggaggaaatatctctcggcgcaaggtttccaaatgcaggatatcttctttcaagataataatctctttcattttcaggaatatcgtttggtgctctggtttcaccttcttttaatggtacccagattcggccgtcattacgtaatgattcagacattaaagtcagtttagactgataatctccggattgcggaagcgaagtaggatgtacctgaatccagcttggggaagccattaaagctccctttttatgggctctccagatagcagaaccattacagcccatcgcaagagtagacagataataaatctttccgtaacctcccgttgccaatattacagcatgggctgcatgtctttcaatatctccggtatctaaattccttacgataattcctctcgctttaccatcaacagtaaccagatcaagcatttcatgtcttgaaaataattgtacagagccttttcctacctgcctcatcaaagcctgataggcacccagaagtagctgctgtcccgtttgtcctctcgcatagaaagtacggcttacctgaacccctccgaatgaacggttgttcagatatccgccatattcacggccgaaaggtacaccttgtgctacagcctggtcgatgaggttcagagaacattctgccattctgtagacattggcttcacgggctctgaaatctcctccttttaaagtgtctacaaacattctgtagacactgtcaccatcgtttttataatttttggcagcattaacacctccttgcgctgctacagagtgcgctctccttgggctgtcctggaaacagaatgatttgacattatatcccatttctcccagagatgccgcgattgagctacccgccagacctgttcctacaacaatgacatctagttttttacgattggcaggattaacgagtcttgctttctttttataattttcccatttatgttccaatgggccttgtggtatttttgaatctaaaatcatgaccgttctgtttaatgataagtaaagaatacataaattggcatcaatgcaaagcctacacagataatgattgaataagcaattccgatcgttttgaaccaatgtacaaacttaggatgatataatcccagggttcttacagcactgtgtatcccatgaaccaggtgataacacaaagcgatcattgatacaacataaatgataacgtaccaccattctttaaagacatttacaaccagaatgtagagatctttatttccgttctcatctaaaggaggagttccgaacttgtagatataccagaaattctggaaatggatcaccaggaaaatcaggattaatgttccaaggattcccatatttctggaagcccatgtactggcccttcctcgtttgtctgtctggtaatcaccacctgattttttatttttcaaggtaatgattaatccgtcaatggcatgcaggataatactggcatacaaaacataagaaactattttgataatgatatttcctgataaaaaatgcgaataggcattaaactgaaggtgcgcctgttcttgcggaagaaaaagctgaagatttccaaggaaatgaatcaacaggaagaatcccaaaaagagtccggtaaggcacatcagcatttttcttgacaatgttgataacatatttttgatttaatgattaataatatcctaagactttcatccacaatcctcctataaccatataaatgatcagtagaacaattcctatctcaagacctctgagccaccatgctttaaggtctacatagccgcttccgaagaataccggagcaggaccgtgaccgtaatgagtcaataccccgtaaatagaacccatgaaaccaagcatcatcgccagtagcataggaggaattcccaaagaaacccctacacccagcaatgctgcatacatggctgctacgtgtgcggtggcactggcaaagatatagtgactgaagaaatacacgacaataataacagggaaggctacctgccagctcaatcctccgatctgaactttgataaggttactgaaccagccaatgaatcccagttcatttaaagagcttgccatcatcaccaatacggcgaaccaaacaatcgtatcccatgcacctttttcaccttttacgtcctcccaggttaatactgaggttaacagtaataacgttaaaccaatgaaagctgttgttgtagcatcaattgaaagagctcctccaaagatccaaagtgccagcaggataaagaaggctaatagcatcagccattcgtttctggaaataggtcccatttcttttaatttctcagccgccatttttggagcatcacctgtttttttcaattcaggcggatataatttgtacaataccaaaggaacgacaaagaatgctaccgccccaggaataaaacctgctgcagcccatgacatccaggtaatatcgatgccaaggttagcggcaaatttctgacacatcgggttactggctgtcccggtaaggaacatagaagaagcgatgaggttcatatagtagctgtttaaagtcaggaatgatcctaattttctatgggtttccggcttttcaggaaccgaatcaaaactgatggccatagatttcatgataggataaataattccgccacctcttgctgtgttacttggaatagcgggtgcaagacaaacgtcggcaagccctaatccgtaagccagccccagtgaacttttcccgaaaactctgatgaataaaaaggcaatacggttccctagtcctgttttgataaaacctctggcaataaagaatgaaatcccgatcagccagattactttatctccaaaaccggaaagcgctttggtaatagattttccggcatctcccggagcaactacctgcgtaagggcagtaaatccaatggccatcatacacatggttcccatgggagcagcttttagaatgattcctaaaatggttgctgcaaagatggcaaacagatgccaggcattctcagcaacaccttccggggcaggaatgaaccatatgatcaacgcaacaacaaatgtgatcgctacgtttttaatattaatttctttcatgatactaactgtttaatcgtttaaaacctactctgtacctgtacaatgaatagattgttattgtattgtgatgtgttttctacctgatgtttgtagcggtcaaactgtactcccagctgaattcttgcgccataatttttcagaaattccaatccgaacatcggtgttatggtttgtcttgggttggaagccattctgaaattggtgtcaagatattcgtaccggcaggaaagttcgaaggcactgagatttttatggttgatttcatatctcagattcggaaggaaataaacaccgcggatcagatattgatcagggttctcaggccgtagctcaggagcaatggaattatacagtacgtggttggtggcctgtttgccttccagctgcatgtccaggctccatttcggatcaaaatgaatcagtgagctcagatcaactcccaaagcatatacttttttgctgaaaacctctccgatacctccatttaatcctacattgaaattatattttttagataatccgaaaacaagacgggtagaatactgttttccgttgtcattatcattgatctggttttttccgtttccattcactactgaaacagcatactggaaaggaatttctcccagctgaagctgtcctgtagcagacattccgatctggaaacttgtccagccaagttttccgaattccgtatactggttagaccagtctaaagatttaatgatatctataggataagtctcttcaataccgaaccatggtctgaactgtcctacggtaattgctaatttgggattgaatgtgtatttgaggtaagcattttcaagaactctgcttttgggatcatttttaaagtctgcaaggttggccaaaacgacaacttcagtacgtttgctgatctgcgcccgaacctggaccctcatgtatttgagcatgaaattattgtcagttccggatccatcggtatgatgaagtccgtttacatcaacatctttagtcatccctacaagataacgtgcctgaaaaaggcctttgatctgcagctgcggatattttacattatcttcttcctgtgcaggaggtgtggtcttcagagaatcctgattctgagcataggcagatagtccgcaggccagcatgcaaaggatcaggcttttctttttaatcgaaaaaaaggccatatctattttgtttttttattgtgaactttattttatcacaagcttcaactctccgtcagatttaaatgaccggattgtacttatgatgctcagtactctttcatccgcaggagcagatgtataagtctgttaagcatctttttctgataaaatattactttaatcctaagaaggtgaatggagcagattccttaaattctgcattggattttccgctatatgtgcggtagttactaaggtcaagtttcattactttaccttttgggcttaaatcaaattctttaagatctacccagaaagtatttggagtaaagactgtttcaaaataatataccagattcttctgatctgaaacagagcgccatcttgtagacgaaatattaggttctgttgcagaagtgattccgtaaggaacagaacagtttctgatcacactgaaaacactggctaccgctgttcgggtatctgctgtctgaggaatcgcattgatgtagtaagaagctcttacaaagcggtctgcagcgcggttggttcccggaagcataactgttcccggaatacctttccagtaattgttaagcgccagctgctcttcgaaaataggagaattggtcatcacagtataagagggatcgtggtgaattaccagctttccgccaatatattcaaatacagcgttgtctcctgaagcatcggaaatagaaagatggacggttgtaaatctttctgtccccggaatataatcacttacaataacgaatggttcttttcttgaaaattctacagcttcttttacggtggcaaaattatcaagataatattgagcccataatgaaatggcaattccctttttgcttccttttccatcaaatttcggatattcggattctcctaaccaaagcaggttggccaccagtcctttttcattcatgccgtcagctgaagcaatatcccatgaagagcttacaagacttccgtatttggcagtccatttgacagatttaggacctaccagcccatttcggtctattcctttcggtaaaacccataagttgacagggatttcatcccgccagtccatagaacgggcagtaataacggtattctgaggacctttgtatactactcttgtacacgcttcagaaggattccataatcctatagaaaggatcagagaaaataaaattaatgggaactttttcataatagtattatttgaatttaaattttatgttgaatctgttgtgaataattcaatgtattttattcatattcattatttggtgatataaatttagcgaaatttgtttaaataaagtaattatttaggttgataatatgtaatttatgttatgaatcatgcctaatgaatgataattggatggttggatatttttttgtatattttaatgatatgatataaaacagttgaaaaaataagaaatattttaatgactttttcctttactttttcattgttttataatgtaacaatttgatgtattgtgctttaaaattaagtaccacaaaatgaaaagctgttaataaaaatcgttatatttgattaacagactgaaaagacatatgaattttatagaatgccatgaagagcctatccatattccgggttctatacaaagttttggctatttgattggcattgatgcagagctccataccattactttttttagcaggaatatttcggatctattcaaaatcgggaactcagaggagcttttcggaagaaaacttactgattttcaggaaagttttcagggcattattgattcagaaatctatacttcactggacaagtttaccagacgtagtaatgagacttatttcgataaaatttttatcaacggtaaagaatatcacttttctgttttcagaagtgaactttatatctttctggaattcgaagcggtactgattaaccccaataaacggatttccaataagtatgataacttttacatcatcgataatgaaaaggaactctggaatcatcttctggaaaccctttcaaaagtggtaaactatgaccggatgatggtctataaattcatgatggatggttccggaaaggtaattgctgaaaagaaaaatgagaatatggaaagtttcctgggacttcattatccggaatctgatattcctaagcaggcaaggaatctttatctgaaaaaaaggaagcgaatcttcagcaatgtatatgcagatacagttccggttctgagcaaaagcccggatcatattgaccttactttctcagcatccagagccatgtcacctgttcacggacaatatctgaaaaattccggtgtagcatcaagcttcagtgtttctattatcattgatgatcacctttggggtctggtaacatgccagaatgtggaacccaaacatattgaccttgaagacagggtacaagccggtatttttacggctcttgctgcgaatgcatattcctcttttaaatctaaaagcgaactgaattaccgtctggagctgaatgaaagaatgtctcagctgaaaactgagtttttaaaacataatattttgtttgattctcttattgaatgtaaagaagagatcagaaacttacctgaagcagacggaattgccattgtttcggaagaaaatgttataacagatggcagcacacctgatcttgaaagtattaacaggatcgtaaaatgggctcttgatactaccactgaacgtatctatgtgagcaggagctttcttaaagatcgtggtgaagagcttgggctttccgaaaatgcagcaggaatcatcatttattttatcgaaagggagaaaaatgagatgctgatctggttcaggaaagaattcgatgaacatatcaactgggccgggaatccggagaaaacaataagtgttttttcgcagaacggagaagaaaaacaaatgatctcaccaagaacttctttccggatttttacagaaaatataaaaggacattctaagagatggaattccagaaatataagtgctgtacagactgtaagagaccttatcctggaaacgtctcataaaaattataatgcgatcaaaaggcttaatgatgagcttaaaaaagtaaatgaagagcttgacagtttttcttatactatttcgcacgatcttggtacaccgctcaccgtaatgaaactgaatgcccagatgcttttgggaaatcttacggatgattccgggaaaagcaaaaccaagatcaatacaattattgaggaaatcgacaatatggctgaaatgatgcatgatgtgctgcagctcagccgtgcaaaatacagtgaaatccagcttgaaaacctgaaaacggttcatacgattgagaaaatctctgaaaatgccaagatgacctacggaagtcctaacagtgaaattatcattaaggaatgtccggacgtattggctgataaaacacttcttcatcaggtgtttctgaacatcatcaataatgcagtaaaatactcttctcataaagacgttcctaaagtggaaattgaaggaacagaagacggacagaccattatttacagaatttctgacaatggaattggtattcctgaagaagaaaagcacaagatgtttaagatcttcaacaggatggataatgccaagaaatttaaaggaaatggtgtaggcctgtctattgtacaccgtatcatgaaaagaattggaggaaatgttgattatgaaagtaataatgaagggacttcctttattttaacttttaaaaagccttacatttgagaaacttttaaaacgttattatggtaacagaatatcttaagcagaatacagcagactatcacgatgcagcagaaaaactttttaattctgaaaagattttcaataagactttcacattagaggattacaaaaaaattatccataccaattatctgatgcttcttcacagtgaagataaaatattcagcagtctttctgataagtatgcggaaaaacttcagcttgattcacgaaaaaagcttttccttatcgaaaaagacctgaaaagcctttccctgaacaatcggaaggcttcttatcatcttgaatttgacaatgaacatgaagcgcttggagccatgtatgtaattgaaggttccactcttggtggaaacgttattgcaaaacagctttcgaaaacggaaggtttcgatgaggtaactttcaactttttcggatgctatcatgaaaatacaggaccaatgtggaagaactttaaagaagttctggatacggaagtgcctgaagaaaactacagtgaagtgctttccggtgcgaaaaaactctatacgtttttgctgaacgtcaattaattcatttaattctaattaaattcctgaaagattgcgcaatttttcaggaattgttaaatttggggagtttcaaatttaaacttaactaacaaaaaataatttaaaaagtaacaatatgaaagtaactgtggtaggtgcaggcgctgtaggagcaagctgtgcagaatacatcgcaatgaagaacttctgttcagaagtagttttggtagacattaaagaagggtttgctgaagggaaagcaatggatttgatgcagacagcatctcttaacggatttgatacaaaaattacgggtacaacaggagattacagcaaaactgcaggttctcatgtggcagtaatcacttcagggattccaagaaaacctggaatgacaagagaagaattgatcggtatcaatgctggtatcgtgaaagacgttactgaaaacttagtaaaacattctccggaagtgatcatcatcgtggtttctaaccctatggatactatggcttaccttgtacacaaaacttcaggtcttcctaagcacaaaatcatcggaatgggtggtgcattagactctgcaagattcaaatacagattggctgaagctttagaagctcctatttctgatgttgacggtatggtaatcgctgctcacagtgatacaggtatgcttccattattgagcaaagcgacaagaaatggtgttcctgtaactgagttcttaagcgatgagcaacaaaaatatgtcatcgaagaaactaaagtaggaggagctacgcttaccaaattattaggaacttcagcatggtatgctccaggtgcagcggtttctgtaatggttcaggctattgcatgtgaccagaagaaaatgatcccttgttctttaatgcttgaaggtgaatacggacaaaatgatatctgcttaggtgttccggctatcatcggagctaatggagtagaatcaatcgtaaatgtaacattgactgctgaagagcaattgaaatttgctgaagctgctaatgcagtaagagaagtgaacggagatcttaaattttaatatttacccgctttaagcgggttttaaaataaataaaatccggctgtttcaattttgaaacagccggatttgttttatgaatattgagtgtgaaagtttcggcgcggccggaggccgcgccgaaactttcatttaaaattatagatatataacttatttcattgtatccacgaagtgggttacagccttcacaaattctttatttttttcatagtacaaaagatgtccgccatcaatggaaattactttctgattaggaaacctgaaggttttataatgttgagttccgactgctttatcatttttcccggcaatgataagtactggagcacgaatgtccttagtaatgggggcataatcagcatagtattcagggaagtctttggattttgagattactgccattccgaagtcgatgatgcggggatgaagagaatctattttatccatttcttttatggtttcgatatcttcggtaaggaatttatacccgattcttttttttcttaatgcactgctgattttggagagctctgaagaaaggctgtctttgggaacagttctgttttttgcctgtagaagactgtttccatattcaatctgttctttgacggattcatcattcagaaattgaagcgtaacgttggccagaatgattcctttgatatgctgaggatatttttttgcataattgacggctatgattccgccaaaggaatgagccagtaagaataactttttcaatttcagatgcagtctcaattcttcaatatcctgaatcattttatcaagatgatagttatctgatgtatcggattcgccggaaccccgttgatctatataaatcatctgcatatttttttccagactgtttcctcccatcagttcaaaagacggataaccctgtccgggaccgccgggaatataaatacaggcttctccttttccggagattttatatttgatccttacatgatctgaggtttcaaagtaagcttcaaatggtttattctgagcggaaacgagattcagagaagtgaaaaaaagaagtaaaagaataattgttttcataccattataacaattataaagggttatatattactaaaatacccaattatcttccttttgccttgtctcctcttaaggtcataacagtgctggtcacagctgctaccagttttccttcagtgttggttatttcgcagtgataaacagtgatggttttaccggattgtattggtcttgcatgagccgtaagcttatctttccaggttggacggaaaaaattaatcttaagttcaatactggtaaagctttcaccttcattcatcagggtagagtgggctgttccgatggccgcatctgccagttcacaaagtagtcctccatggatagttccctgttggtttccatgtatttcatgatccgcattaatggagactttggcttctccggaggcaacatcagttatttgaaatccaagtgtttttgaaatcgctgttggatagatctgataggttgtaaattcatctacattttcaccgttgactactttggtaaggtaatccagaataggaatttttgtcatggatacaggatatttttacagataaatatacagatctttggatgagaaaatcggggggtaacgaaggtatttgttttttctattaaatgctaaattcctgatcagaccatttttcagagttccgaaattttctcaaacaattcagggtagttgattactaatccaatttcatccaccgaaatttcagctttaaaatcggtttcaatattctcatacagatatttattaacatctgtccgtgtatattgctgctggaccggtctgatatgatggcttaaaacatcgatgtaaataacatcaatcttctgagaaccgttctctgaaagttttaaattgttgatcggtaacgtattggtgaaaggagtcagagaaatgtctatgaacttgaaattattaaattcagaatgtacaacaccgttgactttccattggttttgatttctttttcctgaaaaagttcttttaactgtattgatctcagattcaatcagaaaatcctgaacagtccagtctttatcaattagaattttataatttaaagcatatattttattctcgtggaagccaatgattttcgattctacagtataacccttatcgtctgaatataaattaaaatattcaagggattgataaaagattcctttccagattaatgtcttcatatcatattgctttgagtgttgtggctttttgaatggattttaatgtcagcgggatactcttctgttccggatcctgcttaatgtttctcttgcgactcccagaaatgaagccagctgcgtgagagatatacgctgaatcatatgaggatgatgggtttccagatgttcaagtctttcctgtgctgtataaagcttgaacaaattagaaaattcttcctgtctggaggcaaactggcgaatacagtgacgtcctaatgtctcaatttcagggactttagcagcggcttcaaacaattttgttttatcaaaaataatggcatgaagttcctcacaggcaatcatattaaactctgatttttgaccgcttccaaagctgctgatattggtagtgatttcgttctcaaagaaaaatccggtatttttaatatcaccttgtatttcataataacttttgcaatatcccttttcaatataaaacaaagaattacatatatctccttcctgtaacatcagttcattttttctgtaagttctttctgatagggcagactgaagcgtatgccagctttcatcggaaaatggtgtgagtgatctgatatagtttagaagattttgcatgatatcagagcgatcttttttgcaaaaataataaaattaaagaagactatttgtacaattaagtttagaaacggattatataagattgataaaaatacctttattttggtatagagtcagctatataaagattcattttatcaattttcagaatattggtatccttcgtgtaccaacctacaaatttttcatattctgctttattattaatgagccagctattaaacgcttcttgatctcctatctgaaataggtaataattataagcattaaatagattgttatcatccaatattttttgatagtttaataaaacatttgatggattatttttgtatttcagatattccctcaatgcttttattctgatatctgacaagttgtccagattgatttcttttttatcgacagtagcgagtgcaaaatatccgctgtaaagaagacagaaaggaagaggatcagtaggtttactgtcttttttaatagtaataaaggcctggcaaaaatcaactgttgtacttttatctttgaattttactgcttttttatacccgtcatataaaagttgactcatttcctggcttctggaagtggtgcgttccagatttaaaaatatttcaccataaacaagaccgtatagtatattattagaatttaagaataatttggctactctgtaatagtttgatggatatgccggttctgcctttattccgctttggtagctttcaatggcctggtctatttttttttcaagttcaaaaacaacccctctctccagataaagttttccggaagacggatacttttttaatccttcatcatacgtctttatagcttgttcagggttatcggcataatcataggcattgccgagaagggcaaaataatagtcatctatattgggataatctttgattttttctaacagtgatatggcacttttatagtcttcttttcggatataggcaagtgcaatttcatacgggtaggtgtaatcttgtggatcttttttttcacattctctaaggatagcgataccctcatcatatttttctttatcaataagtttgacagcgtcataaacttctgcacatttaaatgtctttttctgtgaatatatgaatgaaaaggtagtgagtgcaactataaaataagtttgtcgtaacatgagttttttgatattagtcctaatgcaaatatgcatttttttaaactaaaaagagcggaaaaaaccgccctcaacaaaattttatctaacaagtatgctttagatataaacacatccgcatcctgtttcccattcctggcaaagacgcatcggttcatgacagcccggattaccgccgccaccgccggaaactctgtaacaggtaccatcactgcaataataagaacctatagttggcggacaattgccctcgatatcacatattgcataaggggtgtcacctccgctgatcaggactagctgatttctctttaattttttcagatttttcatagtaatcatttttaatttgttgattactaatgtataaattttttaacacaccagcaagtgttttaattgaatagaactagagattaatgataacgatctttctattctacatctaaagtcatgaaaagagcaatttcttctgcattttcatacaatctggtgttcagtccggtaatattgaatcccattcttctataaaactgtatggccggataattggtattttgtgtttccagttcaataactcggcagtttagttttcttgcttctttaatggcgtttttgatcagcataactccgattccttctcgtctgtgtttttcatcgatcagaatattttcaatataaaaactattgttccacgttctttgctcacagataatccaacctgccagttcttcattgataaaagcaccaaaagaatttccctgtgcaatgatggtgttcaggtcctcaaggtcttcaggagtggtttcccagattttagtataaggcaaagacttttcttttaaaataaactcaaatgaaccttcaaattcaatagaagagactgcgtatattttgtctgttatatagccgttatgcccccagctcaaacccgggtcggaagttaatttttgtaattttcttatttccacatcagatatttttaagcttattggatttcggtgcagatttctacaagataattgttgatatctttaatgtaagccgttttttggccccaaggctttacagcaatatcttcataaagaacagccccgttttttattgctttttctaccaaagcttctacattgtcagtagtgaagcctaattccattccaaagggtttgtctcctgtttttgcagttaaaaatccttttttgatattggaacctgcaaggctgacagacgcgaatgaaagagtagtttcaccggtcagaagttctccgtagtctttttcaggagtcatgaactttatttcagagccgaaagtatttttgtaaaaattcatggactgttctacatcttcaacatacaggatgacatatttgaatttgatcataatttgaataataatggttttattttttattgataatatattcttcatccaccatcagctctgtatgaggcccttgtaaaggatattctttgaaacttccgaaatgaccgaagtgaagagggtatttttgagcaagcaaacgtactttacttccgaaagaattgatatcaaccttttgtaaggtatcttttttctgcctgccgttggtgaaaaagagcatcaggttacaatgatctttaaaatcaaaatcgttatagtagaatacattaagattttcttccctgcatatgtgcgacaaatcattaataagatcttgcttatactgcaaaggcagattacagtcaattctggcagcataatgttctgcattactttttttgaaatccgaacccaccatctggataaaacggtgttctatgtttcggaatttttctctttcaggcgggtagcttttactggattgaatggtaaaaggaatttcggaatctaacaatacagcattttcacgtatcaataattcttcgatttctaacgcaaactgaaaatgaaaatcaaaaagcatatggtcaccaatattgatgatcagttgattttcattaatatttaagtataaataagtttccttaaagcccgcttttaattcttcgagtttcaggataagatcatctgtattttcaacacggactcttgctgccaattcggctgggttatcggcgtgtccgccatatccgggataaaatttgaaaaattgaaagtcatataaattttccggaaatctgaaataccagtatacgcctaaaatcattggttattaaataatttaaaaattaaaaaactgtataaatcttgataagctggagttgaattcaattttttcataatctttatcaggattatatattttaatatcaaccttatttctgtccttgattgcaagtccgaaatgagttttaagatttgaattaattcgttccaatagtcccaattggagcattacatctaatattctttctccatccgcaaaatcttcgtaaatagcaacgggaagaggttggtagtcaggagtagatttaatataaagagaaaaaaaataaggatcaaggtctccgaactccatcccaaacataaagggaacttcaatctcctgttttgtcattacattttgaaaatagcaatgataaccatgaagaaaatatctccattttcctacttttccactctgagttcttctacttcgacctttgaaataattaaaagcaagaaaagggaaatctttgtttagctttatttttttcttttcaaaaaataaacagaccagttcttcgccaagttttctgtagtcttttgcacactgaacaaaaaataattgattggcaattatctcttcttttgtaatcagtttctttatttcaattttaggctcattcgaatgaatagctatttgaaaatgagggagatttttcgttaattgttcaccataatcctctctgatatggatgataggataatcaaaaactattctaattattttttgtcgtggaatatttttgaggtaatcaatacaaggaagctcttgtatagatctggcagttattacatgagtggttctttccaaagcattaaatcaatgattaattcaaatttaaataaaatttcacacttcaaaactttcaaaacccttaaatttgtggtcaataaaaattttacttggatgcttaggaacatttcaattgcggcagctactttattgtccgtagttacaatcaatgcgcagaagaacagaaacactcaactggaaagaccaaaattagtcgtagggctggtagtagaccagatgcgttgggactatctgtaccgtttttatggtaaatacggaaatgatggtttcaagagacttttgaatacaggatactctttaaataatgtacatattccttatgttcctaccattacagctttggggcatacatgtatctatacaggatctgtaccggctattcacgggattgcgggaaacgactggacagataaagaaacgggtaaaggagtttactgtactgcggatgagagcgttcagccggttggaactaccaatacaaaaacaggaagtcattctccgaaaaatctttggtctactacggtaactgacgaattgagactggctaccaacttccagggaaaagtagtgggtgtttctttgaaagaccgtgcctcgattcttcctgcaggtcacacgcctaatggtgccttctggtttgatgacagcacaggaaatttcattacaagtacatggtacatgaatgatcttcctcagtgggtaaaatcattcaatgctcagaatcttccggaaaaattagtggcaaatggctggaataccttacttccaataaatgaatatacggaaagtgcacctgacaattcgccttgggaaggtctgttgggaagtgccaaaacgcctactttcccttacagcaacttagcaaaagattatcaggctaaaaaagataatatccgttatacacctttcggaaatacgcttacattgaaattggctgaagcttccgtagaaggcgaaaaattgggtggagataatattacagacttcttagccatcaaccttgcatctacagactatgcaggacataaattcggaccgaattctattgaggtagaagatgtttatatcagattagaccaagatctggcagaattcttcaaatatcttgattccaaagtaggaaaaggagagtacacggtgttcctttctgctgaccatggaggcgcgcactctgtagggttccttaaagagcataaaatcccgacaggtttcttcggagaatatgcagaaaagaatctgaaccagaagctgaaggaaaaattcggagctgataaactgatcaacgccatcgataactaccagatttattttgacagaaaagtattggcagacagcaagcttgaactggatgatgtaagaaactttgcagtgaaagaaattgagaaagatccgacggttttatatgctgtttccgtagataaagtgcaggaatccagcattccggaaccaatcaaacagagaattatcaatggaatcaacagacagagaagcggagacatccagctgatctctcacgattctatgcttcctccatattcaaaaacaggaactacacacagtgtatggaattcttacgattcacatattccattgatcttcatgggatggggagtgaagcagggagaaagcaataaagaatatcacatgactgatattgctcctacagtatcttctttactgaaaatccagttcccaagtggaaatgtaggaaaccctattactgaagttatgggtaaataaagttgaaaattatatgagtcgtcctaaaataggttgacataaattaaacaatatttaatccggagagatattttatttcttcggattttttatgcactttatctggagtttgcatattaaggcttagatgtggtcttttagtattataaagataaatactttcttttactaatgagtttacccca

SEQ ID NO: 13 - DNA, 38383 bp, Chryseobacterium sp.
ctacttgagaaactattcttaatttaaaggctatactgtagtctttttgtgtgcgcttttctctttttaatacttgatctttcataaataagtcgattagttgtcaacttatttcaggacgagacaatataaaataaaaagccgtttcaacgctggaacggcttttattttggttatgatgctcttatcatttgctgaatttctttctgaaattttttattttgtcttcgtacctttacaatgaaatacaggagtacagccattataaagcttcccaatgcaacagaacctattatgatggaattatgataagatttcagcttttcgctttctaaataggtttctctattatgattatcaataatctgattaatggatttcagttcgttctgctttctcctgaaacgcatttccaggtattttttgttatactgctgatagagattctgttctcccagagcaagataattatcagctaactctttgtagatgccttcgttcaaaataatatctccagtatttttacacaggttttctgcttttagcaaaagattgattgctgattgattttcatgtttttgcctgtagatttcagcaattcctttcaaggcaaatgcttccagacttttagcatgatttttccgggcatagtccagagactgaacaaaagcttcctgtgctttatcaatttgattaagattaagatagcagtatccgatgttatagtataccacactcatattagcgtaggtggttttcccggaagatactttttcaaaattctgtatcgaaattagaaacttttccagggcaatttctgaattagactgactcttgtaaatcattccctttatagcataacttcttgcagtttcaatatatttgaaaggagttttttccggtattctggccagatactgattggcttcgttcaatgtttctaaactcttattgaatagttccatctgctgatattgaatggcaacagaaataagaacacttgcctggcttttgaaatcgttggttttctgcgagagttccttagcttttaaaatatactttaaagattcctcgaagtttcttttggcaatattcgctgtggaaagcagcatataaatatcaatggatgtaatgatatccggatttttccttaataattgttctccggttttaatggtataatcggggttgtcataaatttcaagccgggcttttcttattaattcacgatccggtattttctgagctttcataccgatacaaaaagacagaaggattgaggttgttattttaaaaaagagtttcatacagttttacttttactgatttcctgaatatatgtattaggagacatcccggtaacagacttaaagaccgtggtaaaggcactgtgtgatgaaaaccctgaatactctgcaagatagctcactttataattgagaaaagtagaatcattctttaataattgtacaatatgattgattcttagtttattgatatagccgttaaaatttttctccttgttattaataacttctgaaaggtatttcgtgttaacctccatttgagaggaaagcatggataacgacatatttttattcaggtaatgaccggatttttcgaattcttcaagtttgcgaagaatctcatcttctttttcccttgatattttggtagaaccggaatcttttgctgttgaagtagccttctctggaatggcagattgagacttgcgactgatctgtttttcaaagaaatcaaattgtttttttaagtctttacctttacttttaatacttaaaaaataagcgaatagtccccaaattaccaaagacaaaatgagcgctaacggccagaaggatttaacaaatatcagtttttgaaattcaatatttttattctgactggtttccacaagttttacaagataccgtattccttccctagaactggcatctgtttttgtctttagatcattgcagagtttattgtaccggtgatactttgtatcatcatgaagtgcataatagctgcgggataatgactcatagattttaatttttaaattattgaaaggcagatcttcaatcagtgaaagtccggcttccagcttttcaacagatgctctgtaatcctgcttcagaaaataatattgagaaaggttttcataggcaagacctaatagaaatggctggtttttctgatgctcaagatcatcaataatactttttataagaggttgatattcgataagtttattttgtttcagcagataggaagaacggaaaatcctgttttccagttttaatattttattttcttcattctgaccgctgaggtattgattgcttttgtcaagattttgcagcgctgtgggataatcccggttgatctctgagttcaaagcctgaagctgatacagttttgcggtagtaactcttagagccgcatcgttacttttaagaagtttctgatcagacaggagataactgataattctcttagactgattgtataaacccagattctgatactgatcagcaaggttataatcaccgaagatctgcataaaataagatagattattgtgcagttcaggatcttctttttgagcaaaaatatttacagattgtacatagtcacctttcatagcaaaagcctgggaaataatattctgaaggatcattttgtgttctgtattctgatcgctgacaagaattccctgagtatagctgatgcattcatcagaattctgatagagtttcagaaatgccttatctgccaggatagtaaagtcaggaccggattgtgcattggtgataagggaaaagaaaatgaaaataacaaggagaatttctttgctatgatcaaataatttttgaatgaatactgggttgtttgtgtttttttgaataattcgggtaaaatccatattcaaaataatattttattatctgattgattattaatattttaaaaattatattcttttgaaattcacgaattatgaaagtcaatttctttgggtgtggtaaatattatattaatattgttttcaccaattaaaaaatctaaatataataaaatatgaaaaatttttacaaaatgtcaatgaaaatattaacagcttgcctttttctgaaattgggtattgtgaaagctcagcttactgtaataagtctgggaaattataatgtaggagctgtttcagataatggagtggtaagcttgcatacaagtgcaggagctatatataaatggaatgcatcgggaggacttgtacagataggttcaatatcaaacggatatcctgctgcgggcagaaccatagtgtcgaatgacgggaccaagatctcatcttccgttacaaatgctgcaacaggtttcaatgaaatctcgacttatgatgtagctacggcaacatgggtaaacaggggagggctggttcctaccggctgggatggcagtgtgagttctacctgggggatgacagctaatggcaatacaattgtgggactgggattccttacggcagctaacgcacatgctgtgaaatgggatgaagtaaacggaatggtagatctgggaagtattgttcagggacgaagctccagggcaaacgccatcaatgcttcaggaacggtaattgtaggatggcaggacgaatcaaacggtaccagaagtggtgcgaaatggcaggatggagtggaaagctttattacagataacaatggaaataatgtcggagaagcgggaggtatttccgcagacggaagtacgatcatcggttcagccaatcctaatccctatgtttggaatgcagtaagcggacttacttatattacgcatcctaatgcatcattcagtttcaagggaggagcaacaggaatttcagcggatggaactaaagttattggatattacagagcattcggagcacctccaatgtctggcgagggttttatatggacctctgtcaccggaagagttaatctgaatgattatgcggtatccttaggaattgccaccaatggagtaacgatgggacttcctctggctatttctcaggatgggaagaaaattgccggaatgggtgtgaatgcttccaatcaaatggtagctttttatctggatacatctgaatatttatctgtgactgatgtggtgaaagaaaaaaacagcatgggtatttatcctaacccggttactgatattctatattttaaagggacaggaaaaatagagaaggcagaaatttataatttggttggacaaagagtgaaatcattcaatactgtagacggacaaattgatgtctcatccttgtcaaaaggagcttacattctggaatattcagtgaagggagaaaagcaacaggcttataaatttatcaaaaaataacatatataaatagtaaagtagtgggatgaatggctgttttcaatattgaaaacggctgttcttttttgtttacatacccaaaagataacatttttaaggcgaagcacggttttttggtgaatacacataaaaaactatctttgcaaaaattttggtttccagcattttggaatgaaaagggaatcgggtgtaactcccggactgtccccgcaactgtaaatcgcaacacaagtttctgcaaaaagccactgtttaacaacgggaaggggcagaatgcgaaagtcaggagacctgccaggattataacaaaaaacatattgctttcggaggaaaagtaaaaaggtatggatataaaaagatctttagtactgcttttttcatcttatggttgttttctttttggacaagagaaaaccattgacactatttatatcttcgacaatcagatgaacagggtgaagctttttcatcccgtaaaaataatttcagcagaggatgctgagaagaactccagcaacctttcggaacttctgagatttcaatcacaggtatttattaaggaaaatggccgaggcgctgtttcttcaccttctttcaggggaactaccgcccagcagactgcatttgtatggaacggaattaatatcaattccaattttctggggcagggagatatcaataatatcgcattgttcgggtatgatcaaatcggaataaaagctggtggaggaagtgttgtatatggaagcggagccattgggggaagcattcacctgaataatacccttgattttaataaaggctttcatggatctctgttttctgaagcggcttcctttaatacttataataattttataaaaggttcttacagcaatgataagttcagttttaaagcttcaggaaattattctgtaagtgaaaatgattataaggtaagtgaccttaactacatcaacagaaacgggaattattacaatacaacgttcaatgtaggcgcatcctataaaattacgaacgatcataaaatttcatggcagagccagttttttgattcttcacaacattatcctgtgtatgaggaaacaggaacaaaaactaaatataaaacgcagagcgtaaggagcctcctttcctgggactggaacaaagcaaagttcagcaactccttaaaagccgcttatacagaagaaaatttccagtacttcggttcgttgacccaacctaaatccagcagtggaacagggaaaaattatatctttaaaaatgattttaattatttcctgaattcaaaatggaattttaatctaataggagaatttcaggtcaataaaggagaaggatataagaacgggatatccaatgtcagcagaaatataggatctgtttcaggattattacgatattttgcaacgaaagatctgcgttttgaaggtggatttaaaaaagattttgtggaagatgtaaaatcaccattaatgtattctttctccggaaaatggagcgctgcaaaatggtatgatgtgagcattaacgtctccaaaaacttcagatatccgtcatttaatgatatttactatgagccgggtggaaataaagacctgagaccggaaacctcaactcaggtagatatgactaatgagttcaaagtaggagatttcaggcttagcttttctccttattatatgaatattacagaccttattgtatggctgccaactgctaaagggtactggcaggcttttaatgttaataaagcagaatcttacgggctggaatctcagctgtcattcagcaagcagttgggaaatcataaaatccgggcgaatgcagggtattattatgcaaaatctattgataaagaaaccaacatgcagagaccttacgttcctatacacagaggaaacattaatgtggattatgaatatggtttctttaaattttttacccaggcactgctgaacggggttacctacaccacaagtgatgaaaaaagatcagaagctatagatccttattttcttttaaatatgggtgtttctgcaactctggcaaaaaaatatactttaggatttaaagtgaataatctaaccaatacatactataaaaccgtttctttctatcctttaccgaaaagaaactatagtgtgtatgcagcaataaatttttaataattaaaattgaataaattatgaaaataactaaacttttaactgtcttatttgcagtggtactattgtttaatatttcttcatgtacaagtgactctgccgagtttgacgtttccccgatcacttaccagaacggatattttatctctaatgaagggaattttaacagccagggagctaaagtaacttttgtgacgagagatttaagccttaagcaggatgatgtatatggttataacaacaataaagagatcctgggtgatgttcttcagacgattggccttaacgggaataaagcttatcttgttttgaataactcaaacaaaattgttgtagtagaccgttatacatttaagaaattgggagtaatcacacaacagcttgataatccgagaggaattgctttcgctaatgattttatctatgttgctaacactaatttcagtgcaaatactcaaagtataacaaagtataaagcttctgattattcatttgtaagcaaaattaacatgactgaagtttctgataaaacggtagaagcgggaggaaatattttcgtacagaatgcttcatcggggtatggaaacaagattacttatattaatacttccaacgacagcaaaactgaaattaccgttccgaatggtcagattggaaatactgtttcttacaaatccaatgtttatacaatttcttcaacagctacagattcttatatctataagatttcaggtaccggaacccttacaccggtaattacactgacaggaattccaagcgcaaccaaccttcagattgataatgataaattatatttcagctcagccaataaggtgtacacaacaagtttaactgctccgacagttccttccagtccattattaacagctgcagatggtggtccttattttacattgtatggatttaatgttattgacggaagaatttttgcttcagacgtaaagcagtttacacaagaaagcgaaatggttatatactcagcagctacaggaagtaagattgttactgtaaaaacaggaggtatcggtgctaacggaacttttgtaaacccataataatttattacttcgaaaaataattttttattttttcatcatttgtgtttttttccggccggtttcttcgaaaccggccggctttgttttcacagtaagcaaaaaaatccggcgggatggaacatcacgccggattttttatattttataacttggagttatattgtcaatcccagtttttcagcttcagctatcacaaactttgtagcttcttccttttcattgggtatttcaccctccaggatagcttcctttactttttcctttaaaataccgatttcacggcccggtttaagattgaacatttccataatctcttcaccggtaataggcggctggaagtttcttacctgatccttttcttccacctccttgatttttaccgccacatattcaaagttttttttgaacttctcctgtttcctgcagtttttcgtggtaatatctgccttgcaaagggtgaaaagatcttccagattttctccggcatcaaacaaaagtcttcttaaagcagaatctgaagcatcatcagtaatcagagcaataggtcttgacgaaagctttaccattttctgaacatatttcatgtcacttcccaacggcagttttagtctttggaaaagtgttttaaccatttttgagcccaaaaactcatgtccatggaacgtccatcctgttccttctacaaattttttggttggagcttttccaatatcatgaagcagggcagcccaacgcagccaaaggttatctgtattcacagaaatattgtcaacgacctccaaagtgtggtaaaagttatccttatgtgtttgtccttccacttcttccacacccttcagttcaatcagttcaggaataaccagctttaaaagaccagtttgttccattagtctaagaccaacagaaggcttttcagaaagcatgatcttgttaaactctaccatgattctttccatagaaacaatcctgattctttcagcttcctgctggatagctttcagagagttttcctcaattttaaaatgtaaagtagaagcaaaacgtaccgctctcatcatccttaaaggatcatcagaataagtctgcgcaggttccagcggagtccttaaaattcctttttcaagatcatcaattccattaaaaggatcgatcagttctccgaaattcgttttatttaaagagatagccatcgcattgatcgtaaaatctcttctcttctggtcatcttccagactgccgccctccacttcaggcttgcggctgttttctgtatagctttcctttctggctcctacaaattcaagctcaagctctttatatttgatcatggctgttccgtaggtcttgaatacggaaacctttaatttcggatctatgtcctgagctacattttgggcaagctcaataccgctttgttccgttacaaaatctatatccgtagaagcttttctgttcatcagaaggtcacgtacataaccgcctacaatgtatacggactggtgattcctttctgctgcttcagaaatgattttaaaaagttttaaattcttattttgattaagattaattttcattgttaataacagtgtcaatttctaccgatgttacccatcaatcataatgagcatacattctactaatttttccatcttcattaaaaaacatgacttccacagcatgtttatccataatcgacttataaaataatgctaccgaatctactcccgccgtggaatggatcagatcaaaatgaaggtccggaaatttatccagtgcctttctccaatattcacggacagcttcttttccttttaatgaactttctcttccacctgtagccatagcaatcataggagtggtgatctcaatatcatccgcgtaatgggacagaatatcctctaaattatgagaattccagacattgacccacgtttgagcaaatttttgatgatccatagcaaatagtttatgagttgagtttgcaaagatagaattaaaaaaaagaaatcctgccaagatgaactgacaagactctaaaaataaacaggtaattctatattgattactctctcagaacttttatcctgttgtcattccatattttgattaccgaagaacctgaatattttgaaactttttctctgtcttcttctacagcataatctacaaggtctatcatttcctgggaaatatcagaaaatttcaagggacttttttcaccactgaaattggctgaagtagataccagaggtctgtttaattttgtaatcagttttttgcagaaatcattttttacaagacggattccgatacttccgtcttcagcaagaagctctttaggtaaacctctcgggttttcataaacaatagttaccggcttttcgctgagatcaataatttcccaggccatttcaggaacatctaccagatcctgaagtcttttctcagactccacaaggatgatcatggatttattcttttcacgctttttgatttcaaaaattttattgacagcttctatattggtcgcatcacaaccaattccccagatggtatctgtagggtaaagaatcgttccgccggattttaatatttcgataatatgctccataattgtatatgagttcaaagagtggctaaaggtaaaaaatctgtaaattttggacaaaaaaatagggtgtaaatatagtttgtcagtttgattattatgacaagacggaaaaattataatccatgaaaaaatgaattaaaataagttatgcgcttaataggttcaatataatcaggatgtagtatttttttgaaatcttttttggtaagatgttgtgaaatcaagacaggaaaatttgatcttgaaccttctttaattaaagtataaagaatagcgttgcttttaaaaaatacaatggttgtctgttcataatctttacctaaactgtagagatctgtcggttcattaaggaaaatcagattcccggaaatctttgaaattctgtaatgatatttttttccatattcgatgattctgcttttagcttcttctttaggaatttcaaacttaatttctttcaaatgtttttcggtgtatttacaatacagtacatatatgctaaaggtgaataaacttataagaattgcacactcgaagctgttactaagagaaaaatctactttttttaataacaggagagaagctattgccaatgctgaaaatccaaaatagatcgaaattgtatcaaacttatcgtatgaactttcttcataaactaatttttcagtttgaatactttcagtaatttttaaattttttagagatctcatgggacatcagtatgagagtttatgattcttaaatttagattttatgaataaatataatgagccaattattaaaaatgtaatagaggctatccacaaaaaataacctttttccaagctgtatattcttcccattcttccattttctgcagccagaatttccttccagaaaaaaaatgttcctgcaattaaaaaagctattgcagccaatatcatagaaattaaaaaatattttttataacagaatatcactgcaataaagaaccaaatattagctgtccataccagaaattcaaatagacccccgcctaaaaagctaatcggacctataagaaaagtttcaaatgatttataatctttaatctctcccatatctcaactttaaaagctgtaaaacaaaaagaaattatgaaaattaacaggctggcaaggggaattcgttttcttacatccatcccaatttcgataaatacctttcctcaataatactcaggtgatgataattgtgtcccacgatcagttttccgatggtttctacagaaatttcatggccattagctatacctgtgttttgcagagcagaaggttgaagtgtttccagtagaatctgtgaagactttcttaccagcttgtattcttctaaaagagattccaggcttctttcgtctgcaaaagattgatcagcgtattgattttcatcaaatcccggcagattgttttttttctcctctggcaaatgctaatatcctgtattggaaaactctttcggtatccgataaatggagcagaagaccttttaatgtccattttccttctgcataagcgaaggtggattgttcttcagtaaggttggaataaattccgatagttttgtctgctgatatctgcagttcgtttaaccaatctcctgatggaatctgatctaaatatctttggatgtacttttgaaattcggtcatattatttttgtttttagtagtaatttagggatacgagttttcgagactcggggtttgttagtgcgtataaatatgaaaattatttattgctcattactcattactcattactcattactcattactcattactcatgattcgtccattcatagaaattcacggaatcataaagctcaaagccgcaggctggatacaattggtttccgatatcattgctttttcctgtttccagaaggataccacaggcttttgaagagcggcataattctttagatgcttcaatcaattctttggaatagcctttacctctgtgtttttcatttatgtagaggtcattcagcaaccagtagcgctgcatccttgtagatgaaaatataggatatagctgtacaaaacctgtcagtttatcattttcttccgcaacaaaaatttctgaatcttttctttcaagcctttcctgaagaaagtttgcagctgcaggaatatcagaggatttatgataaaatatcctgtactgatcaaataattctgcgagttgtggtaagtcagaaacaactgctttccttgagtttttcataatatcagttggtgttataataaatgagaaggattattaaaacccttctcatttaatgtattgtatgttaagaaaaagctttctcaagatctgcaataagatcttctgcatcttcaatacctacgcttaaacgaacaaggtcgtcagtgattcccaattcagcacgtttctctgcagggattgaagcgtgggtcattaaggcgggatgattagctaaagattctactcctcctaaagattccgcaagggtaaatactcttactttttctaagaatttaatagcatcttccttcttcccggatttgaaagtgaatgaaaccattccccctgattccttcatctgagattttgccagctcatattgagggtgagactccaatcccggataaattactttatcaactgccggatgtgtctcaaggtattttgccacagcaagaccgttgtcagaatgtctttgcattctcaaggccagcgttttaattcctctcaatacaaggtaagaatcatgagggcctaaaatcccaccgcttgcaaactgaataaaatgaagtttttcccccaattcagcatctttggcaataagagctccggcaataacatcagaatgacctcctaaatatttggttgcagagtgcatcacgatatcagcaccaagatcaatcggtctctggatataaggtgttgcgaaagtattgtctacagccactaaaatatcttttccttttgctatgtctactactgctttgatgtctaccagtttcatcaacgggttggttggggtttctacccagatcagttttgttttatctgtaatgacatcagctattttagaaacatcatcaaaattcacgaacgtaaatttcagctgatatttttcaaaaagtcttgtgaacattctgtaagttcctccgtaaaggtcatctacagcaatcacttcatcccctgggtttaataattttaaaacacagtcgatggccgcaagacccgaaccgaaagctagacctctcgctccgttttcaatacttgccagagagtcttccaatgcctgtcttgtagggttggcagctctcgaatattcatatccggaatgtactcccgggcttttctgtgcaaatgtagaggtcaaaaatacaggtacatttacagaacccgttgcagactcatggtgctgccctccgtgaattacttttgtattaaaattcataattttttgctttagacttgagcatcaaacaataaagtatattgcttaagcggattgttttattaaaatttgctctagctgaatacaaaaagcttaccgcttactgtctgcagcttgctgcaattatatttttttacttaatagcggatttcacagcaaactcttctgcaatttcttccatccactgtgctacatcctcttcgccggttgctctctgataggtgtttcctaaagatattaaaatctggtggataaacatcttcatttggtctacaggcatttctttggtccaaagatcaattcttagcgcttctcttgtcttgtcatcccatacagaaatcatggttgctttggtatcctgtttttcaataccgccatcctgggcattccatgtaatattttccgggacatgattttcatcaagctctacatctatcgtaatctgagtctttctcattttttctattttttctgaattctaaattttctttatttaagtttcggtttataaccggattgattaaaaattgtggtggcatccattttcagaaaatccgtcagctttgtttcaggcttttctttaaggtatgctttgcagatctgccatcctgtaaaaattccgatctgtggtgaagattcgttatcaatttccgtataaaatttcgagaaaggtcctggtgagatgaaacgttctccaagtctcggatcatctccgaaaatcaggttgctttctacaaaatagttccagatgttggcttcattgctggttgcccattcatactgctttttggtataatttattttcagataatcaggaacgtcaggaagaaaagcatcctggagaatcattactttcccgttcagaaccatctgatctatgaacttctgatgatcaggagattccgttacaatcttttctgcaaaaagctgtgatacttttggaaccatattctgtgggttcattgatttttgaaaatacagttccagccctttataattaggatttccatcacccataaaaccggtgacatctataaataaaaggtttcctttctcgtcataaaatatcggatcctgaaccatctgtaaggcagatgaaaataaatatactttcggatttttaaacttcgggaagtaatatttaatatgtgaaaacaagctctgaagttccttttgaagatttgcctggtttatttttccgattgcttccttgtagatttttatctcttcagcatcagctcttcttttttcaaaatcagcatcagaaacagttccctgaaaccatggaaatttcgacttaaactgatccaaaggaacatccggattataaaattctttggaaatatctgtgatgtcaactttttcagctgtttcttttacttcaaccttccattgattttcaggttcttttttgcaggaaataagtccggcagctaaaacagaagaaagcgcaatatatctaaaaatcttcattatttttacatggaatttaagtttacaaaaataaggattaaatacacaattcatgatgaaaattaaaatatttacagccctgtaccttattttcatgatatcttttttctatgggcaaaagcttgaacttaaagataaaaactttgaaaaagcagtactcggaaattttgatctgaataaaaacggatcactggaagtttccgaagctgagatggttatgaatctgtttctgactcagaaaggaattacctcggcagaagatcttcccctttttaaaaatgtgaaaatggttgttctggatgataatataattcctgatattacaatccgtaaactggatcagctggagctgttctcctgtacaggatgtaaaatttcttcattcaaagcagaaaacctgaaaaatttaaggtcattatatctcgataataatttgttggaaagtatttcgctgatggagattccgaaaattgaccaattaaccttatctttaaatcagttaaaaacaattgatgtgacccggcttaaagtattaaggaaacttaatctggaacataacaagcttcaaaaaattgatattacaggaaatgaggtcttgcaaacgctgaatataaccgggaatacaataaatgaagccgacataaagaaaggtataaaaacagatgttaccatatttagagacggagaataaaactaatcattatgaaaatagaaacggatcgattgattttaaggaagctggaagatgaagattttgaacgcttatttcttatggattccaatcctgaagtcatgaagtatattggtgtgccggttttaacggatatcaatgaatcaaaaaagatcatcagtatgattcagaaacagtatgatgagaatggagtaggaagattgggagttgtggaaaaagaaagcggacttttaataggatggagcggattgaaactgcttacccatgaaaccaatggttataaaaatgtgctggaactgggttatcgctttcttcctgaatcgtggggaaaaggctatgccatggaatctggaaaagcttctcttgattatggttttaatgggctgaatgccgatgttatttatgcctatgcacattctgaacacgatgcttctaatcatattttaagaaaattaggctttgaaaaaaccgacgagtttgaggaaccggatggaatttgtttctggtacgaactgaagcgcgaaaaatacggtgaaaaatgataataataagacaggaagaaaaaaaagacaatcaacaggtttttcaactgacagaagaggctttcagagaaatggaacatagtgatcatcaggagcagtttctggtagaaaagctgagaaaatcagaagcctttatcccggaattatcattagtggcagaagatgaaaacgataaaattgccggacatattctgttcacaaaaataaaaattgtcaataattcaaaatcttttgattcacttgctctggctcctgtttcagtgaggccggaatttcagaatcgggggcttggaggaaaactgattctggaaggacaccgtattgccaaagaattgggatatgaatctgtaatccttatcgggcatgaaaattattatccgcgttttggttacaaaaaaacaagtaattttggcatttcttttccattcgatattccggaagaaaacgggatggctgtagaattggtaaaagacggattaaaaaataaaacaggagtggtgaaatacccgcaggaatttggaatagactaaaaaaatataaacaatgcaaacacaaaaagtaatagatcatattgtaagctggttaaaggattatgctacaaatgctaaagtaaacggatatgtaatcggggtttccggaggagtggactcaggagttgtttctactttggcagcaatgacaggtatgaaaacattactgatcggaatgccgatccgtcagaaagctgatcaggtagatcgtgcacagaaccacatgaatgaccttaaatccagatttcccaatgtagaaataatatctgtagatctgaccccagcgtttgaagaaatctataaaacttttcatgtaaataatgaggtgtatcccaatgagaatctgacttttgcgaacacaagggcacgtctcagaatgcttacactttattactacgggcagctgaacggacttcttgtttgtggaacaggaaataaagtagaagacttcggaattggtttttatacaaaatacggagacgggggagtagatgtttctccgattgctgatctttataaaactgaagtatatgaactggccaaggggttaaatcttatcaaaagtattcaggaagctattcctacagatgggctttgggacacggaaagaacagatgagcagcagattggcgcgagttatccggaactggaaaaaatccagaaagaatacggaacgaaaacggctgacgattacgaaggaagagacaaagaagttttcgagattttcgacagaatgcacaaggctgcgaaacataaaatggatcctattccggtttgcgatattcctgaggagtggagagcatagaaatagtatcatattaaataacagctatgaacggaaaaataagatcggttttttttatatgtctgggacttcttttcggaatgtccgtgatgtatgtctacaggaactttattgaagataaaaaagttcagtcagattctgtaaaaaaagaaacggtgaattatgaaagtacttcttccaatggaaattcatcttctcaggtttctattgatcagcttactgaagaaaaaacggtgatcagctatgtgaaacaaaatcacaggcttccggactattatatcactaaaaatgaagccagaaaacagggctggaatccttccaaaggaaatctttgcgatgtgcttcccggaaaagccattggcggggataaattcggaaacagggaagggcgtctgccggatggggaaaagtactttgaagcagatgtaaattaccattgcggcggaagaaatgcagaccgtatcatctatacccggaatggtgatgtgtaccttaccaagaaccattataaaagttttgaaaaacagtaatgcgtaaatagcatcaggtcattgcttcgtcgctaagcttctcgcaatgactagtgcataatttgtatttaaggggtgataagtcgtaattttgaaaaataaagtattgtatgagcagttcctgaaaattctgcaaaaaaatgcaaaacttttttaatcaataaaattggaaatttagttcaatatgaagacagtatatatagattttacagacataggtgattatgaagatttttacagccagctcaaggaaaaaattcagcttcctgaacattttggagataatcttgatgcactttttgataccatcaccgggagtctggaaatgccgctccatttagaattcgtcaacatgactgtagatcagcttgagatttttgaagacctgctgactactctggaagatgctgaagaagaagtggaagattttagtttcagctattatctggagcaatatgaagacgaagatgatgatgtagaatctgaagaataataaagtaagaaaggctgttccaatacaggagacagccttttttctatatttattctttgacttataaacctaacaggttttgaaaacctgttaggtttcttattttatttcactgtaacgtttattcaggactagccgatgtgaactttttgcttcacagcctgtcagagtttcaaacctggcaggaactaaaaatcaggtttcacctggttacaaaaacgtagaatcaaaataaaaaggaagcagatctttcactgcatgcacttttacaacctcttcattcatgcttgaaaaataaaggtcaatattttcattctgcttggtttcgtactcaattaagctctggcggcatgctccacacggaggaataggaggatttttttcatgaaattctttcggacctcccactacaaaaatcttttttattttcacattcggaaagttggcagctacccagaatagagtggttctttctgcgcaaagtccggaaggataagctgcattttcctggttgtttccagagtagatttctccgttttccagtaatacggagcatcctaccaaaaactgggagtaaggtgcgtaagcattttcacgggcttccttggctctttcaaataatttattttctatatcactcagttcactgctatttttaaaatattcgtaactgatctctatgtcttttttcatatattgtcaactaaaaaaggggggtaaaattagttctttttaatgaagtgggcaatattttattcttcccgtaaaaagttcaatttttttaatattaaaaaatgttatatactccaataaaattcagaaatgttgagttgaaaaacagatgggtaatgtcacctatgtgtatgtattcatgtgaaaacggagaggctaatgacttccattttgtacattatggaagcaggtcacagggcggtacaggtctgctgattgttgaagcaacaggagtggagcccaaaggtagaattaccaatcactgcatgggtatatggaatgatgaacaggcagaaaagctgcagagaatcgtagaatttgttcataaaaattcagaaagtaaaataggaatacagctggctcatgccggaagaaaaggttcaacatggaataacatacagatttccatagaagaaggctgggaaaccgttgcgccaagtcctattccttatcacccgaccgaaagaattccgcatgcactcactaaagaagagatcaaaaagcaggttcagcattttaaaaaagcagcaggaagagctgtaaaagccggttttgatgttattgaaattcatggggcacacggatatctgatccatcagtttttatcgccgctttccaatatcagaacagatgaatacggaggaacttttgagaacaggatccggtttctgattgaaattgtagatgctgttaatgaagaattaaatgaaaatacagccctgtttgtaagaatttcaggaacagaatatgctgaaaacggctgggatatccagagcagtgtggagctggcaagaattttaaaagaacacgctgtagaccttgttgatgtatccagtggcggaaatatccatggggcaaaaattcctgtttttgacggctatcaggttcctttttcatcacaggtgagaaatgaagcaggagtgaacaccggagcagtaggtttaattaccagaatagaacaggcagaagaaatccttaagaaaggagatgctgatctgatctttgtggcaagagaaattctgaggaatccttatattgctgttcagggatcttttgaaatgaaggaagactgtttcttccctcatcagtacaccagagccaaaatctcttcttagttcccggataactttcaaagcaacagcaatggatattgacgatttcatgtttacctgtcccagtaaaaaattcctgggagtagaatgcctgggatgcggtgcacagagagcaatcgtattggtatttgaagggaaattcgctgaagcttttcaaatgtatcctgctgtatataccttattgttgttttttcttacgctgggtttgagtttcatcgataaaaaaagaaaatacagtaatattttaatgattttggtaggtgttaatcttattattatgatcattggctacctatataaacattattaattaaaaaagagaataatgtaagtgtttgattttaaaagggaaatatagagcttgtctgattttgtattttgagttaaagcgaattatttagaaaaatttcaacaaaaaataaaattcattagattaaaattcttgctttgttttattgtgctgaattttagaaatgtcgtagaactactacaatttatgaatcagtgcctcaaaaactttttaaattagaacatgaagtctatctttgttacataaatcctatatcagggatcagtcgttaatgattaaaatttaagaatatggcaggaaattcaagaggaatcttaaaattcaatggaggtgaaggtcagaagttattaaagcttaactatagcgtatcaagatctacagacgtttcaggacgtgtggcatctgacccgtcaaacgcattgatcaaagtaacaattgaagcaacagagaaatctgatgttttagagagtttattaaacagcaaatataaacctacaagcggagaaatcaactttaacaaatctcacgaagaaggaacattgatctctttgaagtgggaaaacggatatgttattcagcatgaagtagattttgatgctattgacagcaacaatatgctgatcagctttgtagtaagtgctgaaagtatcacctatggaaattcatcttatgatgggctttggccaatgagctaagtctttcatgagccgtaaataaaagactgtccgtaataagacggtctttttttaccttagactatattctgcgggatttttgtttatatttttaaactcccgttctgccggataatcgtttagaaaattaatcaaatcactaaaaaatatgtcaaatacacctggaaactcacaagcggcgtcttttcgtccgacgcagaatgcagatggtatttccgaaaaccatcatacaggtatcaatcgtttggtgaaactttcccttgttatagaagggaaaattatcaagtactataaacatttcaagcttaaacaaagtaccagaaaacaccatgaattcacactgacactggcgcatgatacactgggagacagacaaacccactcattggaagaagctaataaatttcttggaaaaagacttacagcggttatttcctataaagatatagacaacagcccggaaagaacttttgtaggggtgattacgggagtaggattcagccaggaaaaaatgagcctgggaaatattgtgcttacaggatacagtcctaccatcctgcttgatggtgctcctcatattcagagctttggaggttcacagcctgttaatatcggaattattgcagacgaagtaatcaaacaggggattgataaaagccgttttgatatcagggttgatgccaataacttttctcagatcatctacagcagccagtatgatgaaactcactataactatctggcgagaatggctgaagcgtatggtgaacagttctactatgacggagaagttttacatttcggaaagttgccggctcagaataaacctattacccttacatatggaagcagcgccaatgatattaaagttgaactgaaagctgtacacaccaaacctcaattctatgggtataacagcaataaaaacgaaaagctgacttcaggatcaacgcccatcaaacacgtaagtgaccttgcaaaaacagcatacagccataacgaaactatctataaaacgccggctttgcaagtggctcctattaaagcaaccacacatcttgacgttgaatactctcagaaaagtgcttcaggaagtgaggcggtaaatgttttttccgtttcaggaaacacaaccgttccgtttcttcaccccggttgcgtagcagatgtgcagatgcgtaaacaggattctaatgaaacctcttatttcaccaggatcatgattacagaatcagagcacgagattgacacgataggtcattacaaaggaagttttgtgggaattgccgcagatacaggatttcttccaaagccggaatttaccattcccaaagctgagccacaaacggcaactgttatttccaatacagatccggaagggcagggaaggatacaggtaagatttgactggcagaccaatgataccactcattttatccgtatgatgagtccggatgcgggaggaacagatcagattacccaaaaccgtggctatgtcgctattccagaagtaggagatcaggtaatggttaattttgtacacagccatccggacagacctttcgttatgggaggaatgttccatggaggagttgccttgggaggaggtgttaataatcatttgaaatccattcaaaccagaagcgggatcagaattctgatgaatgatgaagaaggaagcgtaacgattctggatccaagcggaaatacctattatatggatggacaaggcaatatcagcatgaaagcacctaagaattttactttaaatgcaggtgataatatcaatatcacagcaggaaaagaaatttctataggggcaggagcaagcattaccagtaccgcgaatgacaacattgtttccatcgcaggaaaagatatgaaacttacggcttcgggagatattacagaaacttccgataccagaactgaaatgattgaaaaggaattcaagagacaatctgagacttccaatgaaatagcaggggaaatttccatgttcagcgagttggaaaatatgaccatgcaaagcggaaaaatcgtggaattcaacagtgctgaaaaatcaaaacttttctgatatggcaatcatcaaaacagcaaccaacctgcgcatcacagtaaaagattcttatcatctgagcgttggaaaaaaggttgaaaaaatagcaaagaaaatcaatgtggaggcacataaggagaatctggttttagcaagtaacaagaagattatgtcccatggccataagtaaatataacatactcattctttttattatatgctgtttctcattaacgaattgtcagaataaaaaaatggaagaaaaatacacatggctgggaaccgtttctgctccgcaggaatatcccatggaagtatatgaaggagcgattattgccgatgatttcacttatccctttgatgccatctggggaacacagaataccggctggggaaaagagggaggtaccatgaacgtgaccaccgaaagaatgaatgctcctcataagctggaattcacatggtattccttagtggaaaaaaaattctataccgggaaatgggacctggataaagaaaagatcaaaaaacttttggatgaagggtttgtagaccaggacaccaaaaagaaagctacttaccattcttttgtggtaggattggctccgaagggaagagtcgtattgtggatgaaaggtcccggaaaccagaaagaaataggtgctttccaggcacatgatactgtcattaccaaagaaaaagcatacgataatgcccagtacatgttgaaagaaggctttgcagatagaatgctgaaagacccgtcctacaaaacattcaagccggaagttcgtgagaaaattgaaaaagaaggatatcctgatgcagacatttataatgtgtacagagaaagatacaactggaaaccttccgtaattctcccggaaggagccacctggatcgatttcgggtttactagctataacggagaacaggaaaatctttttgatcagagtttaaaagataatacatacaaaagcagagctctaccaaaattctgcggtttttactggaaagataaaaacaacaacaggtatgcggtatggatagacgcttttgatgacaaagaaatatttgatttgtttcagaaaacaggaaaagataaaaacattgatctgaccattaaagtcaatgaagacaatacaaaggttttgatatccattgactctgaaaaagacaaacttccggtaacaaaagcaaaaataagagtatctcgaaagatagaagaataggtttcattcagtcaatttaaaaacaagaactatgcacaacaatcaatttggaagctatacaccaactgtatccaaagaggaggtactggatattaccattgggattttttttgacggaaccctgaacaataaaaccaatacagacgaaagaaaaaataacacggatgcccataaaaaacatggtgggaaatcatcagacaatacaagctacaataatgactggagtaatgtagcccgcatgtgggataactatgataaaaacttcggtatttatatagaaggtatcggtacacaggataaagaaggagatgctacactgggatatgcttttggaacaggggaaaccgggatcagatcaaaagtgagaaaaggctgcgaggaaatcgtaaaaaaggtgaaaaccattaaagcagaaaaaaaagctgataaaattgcagttcttacctttgatgtgttcggattcagccgtggagccgctgccgcacgtaactttgtatacgaaatcgggaaagcaaaatataaagccacttcacgcaccgtcgccaacgaagctgtttcggtgaccacctattcagatgatgacgggaaaagtgtggaggcagaagaacttccaaaatgggggcatctcggtcttaaactcgaagaagcaggattaaaagttgatgtgttgaaagtaagatttctggggatttacgataccgtttcttcctattcaaaatacctgtcaccaatgcccaatttcagtaacgatgttgaagaattaagcctgaatgacatcggaaaagcccagactgtggttcactttatcgccactgatgagcacagagaaaactttgatctcaccagagtacatatcggaactgaaaaaacattccccggtgtacactgcgacgttggaggagcctatgaaaacggacaggaaacgtgggaagaagttgaaacatcctggacaaccagttccaaattagaagcattaaaagcagaactcgtatcagaaggttggtatgaaaaagatatgctcaccattactcccggattctatttatcattgaggggaacccgttatctgctgaaaacttacagctatattcctctacattttatggctgagtacggcattgagaaaaatcttcctatcaccttgaaaaaaatgactgatgataaatactccattttgaatgatcagtttttaataggaataaaagaccgtctcagaacttatgtgatgggaaatggcaagccttatgccttcaaacattttaaagcgctgcgtgatgcttatggtggaaacgaagttccggaagaccgtcaggatgcttatcagaaagaagtaaaagaacagaacgatttgagattccttcgtcttcattaccttcactggtcagcaagaagagaaggaatcggtatggatccgagaccaaacagaacaagagttatccactagaatcaaattttaaaaagataccatacaaagaaagaaattgaagaaggaacatttttatgcagaaatataacatacataccgttcagaaagatgaaactttaaaaagtatagcctcactgtacggattggataaagacgcattaaaactcttccataacaaccattgcgctgttaaggacatgatcctgatcaaccttaacggacagaaagagctttttattccgagaactgcagttgcagataaaaaccttttggtaaaattcggaaaaggaaacagccttattcttcggccggaagcttcagtgcggagatacagtgtggtcattaccattgaaaaaggagaagataaaagcgaattaaaatatgaaacatctgttcgctggctgaaaacagaaaaaggaaatcatttttttgagatagacagaacatcaaacctttatctcaatgaagaagaggtgaatgaaattgccgatctgctggcttacagaacatctaaggttttatacccgttacagatcagtaccaatgaatatgggaaatttgaagccgtagaaaatgctgaggtgtttttaaaaagatggcccgctgtaaaagaagaactgtataaagaatttgaaggcgaaaccgtagacgaatattgcggaaagattgaaaaagtaatcagccggcctgaagccatagatctttacctgaaaaatgattacttcatccgtactttgttttttggaatataccaaagctatggtctggaatatagaactgagatgagaacaacctttcctgtagtagataatgctattgaacccggatatagaatcgcactggaaacagatccgctgaaaggagaaaccggcctgattactatagaaggatcaggaaagttatatgaagaaagagatattgatgactttataagaagatcgcccttttcattgattataaatgatgcacctgtaatgaatgaagaaggaacctttagactcataaactatatgaaagaagaaacttcacttccgaaatctctttacctggaatgcagtattatgctgcaggaagaaaaaaagatttcagtatcagtttcaggaattgatgaaaactaaattaccatttcactaaagataaaattaatatggcagaaaaacatattgtagtacagggagctctatgcaaatgccagttcggacaggttccggacaagctgaaagtacttacacaccaaaaagaatatgccaatgataaaagcgcttccaaaaaactgatcgttaccacgaaagaaattggagcagccacatttgaaaaaaatacattcggaaactgtaccaaaatgggtagcccgccgccgccttgcaagattatggttacagaatggcagaagttttatgataaagtacagctcagcaatggcggatatatcattgtggaagacagcaaggcagtatgtgccgttgccggtactccatgtattgagatcatagaccacgggcagcgggcggaagccagccagcaaaattttaaaaatgccgacaaagatgttcagcagcagattaatccgctggtggattccgaagaaatgtataatgcgcagccttcaggaggagggcaggatggtgcaatctaaatgataatacaatggcaaaaggtataaaaaaaataaaggttacaagtggattatattatcccaaaatgtctgtattaggacaaaggattaccataaaaccggaccagtgggtgtactttggcgttgaagagtggctgccgggcaccacagatgcagacaaaaagaaacctctgacctggatgagacaggacagcaacaggcaaaatattgtcaatcaggtaacctctgctaccgggtataaatttttaatagacaaacagtattgcggaagctatcacttttatattgaagccagcctttcaggagtcagagataaaaaaaataatacaggaatatttgtaagaggctggtgtgagcccaggattgtaagcagcaggtggtctatgcagaagaacagcaaaagcattaaaaacaataagaaagttgattatatttcctatggacataatgttcatctgaacctcatgacggaaggcctgaatggaaatatactcagtatcgagctttggaatcagcagaccgcaaaagcagacaaactggtatatacctacaataatgttcaggtcatagatggtgaagtcaatcttaagatagaaaacacctttgcctggatggcttatgtggacaacattcagaatgtagaggaattctatattaaagtaaaagatgtggcatccaaacagtacattaaagataagcttggtgatgatcttcatgccatctatctgaatgtaaaaaataaagtcgccactaccaacaccaacggagcccagaaccagacaccgactaaagtgtataagccggatgtcaattccgttagactcgaaccctgtaaatttgaagtcatcaagattactgaaaatgaaacaaaggacggcaaagccagcaacacaaccgttaaagtctttgataacgggaatggtgtcaaactgataaaatccgccgctttacaggaacatattcagagaactatctactataagtttgattctacagttattgataaagacggggaagacgtcctgaataatgtgctcaaatttcttcttgaacacaaagattccacaatgaatctcagtggctatgcctgcgttataggaaaagaaaattataacaaagggctttcgcaaagaagagctgatgttgtcaaaaaattctttgcagacggagggttagatccaagaagaattatctcagtaggaaaaggggaagtagatcctaccgatgataaaatgggaagagataatatcaaatacaaaaacgagaaagactacgaaaataaccgtagagtagatatttcatttatattcaatgcccatgatgcacagactatcagttatgaagtaaccgcaccaagtgtttctacaaagaaaaatctcgtcattgatattacaggttttcaaaccaatgaatgcttcagggacagtaaaggaaaacataaaaaacagaccctgatggtagacgtaggacaggcaatagataagggagacactgtgaaaacatttaatacacctacatttacatatggtgtatattccaacctttccagagttaacgcttttccagtggaatatatctggccttcagcatccaatccgaatcagtttcatttgcatgtgcatagctgccggtatttcagcaatgaaaaaagaactacagtactgatcaaggcttatccggatattaaatgggaacttgctcttgagtttttggtgaatgtatccaattataaagcagccaatatgccgcctggatctgtttatgcaaaacaccaggaaaaatccagacaggcaggatacaacagaatgaggatgaatgaaaccggaaaagttccgatttcaatagggctgggcatatctgccgaatgggatgcggggagagaaaagagaagttttaccaatgaatttgcagatagaatcaaactggtagccagaatgattgccactgcagtcaatattttacaaaatgcaatcaactatgcgcaaagtgcggcaaaagaaacagcaataccggttggtttcaatatcagatatccgaaatttacggttgtcggaaaatggtatctggaaagagtaaacgaaagaaatacacttagcgttattggtgaagtaggctttggatttaaacctttaattggagccgaagttgttattgatatattgggagcagccattgcggcggcttcgtatggagcaaccggaaacccggcagcggcaagaattattaataagtttcgtggaggattagaaaaattaggtgcttcagtaacctttacagcaacattttatggggagctggaaataatggtagatgccctgaagattgacagtatcaacgggatcaatatgcagggaaaaactaccattggaggaaaaatgggagccactattgaactcagtgtaagcgttgaggtaggaagagtaaaagggacaaaatcgaagcctattatgacatttaaagccgctgcaaaagcagattcttactttggtggagatattgtactggattctgattctaagggattattcatccagccgatcctgaaattttcaggagtagtactttcagtagaaatagaaggagaagtaggctggtggaaaagcaattttaaagtagaagaaaaagttataaaagaagaaactcattatttggaaaaaaaatatctaacttaaattgacttatgcataattttaaaaaaccattatattctgtatatccgagaatgtactgctcgggaaccatctacgtaaatgatgttcctgtgatagactggtacggagacgaaacaaaagaaggaggattcggaggagatacaatgatcaatcaggccttgcttcagagcggaaaatataaagtaaccgggaaaatgtatcctcgtttaggaaaaaatattttggatgaagatgatatgatgtccatcgatttcttctgtgcagagcttgataactggaaggcttcacgatttgcgtttcatcctaaaatagaatctccctgggatggtttgagtgacaatattaaatatcctcattttgaaataaaaggtgaaatagaagttgagctcccttttgtacttgatggatggcagaactcggtagatctgaaagacatcaaaaaagaagatcttttcagcgatgttttcaaatattatcaacagattagaacagcattgcaaagccacagtgccggaaagtatctggaaatgtcacaggataaaatgaagctgcaggaacaggctttatactatacagaagaacggaagaaaagttttttggaaagtgcaggccaattatttgcccagaatttagaggtggaagaacttcatgaaggagatctgcagctcgagatcatgggacatggaaaattagtaaggttgatgaaaaaagatggctcacaaccattacagtttaaaagtccggatattgaaaaacaaagcaatatagaaatggaggtgaaacttcatatgagaacaaaagaaaaaggtttcagtattatttaatcattgaaaatgacttttttaggatattttacagcagttcttgtcatattttcactctataaaggatatcaagttttcacgaagtttgcagccaaccgacagcagctaggaaaaaaaggaggccttctggagaaagtcttccttatttttatcatttcagtcattatgatttctgtcaatgcaatggcatttgtactttcatttacttttttttgggaaaaggcttacagaacatttgatgagccgcaatatgtagcaactgttgtggggtataaaaaagaaattacaaagtttaagaacttttcaacttccacctatagagacaaagtgattttctttccgaaagtagaatatactgatgcaaatggaaaaaaagtaataaaaacactggatattacaactgattacccacccgctatgggacagaaatcaaagataacagataaagtagggaaagatagtacaaacacacttcagctggattgggtaatgtttgctgcaggatgtatttttacaggatttgcagcatttttcgcgtcattaatttctacatacaccacatcatattccatgaaaaaaagaatgaccttgtccttcaggattgcattattgcttattttcattaatatttcctgtatagtattcatatatttgaaatcataaagaaacagaagtatagttaaacggattatagtaatcatcaaaatataaaataatatgaaaaaagtaagagttctgatattgatctttgtagtattgatcaatatctgttgtggaaataaatcatttgatttgtcaacggtttcattaggtgatgatgcaaagaagtatgattttgaaaacaaagatctgtttctgaaagatgcagctaagccagacatcattcaatattatgctgatgaaaataaagggctgtcttatgaaaatattccattagataatacaatgggaacaagaattaccgtatacaaaggaaaagtaggtgctgtggacaccaatgctgccgaaaaatattctttggaatttgtagaaaaaatagtaaaaaagaatggaaatcctactgcttctattacagataaagcaactgtagatgctaagctggtaaaacctatttttgaaaagcttaaaaaactttctccagaaaaagtgtcatggaatcaaaatgagaaaaattcctttacatatcctacttctttcttctgggatgacgggaaaaattattccatattaagtatttctattgaagatgatgggagaataagaaataaatacatttctgtgacgaaagatgcatatcgtaataatgcagtttttggattgaaatatcctgcccctcctgcttctccatggtataagtatatgaactaaaatcttttccatagagaaaaaaaaatgagacatcattgacaagaaaaatactggagtaatattcagatatttctacctggttttagaacaaaatagatggaagtaaaaaagggaaaaccatacattgcatatagtattttaggaataatagctgcaggctttatttactttattctgtggattattttcaaagatagaatgccgctgcatgaatatgcttctgaaatttccaataactatgacagttacgcagagaaagcgattgttttttttcctttacttttttttgttttcatctttattgttttaatgaagcctactgcttcaaaacgttttttacgcctgcaggcgtcacttcctacttcaaagattcattctgtggcaaagggacttgcagagatagaaggaacattggtaatgaggaatcctttattctcaccggtgaataatgaagtctgcatcgggtattattataccattgaagatattgacagagattctgatggtaaagaaagttaccggacgatccacagagaaacgcaatgtaacacttttcagattacggatgataccggaacgatagaagtggaacccgaaggaattgaactggttttattaggcgaaacgaatataagcagccagggtggtaaaagatacaaagaaacccttataaaagacggtcagaaaatgcttctggtgggatatgttgattctaaaaacggaatacctttcatcagaaaagacgattattataaagttctcggaattacgtcatcatcaggaatcactgtgtggaacaaataccagccattgctgaggtcatttatgtttacctgttccatcatccttttaataattatttatatacttacacaataatgaatcagacggtcgcaatcatattacttattctattaggagtagttatcatcagctttttgatcaatctgtataacaagttggtgatgctgaaattcaacgttgataaagcctatggaaatatcgatgttgtgctgaaacagcgtgcagatgaaattcccaatctggtaactgttgcaaaacattttatgaactatgaagaaaagattctttcccgccttacggagctcagaactttttataataacagtacggatgctgataaaagaaccgagattgctaacgagacctcaaaagcgctatcttcattctttgcggtttcagaaaactatccggaactgaaatctaataataattttcttgaactgcagaaagggatttccgatctggagaacaaaattgctgacagaagagaattttttaatgacagcgtgaatctttataatattggaattcatgaatttcccaatgttatattggcgaaaatgttaggatataaagacaaaacgttactggaaattacaaacgaggaaaaacagtatgacggggttcagttttaatacctttttcggattggaggacaaaatagttcaaaacccggagattgccattttcggagcgatgttcattcctctgttattgtccctcccggttacagtgatgggatggatattcagaaagcttaaattcaatatgtatatcattcatgtactattgtatacactgctttttacatttatattcggagctatcaccatatttgtacttttttttattacagacaaaaatggagtgaagctggcatattgctggcttatggtatttataggaatgttctttttcagcctgatcaatgccaataccattaccaaaatgtttagcgattggtctaaaataattaaagaaagacagaaacaggaactttagaaaaagatgaagagtatgaaaaaactaagagttctgatattgatttttgtagtattgatcaatatctgttgtggaaataaatcatttgatttgtcaacggtttcattaagtgatgatgcaaagaagtatgattttgaaaacaaaaatctgtttctgaaagatacagctaagccagacatcattcaatattatgctgatgaaaataaaggactgtcttatgaaaatattccattagatgatacaatgggtacaagaattactgtatacaaaggaaaagtaggtgctgttgataccaatgctgctgaaaaatactctctggaatttgtagaaaaaatagtaaaaaaacatggaaatcctaccgcttctattacagacaaagcaaccgtagatgccaaattagtaaaaccaatttttgaaaaactgaaaaaactttcttcggaaaaagtatcatgggatcaaaatgagaaaaattcctttacttatccaacttctttcttctgggataatggaaagagttattccatcctaagcatctctattgaagatgacggaagaataagaaataaatacatctctgttactaaagaggcttatcgtaataatgtggtatttggattaaaatttcctgcccctccggcttcttcatggtataagtatatgaattaaaacagtcagtaaaaataaaaaatattttccagatacttgaatcctgttttttctgtttattattgataaccggacactaacactaacattatgaaaaaactgaaatatgtattaataccagtaatctgcctgagtcttgcatcatgcggccagcagaaaaataaagaaagtgagtctttggttgaaacagcgggaagtacccagactgaaccattcaatcttgccaagctgaaagcaggacaaaatatcaacgatattttaaaatctgccggcgcaacagaaaaagaagctgtacgcaccaatgaagttactcttatcggaaatgaaagactggctttttcatcaaaagaattattacatttcaatgggatagatctggaaggcaggaacaataaaaatacaaataaagtcattttacatttcggaaaagtagaccatgaaataggcccgcttgccaatgaaaaagaagacgaattagggatgtatcagctcgatatctatactgaacaggaaagaacagcacttctggaaaacctaaacaaaacattacataaaccgagcttcgattctatacacgaagggtttgaatcagaagtaaaagataatgagatcattcagactcataataagttcagacaggaagtagcgatctggaaagataaagatatgctttactattactgcgaaaccaaaatagataacagaccggacgaataccgctgcaatctgtttgtattcaaaaataaagaatggaaagaccttctcaaaggatccggatatcccgatctggacaaaatctctttataatattcgccttattaggaatttaaaaacaaaaaatgccggtcttcttcagaccggcattttttatatgatactaggatttcaattattttacaaggaactgcattgtcacctgatcaagctttaaaatataaattccctgaccaagatttctggttttgatagaatttccatttctgaaaggctgatcaatcgtctgaagaactttcccctgaagattataaatttcagctttctttaccttctgaagatctccttttacaaaaatctcctgattagtaaccgggttcggagaaattttaaaactctcagaagtagtttctgcagctgtattttgaaccattcttgcactggatcctgaatagcatgtccatgaaaggtcatcaatagccactctgttacttgttgaattgttaacaagacttaccactacatttccggaaatgttgatattactgatggttgtggtgacagcagaagtactgtaaggaatagttcccacggttgttccgtttacttttacgtcaaaagtaccgttagttccggtaaacttaagctgtgtcgtcaccgttaaagaaccaataccattagcagaacttccggaagttaaagaaccgtttcttaccgttatagctttattattaagagtctgatccgttcttgaatccgttgcagtccatgagataccgccattgctccatgttctggtagaataagtagagctggctgccggaatcgtttcaaaagtttcattggcacaactggttggtgtagtgcttcctgcattggttgtaccggaaactgtagaactgtttgatgatgaatttcctgccgcatccttcgctaccacataaaagctgtaagttgtagaaggagtaagccctgaaatggttgttgaagttgaacttgttgtcgtttgcagacttccgttcatgtaaacattataagctgttactcctacattatcggtagaagcgttccatgtcagagaaatactgccagacgtttttccggaaacagttacacctgttactgtagcaggcgcttgggtgtcaccggaaggttgctgggaaccccagataagattgacataattcggattatcaataaacgggtttctgtttccctggaaagcataagaggcattatttcttttgatttcagcctgagaaaccggatcctgattatgccatgcaagcaaaacattcagctcccatgtctgtaatcccggaaatgcagaacttcctaacatatttcctgatgaaaaagtagaaagcttgctttggtagcgggttacaaaatagaaaatcatacgggccacatctcctttaaactcatcaattggctcaaatactgtccctgaatatcctgaagaagcagaagttccaagttttgaaccattctgtgaagtaaaagaagcacttcccacctttccgaaaggataattacttctcattccgtttactttcccgtctgtagctctgataaagtgaatatcggcaaccattggagaagcctggttgaaaagactttgaggaacaatgtgctctctgttataacaattcccttcagtagaataggtaccacactggtcagatcccggagtataattataagggtcaacacctgaaggtctttctgaataaatatccaggatcgttccgtcattttcgtagtccttgtcaatatcggtggttttatatcctgtccaaagcccattgtagcctttatcaacatgtccgttagtgataatgctgcttaattcagttttcagtgctgcgccacttagtccgttggcagaattgtagtaacctgcaggagcctgtgcatgggcaagtcctgcaaataaagaaaataaaataatttttttcatattaattaatataagtctcagcaagaataccacatttttgtgaattaaaaaattacaaaatcgttaattttaaatgcactatatgtaatgcataatgagtggtaaatgataagtgatgaatgatgaatgatgaatgatgaatgatgaatgatgaagtttcgtgtgagattcagtttttgtattttgaattatggcttttctataatttatcctttacttcaatattggatattcaataggaccgggctttagcccggtttaaaataaaccgttttcctttgctttatccgaaactataaataatagaagactatatccacggttatctgtgcaaatctgtgctatctgcgggataaacaaaaattacccataagccgtactttctatg

SEQ ID NO: 14 - DNA, 264602 bp, Chryseobacterium sp.
aaataaaccgttttcctttgctttatccgaaactataaataatagaagactatatccacggttatctgtgcaaatctgtgctatctgcgggataaacaaaaattacccataagccgtactttctatggtttatcctcaatattggatattcaatagaggcgggctttagcccggtttcaaaataaaccgttttcctttgctttatccgaaactataaataatagaagactatatccacggttatctgtgcaaatctgtgctatctgcgggataaacaaaaattacccataagccgtactttctacggtttatcctcaatattggatattcaataggagcgggctttagcccggtttcaaaataaaacgttttcctttggctttagccaaaacttaaataatgaaagtaattttcaacaatcatccgtgcaaatccatgtaatctgcgataaaaacctctgccattatcccatcaggaaattcctacttataagacatgaaaaagccggtacaaaagtaccggctatatataatggatgacttaaatttattttctttgtggcggataatttttcataatctcagccatgatttcaggaatctgtctctgttttgcttttggagaatctacagaaatcccgcttccgataccctgccagactaatttgttggtttttgcatcaataagatctacaattaaagctccttcattataatttgttgtccatgttctgttcatgccaacaccccatccgaatggtccgccccatccccacattccgtaaggtgaagacgagttgatatcagtaatctttttatgatttgcttttacattgataataagatcaggattttctccggactgaagtcctttgctctgaagctgtctcgacagttcgttcaatactctgtctttatcaatatcattcagttttagatcatcaattcttattttataggttttgtaagaattgaaattggcggtttcagcataatcggaacgtacctgaaaagggctacaagaagttaagcctaaagtagcagatgccaacaaaataaaaatatattttttcattttatttattttttttatcacttttaatgaatgtatcagtctttttatcgtacccgtaaggacagtgtctgcagccgcttttacagcaatagcctcttttcagatggaatttttctgtaaaaaccttgtacccctgttcattatagtagaagtcttcaccttctttgatgtcatattgggccataagttaaatgctagtcaaaaaactttttatatttgttactatgataattgtatgccaaaagcctttaaaaaaattaaaaattaatggcatcgcgctctttccctttatcttcattaggaaacccgaagataaggaaaataatgtattgatcaatcacgaaaaaattcatttgcgtcaacaattggaaatgctcatcattttcttttacatcttctatgttatcgaatattattattggttcttcaaacttaaggacggctatctggcttacagaagaatttccttcgaaaaagaagcttacgcaaatgaaaacaacctgaattatctaagaaaaagaaaattctggagcttcaggaaatacctttgaaattataaatgatgaatgatgaatgatgaatgatgaatgatgagttgcgtgttttcgggattcgcggtgtggatctaggtttggaaatctgggctgggatttggttaacgatcacaatattcaataggagcgggctttagcccgtttatcaaaacaatctaaattcatccggctttagccaaaacttaaattaaatggtccttatcttattatacaaaattcgtacatacttaacacgatcatctgtgtaaatctgcgttatctgccgagaaaaaaagaaaactcacacaacactaaatcttttcctaattttgcaaagaataatcttgagtcgtaaaactgaaatgctattaaaacttcccacagaacctgttcctatccaggaaattcccattcagaaaaatattaaacttttcattaaaagggaagatcagattcatccgttgatttcaggcaacaaatactggaagctgtttcacaatgtcaaccactatctggaaaaaagtcctgataatccgtatattattactttcggaggggcattttccaatcatattgcagcggtttcagcagtagggagcctggcaggtattccaacactgggaattatcagaggagaagaactgcagcataaatggcgcgataacccaaccttactttttgcaaaaagaaatggaatgaacctgaaatttgtcaccagggaagaataccgtcacaaagaaaaactgacagaattccttcagcaggagttccctgaagctttgatagttcctgaaggaggaaccaataaagaggctgtaaaaggagtgaaaatgatgctcaacgaacaaacaaaagattttgactatctttgcaccgcagtcggaaccggaggaaccattgcaggaatttcaaaattttgtgaagagaatcagaaagttataggatttaaagccgttgacgatgcttcactggagaataaaatttttgaattaactttaaagcataattttgatctaatagattcatgttttggaggttatggtaaaataaatgacggaaacgtccgttttatcaatgattttaaagaaaggtacggtattcctttggagccggtttatacaggaaagatgatggagaagatttttgatttgatcgaagaaggatattttcctgaaaacagtaagattttgtgctttcacactggtggattacaaggcattgaaggagcaaatctgctgttggaaaaacagaatagaaatttaattatataagtaaaattgaaaaacatgaaacacttagtgttccatctttcattttaaaacaataaaaaatataagatgaaaagacttttcctatccataagccttttagttttatcaaaattttcagcccagacttgggcaaccgaagatcagtatattcagaagtttgctaaatatgccgtagaagaaatggaaaaatataagattccggcttctattacccttgctcagggattactggaaacagggggcgggcagagcaggctggcactggaaggtaaaaaccacttcggcataaaatgtaaagaagactggaccggtaaaacgatgaaacataccgatgatgcacccaacgaatgcttccgtgtgtatgaagatccaagacagtcttatgaggaccattccatatttttatccaccagaaaatactatgcaaatcttttcaaactggatatgaaagattacagagcatgggcgtacggtttgaaaaaagcaggctatgctaccaatccccgttatgcttcaattcttatcactaaaattgaaaagtacagactatacgaatatgacaatacgaactccaatgaagtattgtacgccgttctgaaaatgtatcctgatctgaaggatgacagaacgtttatggcacagctggaaccttcaaaagctggtaaaaaagctaaggaaccggttaccgtagaagttccttacaaacagacttcttatgcgcagcagcaaaaaagagtggaaagaatcaaaacgaaagctgaaattcttaattccattcttatcaaaagccatccgaatgacggcctgaaatatatcattattcctgaagataccgatgtgaaattcattgctaacaaattcaaggtcagcgaaagcagactgatgaaatggaatgagctggaaagtgaaaccttgaagaaaaatgacatcattttccttgaatctaaaaattctacaggaaatacagctacttataaagccgaatacggagaagatatgcatgatatcgcccagaaattcggaatcaagttaaataaattgtatgctaaaaacagaatggatgaaggacaacagccatccgcaggacagcttatttatttaatagataaaaaaccacgaaactaatttaatttttgttgagagtttaccgttgacaattacatgccaacccgcagctgtcaacagcaacgaagtatatatgaagtatcaaagaagttcggctttgtttgatgaagcctacaaatacattccgggaggagtcaattctccggtaagagcattcaaatccgtaggaggagtgccagtttttatgaaatcagcaaaaggtgcttaccttactgatgtagatgacaatacttacatcgattatatcaactcatgggggccggctattttaggacatacacatcctgaagtactggaagaactgaagatacaggcagagaaaggattctctttcggagcacctacagaacttgaaacagaaattgcaaaattcatcattgaaaatgtcccgaatattgaccagatcagaatggtttcttcaggaacagaagcatgtatgagtgctatcagactggcaagaggatatacaggtagagataaaattgtaaaatttgaaggctgttatcacgggcattcagactcattcctgatcaaagccggaagtggtgctgccacgttcggaaatccaaattccccgggagttactgcaggaacggcaaaagatactttattagcccgttataatgatattgaacaggttcaggatttattccgtcataaccagggagaaattgcagcggtaattatagagccggttgccggaaatatgggctgcgtattaccagaaaatgatttcttacaaaagttgagaaaaatctgtgatgaaaacggagctttgttaatctttgatgaggtaatgaccggtttcagattagcattcggaggagctcaggaacttttcaacgtaaaagcagatttagtgacttacggaaaagtaatcggtggaggacttccggttggagcattcgcaggaagaaatgaaattatggaccaccttgcaccaaaaggtggagtttatcaggctgggacattaagtggaaatcctttggccatgagagccggattaaaaacccttcagcttattaaaaatgatcctgaatttttcaacagattagagaagacaactgaaacattggattttgaaataggaaaaattctgaacgaaaaaggaattgctcacagaatcaacagaaaaggttctatgatgtctgttttcttccatattaaaagtgtttccaactttgatgaggctcaggaagctaatcattcattgtttaataacttctttcaccaaatgcttcagaatggagtatatcttccgccaagcggttatgaaacttacttcatcagcgatgccatcaaggataaagaaattgatatgacactggaagcagtaagaaagtttgagtattcaaataaataaatataaaagaccggattttacatccggtttttttgtgcagactgatttgaattggaaagtctgcagtataacctggattcctacggaatgacaagcgttgcgggatactctttgttgtagtgtagaaagataaactgagtctttttagcaagtaatcaccacaaagcataaatcatacagattttgtaataaaccatacactttgttcagaacacttctttttaattttgccataaacagattggaaatgaagacctcagaccctaccatctcccgcaaggattttatccggaattcagcattggctgttgcgggcttgactttaatacctaatatcatgaccgcatcacctttttttaatgaaaacaggatttcagcaaaaggaaaaatgagccttaaaaatgttcgtctggaaactggttttgcatatgagaatggagaagtggcttctaccaaaacagacctgttctgtatagaagttgaaaacgggaaaattacaaagatttccccaaatcagccagatgctaaagcagtagatttaaaaggattgttaatgcttcctgcattcagggatatgcatattcatcttgataaaactttttatggggagcggtggcaggctgttagaaaaaggaacggtggagtgaaaggaatgatcgaactggagcagaaaatgcttccggagatgcttaaaaattctactttcaaggctgaaaaattaattgaattgttgcagtcgaaaggaacttcctttgcaagaagccatgtaaatattgagcctacttccaaacttcagtcattaaaaaacctgcaaagggctttagaaaataaaaagaaaggatttggagctgaattggtagcttttccacagcatggggtgttttacacggattcagcgccttatttgaaagaagcggcacaaatggatatcgattttatcggtggggtagatccgttcaacattgatggagatattgaaaaagtagttgattttaccgttcagcttgctacagatcataaaaaaggaattgacattcacctgcatgaaaccggagattccggattgaaaacggtagaatatctgattaaaaaagtaaatgaaaatccttctctgaaagggaaaacctatttaagccattgttttgttcttgggaaattagaaaccgtaaaacaagaagaaattgctgaaaaattagccgatgcccaaatcggaattgtctctacaattcccttcggaagactgatcatgccaataccaacactctacaaacataatgtcacggttcttacagggaatgacagcattgtggatcactggaatactttcggaacaggaagtgtccttcagaaagccaacttaatggcccaactgtatggatattcaacagaattctcattatcacgaagtttaaagctggcaacaggaaatatccttccgctggatgataaaggaacccaacagtggcctaaagccggagataaagcagattttgtactgatcaatgccagctgttcagcagaagcggtatcaagaatttcagaggtggaatcattggtacatgatggaaatgttgttttttaattcaaataagaattaattaaataaagatataaatataatctagttgtgttttttttgaccacaaaaggtatagaagtgaatgcggactgaaactaatgtaagagtgaaggtaatgcttttatccttttgtggttatttttagttttctctcacaatttttagtaattttaggagaaaatcaggcagagtgggttatcatacagatcattttccggttttaggaattcaggaattcagcgagaatcagctgaagggctgtaatctgttatttaatgaactttatggagcgcgttctattgatgagccccacaagcatgacttttttatcatcaatctttttgagcacggagtaggctcacataccatagattttacagaatatcaggtgaaagactatcagattcatcttgtttttccagatcaggtacatcagtgggtgattgaaaaagaaactatcggatatcagctgatgatcagcagagattggtttgaaagttttctgccgtcgttgaggttttcagcttcttattaccagaaccatccggtgatcaatctttccaaacaggtctttgaaacttttctctatgaattccgggccattcagaaagaactaagcggggaaaaaatattttgggaactgattcagaaaagaagtgaaataattggtttgctagtgagtaaatccgtggagggtgcttataaagattttgaagtctataactcgaatcctattatttcaaggtttctgcatcttattgacgaacattttaaaacggaaagatcagtttctttctatgctgaaaaactaaatatttctgccaactatctgaatattgtctgcaagaaaagtctcaatgcttcggcttcttctctcatccagaaccgtattttactggaggcaaaaagactcctgaaagtttctgaaatgtctgtgaaggatattgtatatgacttaggcttctacgatcatgccagtttttccaaattctttaaagcacagacggggatgacaccttcccagttcaaagaataatctgtacaaaacaagacataattgatacaccggttttaccttcagcacgggttaattttgtattgttaaaatttaaatcatgcaatttccctatcaattaactgcaaaaggaaaatataccctgaaaaatgtccgcctggaaactggctttgaatacgaaaatgaagaggtcattggaacaaaaacagaccttttcagtattgaaattgaggacggaaaaataaaaacagtgaaagctaatgatcactcttctgaagctattgatgctaagggatatctgatgcttcctgcttttaaagatatgcacatccatcttgataaaacattatatggacttccgtggcaggctctttctccaaaaagaaagacggtaaaagatatgattgcttatgagcagcagatcattcctgagttgttgaaaacttctgtaagcagggcagagcagctgatcagcttactgcagcattacggaactcattttgtgagaactcatttcaatattgatcctacttcaggattgaaatcactggaacatcttgagcaggctcttgaaaataaaaaagattccttccaagctgagctggttgccttcccgcagcatggtgtttattatacagaatctgcacctttgatgaaagaagccgcacaactgaaaagtgtgaaatttattggagggctggatcctttaagtattgacggcagcattgaaaaagtaatggattttacggttcagctggctttagatcatcataaaggaattgatattcatttgcacgaaacgggagagtcgggaatgaaaacaattaattacctgattgataaagcaatcgaaaatcctgagcttcagggaaaaacatttgtaagtcatgcatttgccttagcccatctttcaccaaaagaaacagaacagattgcagaaaaactggctgcagcaaaagtaggaattgcttcttccgtgccttttaaaggaaaagtaatgcccattccaaccttgaaaaaatatggggtaaatgtattggtcggaaatgataatgtacaggattactggagtacattcggatccggaaatatgttacagaaagcgaatctgattgctgagctctatgggtacgccacagaatatgcgttgtcgagaaccttacagtttgcaactcaaagtattcttcctctggatgaaaaaggaaatcagcagtggccaaaagcaggtgatgaagcggcaatcgttctgacggatgcttcctgttctgcggaagccgtttccagaatgtccgaaataaaagccctgatgaacgacgggaatttattctggagaaagtaattgaagtatatattttttatacacttgttttttttaatgccatcagagactttctggtggcattttttgtagtcgcaggtatcgagattacgcgtttcggttttcgagtttggattcgggttttttgttttttttttgttatcaataggaacgggctttaacctgtttatataaaaacgaattcatccctctggcttttgcttaaacatatcagcaaacatctgtataaatctgtgtcatctgctgtaaaaataactgttcatattgctattccagttttttcaatatgaacacccgttcacattgaaaccggcaaatttttataacaccagggaataatgaataaaaaagccttcggaaaaatgttccgaaggctttttaaatttaaatgaaattaatctaactactatattgttttataagttgaagttggtccaacctgcataccatgtatctgtagcatcttttacagcacctttgtaggttacttgtgtaaaccaggtagccaatttaggattagtaaatgaacctccggttaataatggagaacctgcagtaggcgtgaagtttggtgtagttcctgctggagcccatgcaccggcaagttttacatcagctgtagaagcaaggattgtatttcctttagcattgaaccatgttgtaagatctgccaatgtatatgttgtaggagtagatgtagatggtccgaattttaaaggagttgtatttcctgccaatacgttgttttcaaagaaaagtttattacctacaatattgttatctgttggagaaccttttgtagcatcgatgaataaaccaacagggaatcctgtaaatacagagttgaatactgagatagaagagtttcttctgatctgtaaagcattctggaataacgcgttgatagaaccaggagcagcagagttgattggcccgataatcgtcatgttagagaatgtagcagatgtctgaggcgctaaagtagaaccgttggcatcattatcagattcaaatgcgttggaacctgaaacgtccgctacctgagaatctcttactgcgataccaaactgtacatttcctgaaaatccgttatctgtatcgaaatcatcatcaagacctttataagaaataaggtgagaacagtttaccgttcccccgaaccactcaaagctgtcatcatttgcataagcaacttctacataatctactgtagttccgttacctacaccaccgaaagtaagtccgttgatctctttatccggtaagaatgcatatcctgcatattcaattcttacatattttaatacaccactgttgtcagctgcatttgttcccccataaagtccaagaccttcagagttgttgattcctccttcaatttctccaactccgtttgcaccaccgaaagaggcgttggtaggagcgtttcctaaaattactacacctgcccagtctcctcttttaggacttggtttttctgaagtgaagataatagggttggcagcagtaccttctgccatgattttacttcctcttgtaatgatcaaagcaccgtttttatcagcttcacctacaatctttgtacctggctcgatcgttaaagttgctccgttagttacatataccagtcctctcagcttatagattttattggctttaagtgttgtattggaagtgatttttcctgaaagaataagattttcagtttctccgtttccgttacctccattttgaataatggtaggtccatcttcttctatatttctacatgcggtagttgatactaaagcgccaagcattaaagaatataaaacgaactttttcatgttataaagaattaaattatttttattagattatttgttgagtgaattaaaaattgtatcccagtgttaaactgatattggttcctgtaagtctttcaatggcaagagcatctttgctgtcatacttaccgttgtcgttcaggtcatggtagaatttggcacgacggttcaggatatctgaaacattcagcttgatctctcctttgttgctccataattttttagcaagctggaaatcaagaagaggtcttggtgcttcccagattggtggaacctggtcatttcctacatacaggattcttcttccgatcatattgaatagtactgtagaagaccatcctgatttctcagtatcatactgaaggcttacgtttaccgtatatggagactgcccttgcattggtctgtcaatcttggtagtttcgtcagttactctgtttttgattaatgctacgtttccacccagcgtaaagtttttaagagcacttacaaaatccagtttttttctggcttccacttccaatccgtaagcatcagctttatctacattaagataattaaaggtgttactggttcctacccctgattggttgaaatataattcgataggctttttgaagtttttatagaaagcagctactgagaaaatctcaccgtttctcgggtaatattcccaacgaagatcagcactcgtgatttttgttctttcaatagatttgttaccaattacggttgctccaaggtcaaaatcataataagctaaaggtgaaacctctctgaattctggtcttacaacagtttgcgaacctgcaagacggatgttcattttaggatttaccttgaatgttaagttaacagcaggcaggaagtctgtaacacgtgtatttacaaaacggtcatcgcttttcttcgtgcttccaaccaactggtcaaagttttcaactcttaatccccaaaccgctcttaaccatggtgtaaagttattgtcaaactgtaaatatcctgcgttaaggattgtattggcaatatatctgtactggtttcctgcaatttcatcgaatgtaaatcctccgttagttccaaaattctgaggattgaagatcgtttcaaaaggctgggaaaggagtccctggttgaagttttcaagtcttacagagaacggtcttgaattatatattctgtcttttacctggaacaaataacctcctttgatcgtttgcttctgtccgaacattgtaaatgtcttggaaacatcacctccggcattatataaatagtcgcttagcgtagaatagaatacacttcctgacttttgggaaagaccattggaaatcaatgctaaataaggacttcccggcatgttggtatattggttatactgcaaacgctgcagcaaaggaatatactgatcaagaatcccgaagcttccgtaccagttgatggtcaatccgccaagagcatcaattttatggttaccgctaagggttgagttgtagaaagtagtttctttaaaaccgatctcccttgccatgatgtttgttccgttgataggatcaaattcaaagtcctttcctgttctgaaggacatgtggtttaccgtattgttggtaatgatattctttaaggaaattttgttgttgttgttcagctttaaagcaaggttcaacattccccctaaaataatatcattgctgtatttttctgtaaaataatcgaagttggtatcagcaagctggttgttgatggtaaagaaacggttggtagattcagttcttcttttgttgttactgtagtttaaaacagcaattacccctaaatcttttccgaaaatttttgtattaaaaccaccgtcaagctgtaagcttaagttttccgggtaaccgatactgttgtaccccaagttctttgtataccctttaccgatctccgttttttgtgcctcggtcagaatgctgaacgcattttttgcaggcatattggtaggaagttttctataaccgtcatctatacctaagaagtcccattttccgcctttctgcatatggaattcctgtcccatagtagctgtgtttcctcctacacctacctgaacgttgaagaagtttttattaggaatatcctttgtatttacctgaatcaatgctcctccccattcacctgtatattctggaatgaaagttttgttgataacaagggtttcgataacgttggcagggaaaaggtcaaaagagaaagtctttctgtcaggttccgtactggatagctgaataccgttcagcatcgcctggttataacggtcagataaacctcttactacaatatattttccatcaaataaactcacccctgaaactcttttcagaacttcaccggtgtttctgtccggacttcttttaatcgcttcaacaccgataacctgagaaactacaccggcattcttttgtaaaccgatggtagaggctatggtttcttttcttgcatttgattttatgacaactccctcgatttctttttctttggcagatggcttatccagaacgatatcaagatgcgtgttaccttcatttttgataacgacctcgctgatctcttttctgttatacccgttggagcttaccgttacaatgtaattggtaccaggggaaaggttgatagagtagtatccggaaatgtcagtggtaacttcctgaccatttacttttacttttactccttctataggagtgttgtctttctcgtccaataccctaccttccagaatctgactttgtgcaaaagcatagccagcagaaaacaaggcaagtagcataatgctcttgtggagttgttttttcattttacttcttttacttctttttcaagggcaaaataaaggctaagtttttaagaaaactttaggagaatcttaattaattatgaagtttgtattaacggataaatgaattttatagttatcgatgtttaatttatataattataatttttgttttaatgttaattattattccttatattcgatttgtgtatatataattgttaatttttttattgattttataatttcgatttaaaatactattttttaataattagttaacatttacgggatagatgaaatcaatggaaataattaattttgtgggaattcttaaactagaagatgagcaaaaaaattcttttaatagacgatgaactggacattttagagattctgtcttacaatttggaaaaggaagggtatgatatctatacggctaccaatggtaatgaaggtatagaaaaagcaaaagagattgttccggaccttatcttattagatgtcatgatgcctgagaaagacggtatagaaacatgtcaggaacttcgtaaagtgaaagaactacaaaagacacttatcgtgttcctttctgcaagaagcgaagaattttctcagttagcaggttttcaggcgggtgccaatgattacattgtgaaactgatcaaaccgaaaattcttatctctaaagtaaatgcattactacagctgacctctcaggtttctgacaatgctaaactcatcgaaatcggagaccttgtcattgataaagataacttcagagtttccaaaagcgggcagcaatttcttctacctaaaaaagagtttgatttgctttaccttttggcttccaatactgagaaggttttcaaaagagaagagattctggaaaaagtctggggcaatgatgtgattgtaggagaaagaacgatcgatgttcacatcagaaggctgagagaaaaactgggaatcaatacgattcagacattaaaagggatagggtataaactgatcgtttaattatttaaaaaccttaactttacgttcaatcattaaaacgttgtaaaattgaaattttacagacttaccctcgttgcctcctgtctgctgacactggtaatgttccttttggtagtcgtattcgattcactgaaagatatctattatgagacccctttgttcaaaacgggtcttttcatctgtattgtcctgatcttcctgatcaactgtgtagtgctggaactgcttttcaattattatggaagaaagcaggtaaaaggtctttccggatttcttccgcaggaaatcgtacagaatcaggacgaaaatattaccatcaaagaattaggcgaaaggttttcagatcttaaccagcagcaggtatcagagattgatatgatgaaagagatggaaagctaccgtaaagaatacatcggaaatgtttcccatgagcttaaaactcctttattttccatccagggatatgtggaaaccttaagagacggcggagtggacaaccttaccatcagagataagtatctggaaagaattgataaatcggtagaaagactgattgccattgttacagatctggatatgatcaacaggctggaggccggcgaaatcaatcttaccgtttcgaaatttgatgtcaatcttctgatcaaagaaatcttcgaccttcttgaccttgaagccgaaaaaagaaatacaacattacagattcagacccttcatccacagatctttgtggaagctgataaacagaaaatttcacaggttttcattaaccttatttccaacgccattcattatgccaacagacaggaagcaaaagtgattgtaaaaaccagtatcctgaaaaataaggtgctgatagaggtgatagacaatggaatgggaatcaaatccgaaattctcccaagaatctttgaaagattttaccgtgtggaaaccagcaggagcaggagagaaggtggctccgggcttggtctggctattgtaaaacacatccttgaagcacacaacgaaaacattaccgtagaaagcgtttacctggaaggtacgaagttcagttttatgctcgaaaaaagtaaataattccggcaaaatgtaagaaaaaaaaatattttaaaaaatcctgaaatatttttttgtcacatgtcatttattatatatttgcaacagagatttatcataattataaaggcaaaaaagtaatttaagaaactgatatggtttacaaaatccgcgtaatattagatgcgaaagaggatattttccgtgatgtcgaagttaagggaaaacaaacgttatggaacttacatttaggaattaaaagtgcattcagtctgcagggagatgagctttctacttttaatctgttggaagatgacggaacgatcgtaaaaagtgtcccattggaagatatgagtgatgatggtgatggcgagatcatgtcagatgtttacattgatgaggcttttgaaaatgtaggtgacaaagcacagttccagtatgggcttcttgatctttgggagtttttctgtgaacttgtagaggtaatagaagaaacaaaaggggttaattatcctataaccgtatacagatttggaaacgttccattaaaggctcctagcaaaaacggaggtgccggaggtggcaaaaagaaatcagcaatgccattggtagatgatgaattcggttttgatgacgatttcgtagcaggaggaaactttgcagatgaagacgacagtttcgatgacgaggaagaagaagactacaatgatgatgtctttgatgatgaggatgacaatgatgatgaaagatagtcagcacaatatacaggccccgggttttgacccggggcttttttatggccaaataaagtgaacggccattctgcttttaatgattttggctttttacccttttaccccaaaaacaatccttacttttgttaaaaatagtttaatgaaaaaattaattttgttagctgtaattggtctgggaattgtttcctgtaccactcaaaaaaataccagaaggatgacagaactgccaaaagattggaaacataacacaaatatctacgaagtaaacataagacaatatactcaggaaggaactttcaaagcctttgcaaaagaaatgccccgactgaaatccatgggagtaaaaacactttggtttatgcctgttactccgatagcgcaactgaataaaaaaggaagcctgggaagtccttacgcggcagcagattatacctctgtcaatccggaattcggaacactgcaggattttaaagatatggtgaatgaagcccacagattgggattcaaggtgattcttgactgggtagccaatcataccggctgggatcatgtgtggacaaaaacacatcctgagttttatctgaaagatccggatggtaaatttcatattgcctccggaatggatgatatcattgaacttgactacaaaaatcaggaaatgcgccaggcaatgattgatgccatgaaattctgggtaagggaaaccaatattgatggcttccgatgtgatcttgcctcttgggtggaagttgatttctgggagcaggcacgccccgaagtggaaaaagtaaagccgcttttctggctgggagagtttgacgaactggaaagtccggagtacggaaaagtatttgatgccagctattcctggaaatggatgcataaatctgccgactattacaaaaataatgaaccacttcaggaactgaaggatctgttgagacaatattccaatatcggagatgcttcaatgagagcatggtttacgacaaatcatgatgaaaactcatggaacggtaccgaatatgaaaaatacggagtgatcacaaaacctatggcagtattctctgcaacatggaatggtgttccgttattatattcaggccaggagcttccgaatatgaagagactggaatttttcgaaaaagatgccatcaaatggacaaatacctaccaggttgctgatttctataaaacattattagatttaaaatcatcaaatcctgcattaagaggaggagatttcaatgtgaccacctatcttcttaatacaacagccaatgacaagattctggcttatgtaagaaaaaacgggaaagatgaagtattggtcgtcctgaatatgtcaaaagaacccgttaatttttccattgaagatgagcacctgtcaggaacattcagaaatgtttttgataagaccagaagggacttcagtcatggaaaagacttcagtttcaaagtttctgactatgtcgtatttgaaaagtaagcaataaaaatctctgaacttccggttgaagcaataattattaacaattagtcttttagggtactcatttcccttcctctggaggggtggcaaaatcacagatttttacgggtggtttatctgccctacaataaaaatccaccattacaatgaacaaacaggaaataatcaatattattaaagcgaaagcagctgacaaaatccagtattttgaaaaccttatcgcagaaacacgggcttccaataatgacaccaaaagctctatgggagacaaatatgaaacaggaagagaaatgcttcagcaggaaatcaataatctgcagagacagctcaacgaagtattgaatcagcaggctgtattgcagaaaataacttcagattcttcggagaaagttcagaacggagcattggtgaaaaccaacaaaggattattttatatagctgcttccatgggagaaattatgtatgaaaaacagaagattatgacggtttctgcagaatctcctttagtaaaggcgatgtttggcaagaaaatgggagagacatttaccattaacaatattattcaggatattgagcatatctggtaaatcaatcttttaataatatgaaatgtaaaaatctacttctccttgcctttttactggtaggtctggtgttcaatgcacaggttcgtgccaccgtttcgtcaaaaacatatgatctggaaacagttaaatttactgtagatggctttgtgtttacacttaatgcagacggatcaattgctgattttaatgctcctgatctgaatggtaagctggaatactatgatgaccaggtttttgataaagtaaaatatgggaaacttaaaagcattggaaacgttaaagtagattactgggaagattctgcattcacgaaggaaaaagccggtaagttgaagagcttaggtaatatttcggtagactattgggaagattctgcctttacgaaggaaaaagcagggaaggtaaagaaaataggtaatcttgccatagattactggccaaatgatgtgatagataacagcaggctgggtaaactgaaaacaataggaaatatctctatcgactatggaacaaaagatattattgatgaaagtaaatttcagaagcttataaaatttggcccggttagactggattattcaaatgatagatttattgataaaaacagatatggccaattaaaatcaatcaatggaaacaatgaagaaatcagcgtttccgtattataatatttcagctgtttaatcgcttgaaaatataatgtttacactcatttaatagaaaagagatatgcaccttataaaaagcatccataggttgggtgctttttttttattaaatttggaacttaaaatctcattcaaaaatgcaaaactacctggaccttttacagcatattttagacaacggaactgataaaaccgatagaacaggcaccggaacaaggagtgttttcggatatcagttgagatatgatttgtcaaaaggatttcctttggtaaccacaaaaaaagtgcatttaaaatctattatctatgaactgctttggtttctgaaaggagataccaatatcaaatatcttaaagataacggagtaagcatctgggatgaatgggcagatgaaaacggcgatctgggacctgtttacggggcacaatggagaagctggagcggtgctgatggaaaagtagtagaccagatcaaagaagtaatcgaccagatcaaaaagaatccggattccagaagactcattgtatcagcatggaatgttgcggagattcctaatatggctttggctccttgtcatgccttatttcagttttacgtagcagatggtaaattatccttacagctgtatcagagaagtgcagatgttttccttggagtaccgttcaatattgcaagctatgcgttgctgctgatgatggtagcacaggtttgtgagctggaagtgggggattatgttcacagctttggagatgtccatatctataataatcactttgagcaggtaaacagacaactcgtcagagagccgagagcccttccgaccatgaaactgaatcctgatgttaaaaacatttttgatttcgatttcgaagattttactttagaaaattatgatccacatccagggatcaaagctcctgtagccatttaatactcttatatcactttaattttttattacttctatttattttacattaatagaggcattgtctatgcccataagctggaaaatcagaatataaatactttagcataccttcttttggcaatagtttcttaaatttgaaagaaacaaactcggttcattcgatagatccattgaccgttatgagatcaccaattcaaatgctaaaaataaatcatgaagtatttaaaaatcaatatagaagaaaatgcagatattgaagcgctgaaaaatgctgtacagcagctgaaaggagtggcttcaacagaaatagtggatgacgaaaaccctgaaagcgagctcaaaaaagcctttgctaaaacaaaagaacagcttaaaaagggagattatgaaactttagtcaatgatattttcgatataatcattaaaaaataattctaaaaaataaagtagaccgatgagaaaggccattttatcaattgctatactgggaattttattttccgcaaatgtatcagcacaaactgaaacttcaggaagggaaaaagtatacagagctacccataccaaagtgacagaactaaagcataccaaactgaaagtaaatttcgattaccagaaagaacagatgaacggagaagaatggcttaccgcctcaccttacttctatgcaaccaacgaacttactcttgatgcaaaaggaatgctgattcatgaagtatccctcgataataatggcaaaaaatctcctttaaaatacgaatacaaagacgatattctgaaaattactctggataaaacataccagagaaatcaggattatacagtttatatcaaatatacagcccgaccgaatgaggtaaaacaacagggaagtatggctattaatgatgcaaagggtctgtatttcattaatgctcagggaacagagccggacatgcctacacagatttggacacagggagaaacagaatcttcttctgcatggtttccaaccatcgataagcctaatcaaaagaccacacaggaaatttacatgacggttccggataaatacgttaccctttccaatggtattctgaaagaatccaaaaaagaatccaacggacttagaactgatcattgggtaatggataaaaggcattctacctatctgttctttatgggagtaggagaatatgccgttgtaaaagacaaatggaaaaatattccggttgattattatattgaaaaagaatatgagccgtatgccaagcagatctatggaaatacaccggaaatgatcgactttttctccaaaaaactgaactatgattatccatgggcaaaatatgcccagatttccggaagaaattatgtaagtggagcgatggaaaatacgactgcaacactccacggaagcgatattcttcaaaagcctggacagcttatcgatgaaaatacttgggaagataccattgctcacgaattgtttcaccactggtttggagacctcgttaccgcagaaagctggagtaatcttacagtgaacgaatcttttgccaactattccgaatacctttggaatgaatataaatacggaaaagaccaggcagattatcacctgatgacagatgtgaataattatctgcataacccagccgattttaataaaaacctggtaaggttcaattatgaatcccgtgaagatgtttttgacctggtgacgtatcagaaaggaggtggaattttaaatatgctgagaaactatctcggagatgatgccttctttgccggaatgaacgattatctgaaaaccaatgaatatcagaatgcagaagcccaccagctgagactttcttttgaaaaagtgtctggtaaagacttaaactggttctttaaccaatggtattttggaagtggaaacccgaagattaattactcatctacatttgagcctgtgaaaaaacaggttgctgtaaccattaatcagactcaggaaaaaccatttgaatttcctctggctattgatgtttatgacaatggaaaacctaaaagatacaatgtctgggtaaatgcagaagcaaaaaatacatttaattttgatgtttctaaagctccggatcttgttaatattaatgcagatggggttttactggctgatattaccgataccaaaactccggaacagaatctgacgcagtttaccaactctaaggaatttaaaagcagatacctggctttaaccggaataaaagatcaggttggaaaaagccctgccgcaacaaaattgttagctgctgcactgaaagatcctttcttcagagtaagaataaaagctttgaatttaatagaccttaccaatcctgaacaaatgaaagcattgggtgctgaagttgaaaaactggcttccagtgatccgaaaactttaacccaggccgccgctattacagctttagggaaaacaaaagacaagaaataccttccattatttgaaaaaggagtaaatgctgtttccaatgcagtgagaggaagctcaatgagtgcgattcttaccattgatccgtcaagggcaaacagtctggctgacaaaattgatatgaaaggtgcttcagaagaattgcaggcacaactgcttcctgttattgtgaagaacaggattacttcccagatagaaaatattgcgcctcttgctactttttatccgtttattaaattccagaacccggaattaggaaaagcggcagaagacggtttcaactggatcatgacttccgataatctgaaagctacggaaagtatcacaaaaatagcaggatatgccaaaaatcagatggcggataatccacaggctaaaatgatgatggttcagatgctgaaagatggcctaagtaaaaaaatggaactgctgaaacagaatccacagaacgcagtaagcatcaacaagcagatagatgttctgaataaagctattgaaaactataaataaaagaagcagccggtaaatttaccggctcccttctttttattgctgaatactaaactgtcagattatcatttaaaatacattgatttttaacgatgttataaaaatcagtactttttcctgttgttttttgcgttatctttcataaattcgttcaaaatttagacaattatgagttttggaattgaagcagcgggctattatgtgcctggtttatatttggagattaaggatttagcagaaaaaagaggaatagaaccggcaaaattggaaaaaggcttaggtcttcataaaatgggactttctgatgtccatgaggatgctgcaacctttgcagcagaagcattactgaagcttatacaagattatcatatcaatccgaaagaaatagcaagagtgtatctgggaacagaaagtgctttggatgctgcaaaacctacagcttcctacgctgtacagatggtagaaaaagttttggaggaaaaatttggaaccagatgtttcagaaactgtgatgttcttgatatgacttttgcctgtgtagggggagtagatgcattgcataatgctctggattttgtaagagtaaacccagataaaaaagcagtcgtaatcgccagtgattacgcaaaatatgaattggcttcttccggtgaatatacgcagggaggcggagctgttgctcttctggtttcatcaaaaccagatctgcttgaaattgaaaataactggggtgttgcttcagaaagtgtttttgactttttcaaaccaagaagattgtataaaaaggaagatctgaacggagctccggaaacttaccctgaaaaaattgagatttttaccgatgaacctgtttttgacggacaatattccaaccaatgctaccaggacagaataagagaggcttaccaacattataaagagataacaggaaaggaaaagccttatgaaaactgggaatatattattttccacttgccatatgcctttcacgggaaaagagtatttactgaaatttacagtcttgagaacaatctttcctatgaaacggtagaggaacagaaagcggttgccaaatccgaaagctatcttaaattaatcaacgataagattgaaaaaacacagagagcttcttccgaaataggaaatatgtacacagcatctatatttatggcacttctttctgcgctgcagacagcttttaatgaaaatgaagaactttcaggtaaagaaattggttttgtagggtatggaagtggttcaaaatcaaaggtttttgcaggaaaggtttcagagaactggagaaaggtagtggaaaaatggaacttattcgaaagtttgaaacaaagaacagctgttgattttgaaacttacgaaaaactccacagaaagcaattgaacctatctgtaaataaagattacaaaggcttcgggttggtctctgtagaagcagaaaaccctgttttaaccggagcaaggtattatagttatcagaattaagataagtgaaatttaatatttaaaggcattccattttgggatgctttacttttttattaatataatcatgcaggaatattttgtgaattttacagttgtattatctttaattttaatggtaaggcaggtaaaaaaatacaacaaatgtttgcggagattccacaggctttaattgaatttgatatataatatattaacagttttttgaatgaaatcccacatatgcatcacgaaacaggaattctccgattgcagaggtctgttttttatataaaatttaagaaaaaggtctgtttttttctccatttctgccaaaatcaatacttctttttgtttatattttacgttaatatgtggaatttaaatttatttttttaactatttattttaaattgctgtatattgattttaattttaaaatttattaaaattccgttaatatataaattaactcattttttgttaattttttaaatacaattaaaatgattttccatcattttttgcgtatggatgtaaatctctcctttctggaagcctgttttcagcatttaccgaattgatgttatagatatttatcgacatatttgtcgcttgaatatattaaaatctgttaatatgaatgtgaagttacatgtattaagtgcaggagctttgttttttttaggacaagctgcttttgcacaaaaatctaagaatgattctgttctgaaggagaataagatcgatgaagtaatcgttactggataccagaagaaaaaagcagatgaaattacccaggctcaggctgttgttggtggtgatgaaatcagaagaaactctcctacaacatctatcgggaactctttacagggtagagcttcaggggtatttgtacaaagtacaacagggcaaccaggtgctgctgcgacaatcttggtaagaggagttgccggtgtaggtggttcttcggaacctacttacgtagtaaacggaatgtatatgactgctagacagttcagtgcaatcaaccctgctgacgtagaatctatttcaattcttaaagatgctgctgctacagcacagtatggtgcgagaggagcaaatggggtagtagttgtaacaactaaagccggaaaggctggaaaaactcactactcatttgaaactaagtttggtttcagtgaaaagctgagagacaaaaactacacgatgatgaactcaagagagttgatggattttcagaatcaattgggataccttggatttaaaccacgatctcagcaggaaatggataggcttgcggcttatgatcacaactggcaaaaagaccttttgaagccttcaagcattcagtcttacttattcagcgcacaaggtggttccagagagagtactttttattactctttaggttatgactctgacaatggaattatcagagatatagatggccttaagagatatacaggtaactttggatttacgaataaactgagtgaaaaacttaacgttggtatcaacattggggttcagtatcaggaaacacagaatttcagagacagaaacaatacacagaacccatttggagcaatgtataaatacgctccatatgagccgatttataatgcagatggaagttataaccagaccatgagagcaggttctaacgttgttgagcagatccgtaattatagattagacgatcagagactaagaattccggtaaccttatttgctgagtataaaattattgatggtttgaagtttaaaaccaacttcaatggtctttatgattggtacatgggaactcaatggctgaaaaaaggttcaaacttggatatcaccgttaataaagttcctacaggtgcattaaataaaaactcattctatacatttaactatacctggaataactccattaattataaaaaatcatttggaagccataactttgatttcttaggatttatggaatacaatgataacttcaacgaaacaatgaatgggggtgcctatggattgaaatcttctcaattaagtgttccttctattacaacgccttctgatagaaatacatttactggggttaaaacaagaaatactctatttagtttagcgggtctattaaactatgattatgctggtaaatacttggtaactggatcattgagaagagatgcttcatcaagatttggtgccaataaccaaagtggtgtcttctggtctgcaagtgctgcatggaatattgccaaagaagatttcatgaatggaggctttattaatgatttaaagcttagaggatcatatggtacaacaggtaatgatggaacactgccggattactataacgtaaccaatgttagctatggattatatggttctaatggagctttatatccgggaacatccagcagttttattattggtaacgaaaatcttaagtgggaatctaatgcaattactaacttaggggttgatttcacaatgtggaacagaagaatccgtggatccgtagaagtttacaaaaataagagaaaagactttgtacagttagtacctttggataaacaggaaggaggatattaccaatatatcaatgcaggagatatgtctcagaaaggtcttgaggcagaattaagtgttgacgtgatcaaacaaaaaaatttccagtggaatttacatgctaatatttccttccagaagtcagttcttgataaattagcaaatgggcagacagaaagaaatttaggagatacttatcttaaggtaggtgaaacaccatatgtattctacaatgttagatttgctggggtagatccaagtaatggtaacgcactatactatgacaaagcaggaaacattactgatgtttacagtgcttctaatgcagttccacttactgataaatctccattcccaaaaagttttggtggatttggtactaccgttcagtacaaaggacttgatttcagtgcagactttgcattcaaattaggtggatatacctataataacatgtacgctgctgctgttgatccaacattggctgttgctggtagaaatatggcacaggctgctgctcaggtttggcaaaatcctggagacacaggagtattccaaaaagtagactctaatggtatgcgtgactccgatcagtggattgaaaaatcagattatctaaggttgagatcacttactttagggtatacatttgataaagcgttccttggagaaggatctccaatcaacaagcttagagcatatgtacaaggacaaaacttatttactgtgactaagttccacggcgaacctgaagtttcagtaggatctggtgaatctacggcattatttgtacctggctcatataacctttatacttatccagctgtaagaacaatcttggtaggattgcaattagaattttaatttttgaatagctttatgaaaaagaatataataaaaataagtttagctgcgttaaccatgtttgtttcgttaacgtcttgcgatagaaatttagatcaaacatcttcaattaatgaagaacagaaccaggcaatgaccagacctgaatcatttagacaggctatggatggagcttatacagctcttaaaggagtaggatactataatggagatactggtaatcagcttatcatgggtgatcttactactgataatttagttcgtacggcttctggtagaaataccaattctgcagcatctaatttcgagttttcttcagataactcacaaacaacaggtttatacagtgccgcttatcttgtagttagtagaactaattttgttttatcatatatcaataacggagtgttatcaggtactcaaaaaacaaatattgaagctgaagcaagagcattaagagctgcagctcattttgatattgtaagagcctattctcaaattccgactcaatctgcaggagctaaaaatgcaacgggaatttattattcagaaaactataatccttcgaatacaacatcatctagaaatctaactgttgatcaggtatatgataaaattatagcagacttattatttgctgttgataatatcacgcagaatgatgcggataaaggaagattaagcaaagctgccgtatatggattgttgtcaagagtaaacctttatagaggtgattatgccaatacaatcaaatatggtgagttggcattggggctttctccaagtattacaacattggataactttaccagaatctggaaagaaaacgaaggtttatccagaattacagatggtgttttgttccaggtatcaaatgcaccagctgaattgaatacagtgggagttgcatataaccagtctgtaccaagcattagatctgaatttgttgtggattatgatctatatactgcttatactgctaacgatatcagaaaaggagcttactttacgaccagtacatatagtggacaaaaatacaaccacgttacaaaatatgctggaaacggagggccagccaatattgtgccgatcaagtatcttagatctgctgaagtattattgaatattgcagaagcatattacagaacagggaatggtgcacaggctcttgttttactaaacaagctaagagctgaaagatatacttcatttacacctggtacagaaacaggacaggcgcttttagatgctatcttgaaagaaagaagactggagcttgcattcgaaaacgacagatggtataccttaaaaagattagggctttctgttcagagatcaggtaaaggagatctttttgacggtacaggaacgccggctgttgcacagaaccttccagccggaagcttaaagtggcaatggccaatccctatcactgctattcaggcgaatcctaatattaaacaaaatgatggttactaatcattattaaaaataaccccggagtttttacttcggggctttttttatatagactgttttatcaccattctgtcctgataacttttcggagttactccctccagctgcttaaatactctggtgaaataattcgtatctgaaaatcctgtctgaaaagcggtttccttgatgctggtctggctggccaacagctcttttgctctattgattctttcctgtaaaataaaatcattcggagaagttcccagctcatctttgaacattttaaagaaattggatttgcttacataagccagcttcgcaatactgtcaatcgacaatttctggtgcaggtttcttttaatataatccactacaaaacctattctggatttattcttaacaatatttttttctaccatgcttcttgcctgggtctgcatcagtctgatcagaagttccttcagtgcaaaatcggccatgatatccttttgagaattatcatccatagcaattctcataatattgttagtagcagaagcaagcgctttattattaaacagaaaatactcatccagctgaatattccattgtgaggcttcatccactttgggaagatgataattcagatagttgagagaatcttcaataaaatcgggatttaggcttaaagaaatacattgtgtaggtgtttcatcagcctccggaaaatcaatgaccatggtttcccctggtgctaccagaatgctttctcccggataataatcaaaataactggttttattatccagcttcatgtgttttttacctctcagcattgctgtaaatgcaatattttcaaagtgcagtcttacgtcaaaagcagccttgtgggtctcataaatattgaattcacaattgtttagattgaacttcgtctggttttcaacaagactcaatagttggttttccttacgtaattcaggagtatttaataaaatcttactattgttattcatttctaaatttttttctaaaggaggtaactcaaatatagaaaatttgacagtacgttgctgttaataaaatactaaaattaaacccgctgcactattttacactttttttatacgattgtgctatactctttcaggcttctcagtgtaatttggcattaacgaaaaataaaaacaaactaatatgagcactattacagaaccaagatctgcgacacttttacagcgtcctcagtttaaaaacagatatgataattatatcgacggaaaattcacgccccccgttaaaggacagtactttgatgtagtctctccggtggacggaaaaaactttactcaggtggcccactcttctaaagaagatttggaattggcagtagatgctgctgcaaaagcatttcagagatggaagaatacctcatctacagaaagaagtatcatcctgaataaaattgcagacaggatggaacagaacctggaataccttgcaacagtagaaaccattgataacggaaaggctgtaagagaaacattggcagcagatttacctctggctattgatcatttcaggtattttgcttctgtgattcgcgccgaagaaggatcacataatgaattggacaaagacaccgtttccctaatcgttcacgaaccgcttggcgtgatcgcacaaatcatcccatggaatttcccgatactaatggctgtgtggaaactggctccggcgttggcagcaggaaactgcgtggtcttaaagccggcagaaagtacccctgtttccattatggttttaatggaactcatcggagatcttttacctgcaggagttgttaatattgtcaacgggtttggagcagaactcggaagagcccttgtaactaatccgaaagtcgctaaagcagcatttaccggatctacagcgacaggacgtctggtaatgcagtatgctacagaaaacatcattcctgtgaccctggaattgggaggaaaatcacctaatgtcttcttcaattcagtaatggatgcagatgatgaatttttagacaaagctatagaaggagctgttctttttgcccttaatcagggagagatctgtacatgtccttcaaggttgctggttcaggaaggtattgcagatgcttttattgaaagagtgattgagagggtaaaagcaatcaaagtaggaaatccgctggacaaaaccgtgatgatgggtgcacaggcctcacagattcagaaagataaaatcctttcctatatccagctgggaaaagaagaaggggcagaagtgcttgtgggaggtgatgtcaatcatctgggagaagatctggaagacggatactatattcagcctaccatcttcaaaggaaataacagaatgagaatcttccaggaagaaattttcggtcccgtactggcgtttactactttcaaagacgaggaagaagctgtgaaaattgccaatgataccatctacggactgggagcaggagtctggacaagagatgcgcatcagctgtacaatattccccgtcagattgaagcaggtagggtatgggtgaaccaatatcattcttatcctgcaggagcacctttcggaggttacaaacaatctggaatcggaagggaaaaccataaaatgatgctcgaccattaccgtcaaaccaaaaacatgctgatttcttataacaagaataagctaggtttcttttaatattatttaggacgtgcccgattgccttggcttttcccagggcaaacggtcgggctatccagggctgcacttcgtttcattccgcaccggctcgttcctcgccgcccttactatccttcacgcaggaaaagtacctgtttagaaatgaagatacaaactaataattccaataactcaatccaaaaaagaaaatatgatcccaaagacaatgaaagcggcggtagttcagggctacggccaacctttaaaaatagaagaggtacccgtaagagaacccggcagatatgaagttttggttaaagtaatggcctgtggagtctgtcatacagacttacatgctgtggatggcgactggcctgcaaagccgaagatgcctcttatccccgggcatgaaggtgtaggtattgtagtcgcatgcggacccgaagcttttgtaaaagaaggagatgcagtaggagttccgtggctgtacagtgcatgcggatgctgtgattattgtatcaccggatgggaaaccctttgtgaagcacagaaaaatggaggttatagtgtagatggcggatttgcagaatacgtcattgcagattcaagatatgtgggacatttgaaatctgatgttaactttttggaaattgcccctattttatgtgcgggagtaaccgtttacaaaggattaaaagaaacagaaacaaaacctggtgaatgggtcgctatttcaggaattggtggactgggacacgtggctgttcagtatgcaaaagcaatgggaatgcatgttgctgccattgatgtagcagataataagctggaactggcaaaaaaattaggagcagaccttgtagtcaatgcaaaaaacacagatcctggagaatatttgcataaagaagtcggcggaatgcacggcgcattgattactgcggtttcacctattgctttcaaacagggaatagatgtgctgagaagaaaaggtaccattgctctgaatggcttgcctcccggctcttttgaacttccgatttttgaaacggtcttaaagagaatcaccgtaagaggttccattgtcggaaccagaaaagatttacaggaagccctggattttgccaatgagggattggtaaaagctaccgttactcctgcaaaactggaagatatcaatgatgtattcgataagatgaaaaaaggacaaatagatggcagaattgttctggatattgccggctcaaattaaatgatgatgtgttgtggttcccggtaaatattttaccgggattttttatacatttttaagttaggttcactctttatcacattaaatagaaaatggaaacaaaaatatcaagactttcagcaactgagcaggcgcttgaagtaattcgtacacttgaagaacaatacggccccctgatgttttatcaggcaggaggatgctgtgaaggtacccagccgcaatgtttcgaaaaaggaggattttttcccagaatgaacgacgccatgatcggaactatcaatggacacgaattctggatagatcgtgacctctttgaatactggaaatattcacattttactctggatgtggcagacggcttcgggcccggaggattttctctggaaactccattaggaaaaacctttaaggttcattacaggcttttcactcctgaagagtatgaaaacctggagcctgtaaagcgtagtgaataagataaagatttaaggcttttgagcaatatagataagctctctttcaaattcatatttgcctcttgaaattcctctttttaaaatgaaatattgactaattcctattactaatgcgattattgcgagcatatgatcctgtcggtctccttttatactgacaaaaacggcgcccaagcaaaaacatacgatgacgatccagttaaaaatctgaaatcctgatgggaaaaattctataaccacggatgatttaccgttcttatcagaaatagttccatgaaatataggattgcttctgtttatgtcaaataatcttgctcttcttttgattgtaaagctgttgccatcaatcattccgcggtattcaaaccgtgtgggaattgtagcatctttttccagtgatatgaaagtagtattggttttataagtgactttcattaatctctgtatgagttcagtgctgttgatatcgagatcaacagtgagactgttatataagccaatgcttttgagaagtgagttcaagggttaatagaaaatagttaaatgtaatcagacttttacaaacctactgacaaacatagccgcgactatgtctcccacagcattcagcactgttgctaaaggatctaccaaagttccaatgatcatcaccgcaggaatggcttcctgaggcagcttataaacagaaatcatcagcatttccccgatgtatccaccattaggaattccgcctgcgacaatactcacaaaaacggttattcccaaagctaaaagcaggttggcagggtcaaagaaatctcttccaatgatcaggaaagccacatagatcttaatgatagaagacatggatgatccgtttttatgcagggtggttccgatgggaattaccagattggcaatagaattcgggatccctatttttgatgcggcctgtaaattggcaggcattgttgcaaaactgctgcaggtgcttattgctgttaaagtagggtagatcgcattcgtccaaaagcttttcactcctttttgtccatttgccataaacgcataaatagagaagaaaacaaggaagtaaattatccctgcaatataatatagccccaaaggtttgccataaaatccaaaaagctgaggtcccaaagttgctacctgataagcaaaataagcccctaatccaatgggagccagcttcataaccaatagaaggagctctttcattacttcatatccggaggcaatgaaaaccctgaacggtaacccgtcttttcctgtctttcttgctgcaaatcctgtcagaaaagcaaatacaagaagagccagcatatttcttctggaaaaaagctctgtgaattcccctactgtaaagaaacttacaattctgttgccccatgtatcctcattagcggcttcagaaataatctcagaacttccggagattcctgaaaccgggaaaagataaactgcacaaatagtgaaaacagctgctgtgagaataaagaataagaaagtaagcgccatcacaaggatgatctttccgaatttggactgctgttccaaggaggcaatagaattggataccgcaaaaaataccaaaggaactacacttacaaaaagaagattaagaaaaatatcacctaaaggttttatatattccacaaagctgggagcaacaattccaatgatgcttccaacaatgattcctaaaagtaaaaatatgattccggagtagtttttcaatacatctttcatgtagagcattttatcaaagataggtttatttttaacattctgttatacaattttcaaacctaaaattcataaatttgagtaaacctcatttctatggcttatatagattattataaaattttaggcgtagataaaaacgcaacacaggatgatatcaaaaaggcctaccggaaactggccagaaaacatcatcctgatttaaatcccggcgataaagaagcagagaagaaattcaaagagctgaacgaagccaatgaagtcctgagtaatcccgaaaaccgtgctaaatatgataagtacggagaacactggaaacatggcgaagaatacgaaaaagcccagcagcaacagcaaagacagtatcagcagcaaaactataacggaggattctccggtgcggattttggcgaaggagaagatttttcagatttcttccagagcatgtttggtggagcaggtggaggatttggcagaagttcaagaggaagggcctccggaaaattcaaaggacaggatatacaggcagaactgaatttaagcttaagagatgccgcaaccactcaccagcagacttttgatatcaacggcaaaaaagttagaatcaccattccggccggagtgtatgacggacagcagatcaaactgaaaggacatggaaaccctggcgtaaacggaggacctaacggagacctgtatattaccttcaatatcccggcagatccggattttgaaagaatcggagatgatctgaaaacaaaagttgtgattgatttatacaccgctgttttaggtggagatgtaaaagtacatacccttacaggaagtgtaaatctcaaagtaaaaccggaaactcaaaacggaattaccgtaagattgaagggaaaaggttttcctgtctataaaaaagaaggtgaacacggagatctttttgtaacctatgaagtgaaactgccaacgaaccttactgaaaagcagaaagaactttttgaacaactaaaaaattcataagctatgagtgaaagaatatcacgggaagaactcgtaaaaatatataatatagaagtcactttttttgatgaacttgtagattatgggctgctgaacattcagattgaaaataatattcattacctgatgtatgaagaccttcctgatctggaaaaatttgccaactggcattatgatcttgaaataaatcttcccggtcttgaagtgattaataatatgctgaaaaagctggatgctctgaagcgcagaaacagggaactgatgaataaactttctgcaataaatgatcaatatgaagatatttaatgtagttttgtagcttttaaagcaaatcctacaattatgaatgaagaaaaggtgattaccctaaaaccggacagaaagacttttgaagatatttattttagcggtaatcagggaagtctgcttttttcacctactacaaaaagtaaaacgattgccaccattgcagcggcagttattgttttcatcgtttttctttttaaagatcttttaagtaaagaaagtgtaggaattttatactttttaagctttatttttttgctttgtgctgtttttctatcggtaagtgttaataaagtttcaagatggaagaaacaggtgaatcattatttaaatagcctggaaaaatgcaaagtgtatgaaatcctttttgacaagaacttttttacagtaaatatcgatggggaaaaagaaacaagtgaatggaaagattttgagtattttgacagtaatcatgaatttatttctcttgaaggaaaatacagttatatgtttcccagaaaagcaatgagcgaaagagaatacagtcttctcaaaaatatattgaaagagaaagtaaatatcaacccataaaataaaaacggagcaaaattatcttgctccgtttttattatttataaattagcttttttgccttttagcaattttgcttatttactttcttccagccatcccatttccttcatccattcatcattgtagatttttcctacatatcttgaaccgtggtcatgaagtaaaactacaattacatcatctttagtgaactgatctttcatctgaaccagtgaagcaatagcacttccggcagaatatccacagaaaataccttcttctttagccagttttcttgcgtagatagcaccgtctttatccgttactttttcaaagtgatcaatcacagacatatcatagttttcaggaatgatatcttccccgattccttctgtaatataagtgtatgcgtgatcataatgaagttcacctgtttcatggaattctttcagaatagaaccataagtgtcaaccccgattactttaatctccggatttttttctttaaagaaagttccgcatcctgtgatggtacctcctgttccggctcctactacaaaatgcgtcagctttccttcagtctgttcccagatttccggtgctgtagattcataatgagctgctctgttggataagttatcatactggttgacataccatccgttttccgtttctttagccagcctttttgaaactgaataataagaacggggatcagtaggctttacatcagtaggacaaacgattacttcggctcctacggcacgaagaatatcacatttttcttttgactgttttgaattggttacaaaaatacatttgtagcctttgatgatcgctgccagtgccagtcccattcctgtatttcctgaagtaccttcaataatggttcctccaggttttagtctgccgtctttttcggcatcttctatcattttaagagccattctgtcctttacggagtttccgggattgaaggtctctactttcgccaatactaatgccgggaaatcttcacctaacactttgttaagttttaccagcggcgtattacctatcgtttcaaggatattgtttgcgtatttcataatgttttatatgcggcgcaaagataaggcttttaaaattatctgcgctgtggataacatgtggataagttgtggataaaactgaaatcatctaaaagacaatcaataacttccaattatcaattatcaaattagttgtacttaatcgccttcaccggagaaattttactgatcaggtaacttggaataatcaaagccaatcctgatataataagaattccgactgaaatagatataatggcaattggattaaggtctaccggaacggtgcttacataatagttttccggattaagcttaatgattccaaagaatttctggattaaaatcagtcccaatcctatagcatttccgtacaaaagcccaggaatcataataatcagggtataattgatgaaggttgctcttatctgtgaattgcttgcgcctaatgttttcagaagaccaatagaatttgttctttcgataataagaatcagcagaaccataataatattgataaccaccacaatcagcatgatgatgatgatcaaagcgatattagtatcaaaaatgctgatccagtcggtaatctgcgggaatttttcagtcgctttttcagcgtaatttttgtaaccgatcagcttctcaatgtcaggaaaatctttgtcaatatcattaacgttcttcaggaagatatctataccgccgatttcatcaggtttcatatcctgaatttttcttgcatgattgatgccgccaataacaaattgttcatcaatgagcttgatatcagttctgtaaattccgatcactctgaatttacggtaaagtggtttttgatcggcttttaaaaatacggtaacaatactgtcatttactttaagatgaagatcattggctactttctgtgaaatcgcaacatcattgttgaaccctttctctgtcactttcggagtagtcccggcaataaggaattttttaaaccttaaactgtcaaaatcttttccgattcctttaaatatgattccggcgaaattgtgctcattacgcataattccggttactgttacatatttctgaatgctttctacatcaggaagttcttttatctttgcaatgtttagtccctgattatcaagaacagaagtattgtaagaggaatttgaccgtgtagatcttaccgtaatgtgtccgctgaaatctgccagcctctctttgatagcttttttggaaccaaaaccggtggctacggtaattaaggaaacaatgattcctagtgctacggaaagcctgccaatgaagatgataacccttgaaaggttatttttgttatctttggaaaatgctatttttctagagaaatataaaggaaatttcaagcttatgaatttagatttcaaaattaaaaatttacttctgatttgcctaatttttttaggagtattcaaccaatattattctcagactcaagttcaaccggattttaaaaccggtgcagatcagcctgaaatttatttgccattgctgaaaaacaaaacaataggaatcgtaaccaatcagaccggcttaatgagtgacagaactcatctggtggattttctggtaaaaaaaggaattaaaatcaagtctatttttgctcccgaacatgggttcagaggtgatgctgatgccggggcaaaagtgaaaaacggagtagatgtaaaaacaggaattcccattgtttctctgtatggtaataataaaaaaccaaaaccggagcagcttgccggaattgatatcgttgtttttgatatccaggatgtaggagtgaggttctatacttatatttccactttgtcttatctgatggaagccggtgcagaaaataatgtagagattatggtgctggaccgtcccaatcctcatgacggatatactgatgggccggtgttgaagaaaaaatggtcaagttttgttgggttgcatgaagttcctgtagtatacggacttaccataggagagtacggaaaaatggtcaatggtgaaaaatggctgaaaaatggtgttcaggctaaatatacactcatcccgatgaaaaactatcataaaaagcagcgttatccgatgcttgataagccttcccctaatttacccaatgataaagctatcaatttatatccaagcctttgcttttttgaagggactcaggtttctgtaggaaggggaacagatcttccgtttcagatttatggctctccatggacggaaaatcttccctatcagtttacaccaaaaccaagctatggtgctaaagatccattcctgaacgggaagctgtgctatggtgaaaacctttcgaattaccctaaagatctaagagaattaaatcttgaatgggtaatcaaagcatataagaattacaaaaatccccagcaggatttcttcctgaaaaatttatggtttgatactttatcaggaactgatgaattgagaaaacagatcattgccggaaaatcaatccaggaaatcaaaagctcatggaaaacagatctggaaaatttcgaaaagatcagaaccagatatgtggtctatgaagattaattaatcaaaattctggggcggatttttatcatttctgcccttgtttaatataaatagtcccacagtcagtccgacaacacctgcaaaagcagtcattaatgccctttgtaatttatcaggcagatcattcccgatataattcatcaaaaaaaggatcacaaaagtgatcgctaaaatgatcatatgattttttccaaatagcttcattgtcttattttaatttataagagatcattacgcctcctctgtacggaatgatttcaccacttttgttgaattcttttgccgaatcatagcgcaatcctgtagagcgatcatatcctttataaaatccctgagatgttccaacagttccataaatatcaagattccatcgttctgataactgaaactgatatcctgctgtaatacccagcataatattaaagcccttctgataaagattggtgtttaaaaggacatctccattatccttataaaaatatccgctatgccaataactccatttttgaagattataagctgcaaaaccaatattcgctcctaagtaccagtttttaaaagcttctttaaaataatatcttccttctacggaaagagagtagatctgtaattcatgtcccgcaaaagatttccatggtgaaatgaaaacatctccctgcagggtatatttgggactgatctgtttttccagtccaaggtttaaaataccaatgggagcaaataaagcatttccttttatgtataaacttttatcctgtcctccttgttcctgttcctgcgcacttaatgtacttactgacaggaaagctaaaatgcctgctgctaataatttatatttcatccggtatctaatgtttattttatttgctttaataattcgtctgccagttgagaatccttattcccctgaactgccatatttttagacatctcagcatagttttttgctgtttctttatttccggtaaggtaatagagtttggcaagaatataagtgttttcagaagtttctcccctcataacagatttttctgcccattcagttgcttttttcaatgatgacggtgttttcacatggtctgcaaatatccaggctgctctcagaagttcattcggatcaaaagtatctgagtttttataataatctaaagctgctttttcgtattcaggaaaattgctgttttgctcatagtagctcagcttggtctgattaagtttcttagcggcagcttcttttccaactaatggttcggcagctttcatgaaatagtcatcattgattttcttctttttatcatcaatagactgttctactatttttcccaatttcagctgagcatcaaattcattgtaagtttcttcaggaaggaatttaataatctcggcttttctggatgcaaaaacaggataattgatatcttctgatgattttacgaaataaagaagaaaaccaatctcgtcctttgtgagttcttctgttttctttttattctggaaatatctttccgaagcttttttggcaaattcataatctgagttggcattaagtttcatgatattgataagaaattccgggtctttttcaccaccggcaaagcggtccttaagagaaccttttttatttcctggtgaattgatatcctgagccatagctacaaacaggctctcttccatataccctgtatttctggaaaccagctcaccttcaccgttcaggaaaagataagtaggataggaacgtactccgaatttagaagcaatatccctgccttctcctttttccatgtcaaatcttgcattaatgaagttggtattgtagtaatcactcacggacttctgggtgaagacatttttttccatcattttgcacggtccgcaccaggaagcataggcatcaataaaaaccagttttttttctttcttggcttttgcaatgatatctttgaacggcagttcctgaaacgttatagattcctgagcagagacagcgatggcgcaaaaaatagatatcccggagatgatcttcttcattttcaaataagatttgtaggcgaagataattaattttcaaaatatagcgagccgaatctgcggagcaaaccatgatattaactaattttaagacttatagatacttctgattcttcagacttttataaaagtatgaggatataataaagcagtatagtaaaactattttttcttctttatttttttatgctcgtttccccatagttccagctgatccagaaccggaattaattttttgccaatttccgtaagttcatattctacttttgtgggcacttcagcatatactttcttgctgatgagttcttcctgctccattttttttaactgcaaagtgagcattctttctgaaatattgtggatcttatctttcagttcagaaaatcttaactttccatgtttaagatggtagcagatggagagaatccagcgcccgctgatgagattgacggcatatatttcagaacagctgtactccagcgtttttttattttcattattggtagatgattctttaatactcatacttacatttttgttcgttccggacaatcatttgttcacttggaaaacagaatatagatcagttaaatttacaaataaaaacaggagatgtactgcctgaaagtagttttatcacctatgtagaacaaaatatttaaattaatatgaattttgatagaattaacagtgatttaaaatatagtattgataatgttccttattcattagaaattgatgaaaatttgtttttgaataatccggaaattattcaagaggaaagaaaagaatttgtgaaagctcatccctttaagaagccggatcatattattgtgaaagatatttttattcccggttcagaagatggatatcaaatcagacttcatatttatcaggctgaacatttcagacctgatagagttcttctttactttcacggaggaggttatgtttttggattgcctgagcaagtggatgatcagatgttcgaaatagcagataaactcagtgcaaccattatatctgtcgattacaggctggccccccaatatcggtttccgatccctgtttcagatggtttcgatgctttacaatggattataaaacacggaaaacatttgggaatcaatcctgatgatattaccatatttggagcaagtgcgggaggacatttggcggcggccgtaactcaaatggcagcagaccatactattcaaaatataaaacatcagttcttgctgtatcctgttattcataacaggctgaatactccttcaatggaagagtttaccgatattcctctatggaataaaaattatgcaaagacagcctggctgcattttcttggggaggaaaataaagataaaagcattccatattcagacctgacctgttacaacaatttttcaagtttaccacaaactactattgttgcctgtgaattagaccctttgagagacgaggatatagaatatgctcagctcttatacaaggcaggagtgaagacagaactatggctgattccaggcgctttgcatgtgtttgatctctttaattcttccataaaagatgaatataataattttatgctgagcaggctgttcaaataaaatgtatgaaataaaggtcatcatacttacaacagttttctattgtagtgattattgtaggggttgctaaaaactgacggttaacggatatttaaaatatataaataattcactttacagtcctgaaatctttgttatatctttgcaaacgaataatttatatgtagaggaatccgtaatttatagaatttgattattaattttaagcacgctttatccaaaaaatccatttatattaccgctttatctgcctgcttcattgcagtggcagcatttgccgttttgagtcttctgattaccgaagacagccgtaagaataccgacgattttgccaagaaaacattcttccgaaagtatgaatctatagaacatgaattcagaaatattgaagattatcagtatctccttcgtgcattgatccagaaagacggattgaaaaactataaagactattcttcggttttaaatgacctgaacaaaaaaagaaatctgcttccttacagctggtattattatgaaaatgcagcttccggtaaaacagaaagtaataatccgttatccggtatttttaagaaaacaaaggataaagggcattctgttgttctcaaaaataatggaccggggcattttaaagatcttttgacgactcaaaaggacagtatgtattggataagctatgattctttggtcctgcccgataaaagcagattatattatggttctaccgtaagtcttgacgaccttcatcaatattttatcaatgttgacaaaagttccaatacatatgcctatgtttttaccaaagaaggaatctgtatcacccatccggagaagaaatatatcgggaagaatattttcgactttacagatatcaaacccaatgatacactgacccgccaaactgaagcagggtataccaagggaacagccatttcagaatatctgggtgtagaggtgacacggtttataaaaccattgaagaccgataattttgacggatacacagttgtgaatcatgtaaattttatcattgatgagaacctcaataagataaaaacttatactgtttatattttcctggcagcgttattccttattgtaactgtttttattttatttcagagggcgaccagtcttgcttatcaggaaaaagaaaaaatacagtcggagaagaatttactgttgatagaaaacgaaaaaatgcacaaagccgaagtgatcaatcagcttcagcagcttaaaaacaatattaatccacattttcttttcaattcactgaattccctttatatgctgattgggatcaataaagagaatgcccggaaatttaccatgaatctttcgaagatttaccggtatctgattgtacctccgaaagaaaatattgttccggtttctcaggaaatcaaatttatacagcagtatatggagcttctgaaaagcaggtttgatgaagagatgaagtttgaactgattatcaatgctcctgcaagcctggaaaaaaggattccgtatttatcccttcagatcgccacggaaaatgcaaccaaacataatatagcaaccatagaccaacccctggaaattatcattattgttgatgaagacggaattacggtaaagaacacctggcagcctaaaacagacccggtacagggtgagaagttcggaattgattatttgaatcagatttacgggtattttaagaataatcttcttcatatttctgtagatggtgaatatttcatatgttttttgcctttattgaagtgaaaataaaaatccattcactcccgaaaaatcaccattcactccctaatattatatatatgattcatgatacctatagctttgcggctgaaactaagatatttactatttggaatgaatcggactattttaatgaagaattacaggctcgcactgtatctcggtcttgctatggcctcaccaatggcagtagcacagaaaaaagataaagatacggtaaaggtcaacaaagaaaaaacggataagacagaaacctcttcctccaagaaaaccaaaaagattgaagacctgatcaaaaaaggaacctataaaaaagggctttttaataccattcaggtaaaaacggatatttattttgagattcctgacagcttaatggggcgccagtttttggtggtcaataagctttctcaggtaccgatgcaggtgaatgaagcaggtttaaacaaagggatgaattatgaaaataaagtcatctctttccaccgtgatcctatagctaaaaaagtatgggtgaaaactgttgtacctaaggtatcatccccaaaaaatgatgccattacaaaatctgtaaaagacaatttttcagaatctgtcattgaagtctttgatattgaagcacaaaacaatgactctacagctgtagcgattaaagtcaataaagtttttgacggaaatcagaaaagctttaatgatgtattggccaatgtaggattgggaggatctgtgaagtcaagcctttcttatatagaaggagtaaaaacttttcccaagaaccttgtggtaaagtctcaattgtctacttctgtcaatgaaggtggcgtagatcttccggtaacattaggagttaccaccaatctggttctgctttctaaaataccgatgaaaccaagagtagcggattcaagagtcggatttttctccgaaaaacactggtcatttaatgacaaccagcagaaaatggatgagaaattcttcattaccaaatggaatcttgaacccaaagatgaagataaagaaaaatacttaagaggtgagctggtagagccaaagaaaccgattgtttactatatcgacccggcgacaccaaaacaatggcgtgagaaaatcatcgccggagtacatgactggcaggcggcgtttgagcaggcaggattcaaaaatgcagtgattgcgaaaatgccggatgagaaagatgaagattttgatattgatgatgtaagatattctgtgattacttacgccgcttcgccaaagtcaaatgcaatgggaccttctgtagtagacccgagaagtggggaaattatcgaagcagatattatctggtggcataatgtaatgacttctcttcatgactggatgagaattcagacagggcctattgatccaaaagcaagaggaaataaattcagtgatgaacatatgggtgaggccatccgttttgtttcatctcatgaagtaggacacactttcggactgaagcacaatatgggagcatcctttgcttttcctgtagaatcgcttcgctccaaagagttcacagacaaaatgggaggtacagctccttccattatggattatgcccgttacaattatgtagcacagccggaagatggagttacagctatcactccgaaaattggcctttacgataaatatgccatagagtggggctaccgttggtatccggatgaattcacagagaaaaaagcgctgaaaaacttaattgaaaaacatcaggatgacccgatgtatttctatggagaacagcagagctatcttgaaaccattgatccgcgctcacagtctgaagatttgggagatgatgcgatgaaagccagtgaatacgggatgaaaaacctgaaagtggttatcaataatcttttacaatggacctatgaagatggtaaagattatacagatgccggaaaactatatctgggagtaatcgggcagtgggatctttacacaggtcatgtgatggcgaatgtaggaggaatttacctgaacaatacagtttttggaaacaaaaagaaagcttacgaggcggttcctgcagaaattcagagaagagcggttgattatcttgttaaaaatgctatcaaccttccggagtggttattctttaatccgattacagaaaaaacgtacccggtaaaagattcgccaatgggaccatttgagcagacgccgtatacccttgcaagaggaatgcagtatgcgaatatctattctttatttatggatgaccggttacttaggctgcttgaaaatgaattaaaacatcagatgtccggttcaaaagaagaaatctatacggttgagaatttatttgatcaggtaagaacagccattttcagtaaaaaaggaagtcttacgatgcttgaaaaaatgactcagaaaaattatgtggatgctttgattgtttcggtaaacaaattatttgagaaaacggcagtgaaaggattgaaaacagatgataacctgaatatcccgaccatctgtaattttcatgaagatgatcacggtttgagaaatatcaattattcatctatgaaaagagtatctgaggttactacatacaagagagcagaacttcagaaagttctggatttattgaacagaacaaggtacagaggtgatgatgcttcgagagcacattacacagatttaatcattcgtatacaagaggctttaaacaaataaacggcaatgaaaaaaactctaatacttttacctcttttggctgctaatatagcaatggcccagcaaaagaaaaccatcaccgggaaaatagaagatgccaatacatcccatattatcagcggtgcatctataaaaatcgagacacagtctgtgtctacgaaaacagaactggaaggaattatcgaaagtgtatcagtaggtacagtgactgataaggacgggaaattcatactggaaatccctgccgatacaaaatccgtcttggtaagttttccaggctatgaatccagggtcattcagcttaatgaaggacaaacgaattataccatcagactgacttctgaagtttcagataaaaataaaatccaggaagtaattatcaccggttaccagaaaattgaaaagcgcaagcagacttcagcggtttctactgtgaaaatggacaacatcagccaggctggtgtggccagtgtagaccagatgctggcagggcagattgctggtgtggcagtaactcccgaaaccggtgctcctggcagtcctgcaaaaatcagaatcaggggtacagcttctctttccggacctcaggatccgctatgggtaatcgatgggcttccgttggaaggaaatgatgtgcctaactttactgataaagacaatattgaccagcttcagaacttctctattgcaggtttgaatcctaacgatattgaagatatcaccatccttaaagatgcggctgcaacggcaatttacggagcaagagccgcaaacggggtaatctccatcacaaccaaaaaagggaaaaaaggaagcttaaaactgaatttctctgcagatactttcgttacagcacgccctgattttgataaactaaaccttttaaatgcttctgaaaaagtagatctggaactgatgcttgccaaacgtgcagatcttacttaccgtgcagataaaggagaagtgatgagaattctgactcagaacaaccagcttgatgttttcagaaacggtggttttgacgcgttgaattcattcacccgtcagcaaattaacggtttaagaaacaacaatacagactggggcaaactgttgtacagaaatgccatcaacaaacaatacggattaagtgtttccggaggaagtgaccgtgcagattactatttctccctgggatactatgatgaagaaggaacaactatcgggacaggttttaaaaggtataacctgactttaaaaaacaattacaaattaagcgataagttaaatgcaggaatctctattttcggaacacaaagtgaacgtacatcttttgtaacggatgctgatgcttcaataaacccggttaactattcaaggaatgccaatccttacatgaaacctttcaatgcagacggaagttacaattatgatagagatatggatggttttgaagaccgttatattcctttcaacttccttgaggaaagagaaaataccaattattcgctgaaaaataactctttgaaaggtattttagatttagaatataaagcttcaaaaagtttaaggtttacctctcagttagggattcagtatgatgccaacaaaacagagaagttcgcagcagagaatacttacttcaccagaaaaatgaaagaaaatacccgttattacaaagacggtaaatacaattactttctgccggctggtgctgtaaaacaaaactgggataatgatttcttccagtacaactggaaattgcaggcggcatacagcacaaagatcaataaacatgagattgatttgatggccggtacggaaatccgtaaaacagaagataatacaacgattacaagagctttcggatatgatccgaagaccagaagagctacggccattgttttcccgaattcaagttttgcagcagataaaagatatgaaacctatcgcgaaaatcctccaatagagaatgcttatgcttccatgtttgcaacagcatcttatacttacgaccagaagtatacattctttggaagtgtgagatatgacggaaccaatcttttcggggtaaataaaaaatataaatatcttccgatctgggcagtttcaggatcatggctggtaacgaaggaggattttatgaaaaatatttctgccatatccaaccttaggcttagagcatcgtacggtcttcagggaaatatcgacagaaatacatcaccattctttatcggtgaatataacgatgcaaccattcttccgggaggaaaagaagcaattattaatgttctcagccctccgaacgataaactgagatgggaaaaaacaaccaataccaacttagggcttgatttaggattgttcaataaccgtgtaagccttaccgctgatgtctacagcagaaaaggtacagatatgatcagtatgaaggaaacccctcttgaaaccgggttcgaatatacgatgatgaactggggaagcttaaccaacaaaggttttgaactggcaatatctaccagaaacatcaatcatgataatttcaagtggacaaccactatcaactttgctcataacaaaagcagagtgctgagtgagcagccgcgtgataactcattgcttccgtcaagagaaggacttcctgtaaatgctgtttttgctttgaaaactgcaggaatggatgaacatggaaacccattattctggaaaggtgatcagaagatttcagcagcagaattctttaagttatatgatgtgtatgcagattttcttccgggacagcttgttgatacaaaactttcaaatgctgagctgagaagcctgtttacctatgtaggagacagagacccgaaatttaccggagggattatcaatacctttaaggtaagtaactttgatcttacaatttctgcgacattcaacctgaagcagaccgtaatgagaacaccttcttaccgaggaatggaactggacaggggaagaaactatacaagagatatctacgaagcaggaaattcacttccgggcattacgagtcccgatatggatgctaatcctgatggatggatggccaataaatggtttgccggaaaccgttcaaatgcgtacagcttattggatgtttgggcgaaagagatcagctacataagaatcagcagtatccgtttaggatatacgctacctaaagaatttaccaatcctatggggatttccagtttgagactgagcgttgaaggacgtaacctttttgttttcagtaacggatataaaggatatttcgatccggaaacgtatggtaatatttatgcacagcctatcaccaagtcggtaactgtaggatttaatgtttctttttaaaatttgagaaaaatgagaaaaattacaacaatcatagcactttcagcaatcagtttaatcaatatcggatgtgacaggtttctggacattcagcctgaaggaaaaattattcctgaaactaccgaagattaccggaaagttcttacctctgcctattcaaaatatcctgttcacaaatctctggtagcccttcgtaccgatgaggtgaatattgatgataattctacggattttatctcctaccgtgagattgccatgtggaaagattcaaataatgatcaggcctctacggaatttccatgggtaagcttttattctgtgaacttctatctgaatcagattattaatgaaggaagcaaaaccatgcaggattctcctgagaaaaaccagattttagcagaggcttatgcgcttcgtgcctatctgtattttgatatggtaaatttatacggaaagccatacaacagtgccacggctgctaccgacagaggggttccaattaatcttgaaattgaccttgaacaggtattgaaaccatcatccgtacaggaagtgtacaatcaggttcatgcagatatgaaaaaagcagaagatctgatggttgagcagaagcagccactgggagtcaattacaggttctcaaaaactgcattgctggcttttgaagcaagaacagctctatacgaaggagactggaacaaagctttaaactatgcagatcaggtactggcggtaaaagcagatcttgctaatttaaataccgtaaatactccgcccaaccattatgcttccccggaatctattatggctttggacaatacctgggataactctattaagaatttatcttttgcatctccggagcttatttcttcatacaatactacgaccgacagaaggcttggcatgtattttgaaaaaaacggaagtaagtataaagtgatcaaaggagggagtttagaatttaaagtgtctttcagaaccgctgaactgtactttataaaatctgaagcattattaaagttaaataaacttaatgaagctaaagaagtacttctgaaagtagtaaaaaacagatacactccggacggatatacttcagtacaaaatgcagtgtcctcaatggattctacagcatttatgaactttatccttgatgagagattcagagaatttgctctggaagggcagagatggtttgatttaagaagagccaatcagaaaaaaataagccacaccatcagtggtaaagaatatattcttcagcagaatgatccgcgatataccattgaatatccaatgagcgcgaagaagaataaccctaatttataaaacttcatatcaaattcaatacagaggaaaccgcttgaacttaattgtttcagcggtttttttgtacttttgcatcgttatgaaaattgccattatagaagatgagctgctggctgtgaattatctgaaaaatcttttggatatacagagcatagtccctgttacagagactgttattcttcgttccaaaaagcaggcaattgatttttttgagaaagattcagcagatcttatttttatggatatccatcttggtgacgggatgagtctggaaatcttcgaacaggtagaactttttaccccggttattttcattactgcatttgatgaatatgctatgagagtcttcaggcattttaccattgattatcttctgaagccttttgaagaaggggatctccataaagctttacagaaatttatctccataagaaacaatttcgaccctgaaccggtacttaaatctatttcttcattaagccagacagaaggtgaggtgatgaaacgcttcatggtaagagaagggaataaattaaaatcaatagacgaacataacactgcctacttttttgcctccgggaaataccttttcctgactactaaagatcatcagacttatatttatgatgatactattaaagatattattcagaagctgaatcctgaaattttctttaaaataaaccggaaatttattgttaataaaaattcggttacggaaatcatcaaacattcaagccagaaagtagaattgaaactttctcctgaaccggaagtgaatacagaagtttttatcagtaaaccgcagattgccgagtgtctgaactggctgaacacttaatactcattttaaggggttaacaaaaaacctctgaagaacagaggttttgaggtgctttataaatgcttagtactaaatcatcttcatatatctgagatacgcttctataaccggcttattaaaaatggcgggtctgatatctgaaccttctaaaaaacgttccgtattgctgcttttaaaataataggtgttttcataagcttcaaccagcgattttccttcgtgaacatcatcagaaaacaaataaagcagtgcatagacaggcgtttcatgatttcgtttccattgttcaaaccaggtttcaaaatctaaacttttcatttccagtccgcagtaatcggtgatacggacacaaaaatcggtaagagacagatcatgctccggtaaaggattcagattaaagttgagtccaattgcctccggattctggctgatgtgagcaatagatttgcagacataatctacagtgattacttcatcttttaatcccattaccaatggaaaagcttttagttcaatacaggaacgcatcagtgaactccaccattgatttaatggagtggcaccggtttccccatggcaaactacaaaccctaaacggaaattgatcaggggaaggcctttggcacgggctttcgaagccatactgtccattacccatttgcttctgatatatcccatatctcggcatacggcaggtaagttttgttcaataggatcatcctctgtcatccatgtttttcctgtaaagcttcttccccagctgtaaactcctatagatgaagaaatgatcaggaattttgttttttcatgaactgccagatgtaatatatgcgccatgccgtcaacatttggttttttgatgtgttcgtaaggttttacatagcttacatcacttcccatgtggtaaattacctcaatgtttttaagaagatattcatataatttttcatcaattcccaatttgggctgggtcaggtcacctaaaacaattctgattttatcctcatactctgttttccatatcagtttgaattttaaaaaagtacttttaatacgttccagacccaacgtttcattctcagcccttacaagacaataaatgacagcattcggattccggggaatgagttcttccaaaagatgggaaccgacaaaacctgtaacacctgtcaggaaaattgtagaaggattagataaaatcttaggatcaggttgtatggtaatttcaaaatcaaaaggaagttgggcatcctttataagctgttgtcccacaagacgggctttctgttgctggctaagctgattttgtgccagccgggtttctgcttcctttacaaaaagagatatggttgggaactgatacagctccggaagtgatattcttttctggatgttaaatggtaaaagggcgtgcagatgtcctagcatcagagaatgtccacccaattcaaagaaattatcattttcatttatttcatcaaggttcagtaaatccatccatatttcctttatttcctgtttaagatctgaggtatctactttttcctttgccttttttgcggattgctgtaagggaacatgaagcttgctcttatcaatttttccagtaatagtcaagggaagtttgtcatacaaaataattttttcaggaagcatataagttggaagactttgtttcagtcttgcacggatatcttccgcagtgatacgttctttgtctgtttcataaagttccagaaatgcaacaagaacaggctgtccctggtctgggcgatgtacttttacggccacattcgcaacctgtgccagttgtcctatatgatgttcaatttcttttaattcgattctgtatcctcgtaattttacctgctcgtccagacgccctacaaactcaatgttaccatctttccgcaagaatccccgatcgccggatttgtataatctgtagctgattccgtaatcagactgcatccattcaggtgcatcaatgaatacttctgaggtttctgccggcttattgatgtacccttttgctacctgcctgccaccgatataaatttctccggtaataccttcattcacatactccatatcttgattgagaatatgaatatgggtaccctctaaaggttttccaataatatgaggattggtatcatcctgaaaatgatgggtgataacacctacggtagtttcagtaggaccatatacgttaatgagacgtactctgttgcaccagttttttactgtttgttctgacggtacttcacctgcaatggaaagggtatggagctttccgatgggaagatttattggtagtgtgctcaatacagccggaggaagaaaaggaacaacttcaatctggtgatcaacaataaagtccagcaaaggttttccaacaattttattatcaggatacagaacaacggttgctcctgtaaacaaaggaatccaaatatcaatgatagaaacatcaaatcctgctgaactgaactgaagtgtcctgtctttagcagaataaccccaaagttttgtgaaagatacaataaaagcataaaaagcctcatgatgaatttctacaccttttggaattcctgtacttcctgaagtataaataatataggctgtctgcttcatatctatatcatcggggctgattgtaatccgatctccggcaggttcattaattccgtggctcatattaatcaattgagcctgtgtttcttcaaatttgtcaagataggaatcttcagtgatgacaagttcagcttgtgaatcttcgatgatcattttaatcctgttttccggcaattgtccatcaataggaatatatgctgaccctactttcagtacagccagaaaagcaacaatacgttcagtagattgtgacatgcagacagcaatgggagttcctttttttaattgtaaggacagaagataagcggccagttgatccgattggagatccagttcttcgtaggagaggcttttactttctgaaataattgctgttttttcgggtaaagagtgacttacttctttaaaaatagaaattacatttttaaactgactttgttgaatgctaaattcattatcagcattttcgggaatgattgaatgtttcatgatttgttttttgggattggtgttgttatgattatttataattgtttatgtttaaatataattcaattatcttaaataattcctttttgtgtgattaaatgtttttaattttcttatttagatgcgaaattgtcggttataaggaagtcggagagattaagaattgtaattttgattcagaagatagtatggaaatccgaaacgattagcaatgaatataagaacaaaaaaacctctaaaatgaattagaggttttgaagtggtttctccaggaatcgaaccagggacacatggattttcaatccattgctctaccaactgagctaagaaaccatttatgtttttgtttattacttcgttgttttaaagtgatgcaaaagtataacattttatgataccgcgcaagtattttgttttatttttttaaagaaatatcctgatatagcttatttttgatttcaatgtactgttcatcagtattttgatagattattatttttttcagtttttcttatattttactttttcagatgataataatttcccattgcaccttagacagggaataaaaagcttgactttagaaatgcaaaaactgtagaggtatttacagaacccaaacacagtctctagaaacagtcctgtgtgatgaattagaagagaatcggaggtaaaattgtatggaatgctgaaagtttactttatactagtctagcaaaatatagagctatcatttcagtattcagaaaacaattattacagaatatctgatttaaaagatagattgatgagagttcagggaattatagagcatgaataaaaaaaacaaaaaaacctctgattaatcagaggttttaaagtggtttctccaggaatcgaaccagggacacatggattttcaatccattgctctaccaactgagctaagaaaccattatatttttgtttgacttacttcgttgttttaaagtgatgcaaaagtagtaagttttaatatacaaagcaagtattcatcgtactttttttgaataaagttaaaaacctactgattatcagccggattattttcctgctcctttctgatctgttcgctcatctcttccaataccggttttatcgtgttttccggaagatcactgattcggatatacatcaatccatcgatcgcatcattaaagttgggatccacattaaaagcaattacttttgcgttttgtttgatgtattttttgatcaggacaggaagtctcagttcaggctcaagatcatcaataatcttatccagcttatttaggtcagattccatttcctcaaagaagatgtttttatccctgtcacgaagctttaccttatactcattccttggagtgatatattgagctacagcagaatcaaaataattggagcgcataaactcaatcatcagagactttgagaattccgagaacttattcgagatgctcacacctcccataaggaatttatggtctggatttctcaggcatacatgtacaattcctctccataaaagaaagagtggaagaggtttttgctgatattcctggcaaatataggcacggcccatttcgattacttttttaaagaaagggtggatgtcctgctcaaattcaaataaagagcttgtataaaagcctttgatgccatatttcttcattacctctctacccagtgccattctgtaggctcccaccagttttttctcaccattgtcccaaaggaaaaggtgatgatagtgtttatcatattcatcaagatcaaaaggaaggttacttccttcacctacagcacggaaggtaagttctctctgacgtccgatttccctcatgatagaagggatttcctcataagtcgtaaagtagatctcgtaatttccgttactgaacagcattttgtcagttcctctcaatttatcaacatcatttatgatatcttcaagaggagtttcgtcaataatattctgaacaatattttcttccttcaataaaggaaattttacagataagttcttaagattgatactctgggcaagagattttcttttctcataataagatttcatcatataaaccttacgtttcagaaactctcccaattcctctatcgtttccatatcatccattgcctttacggtaatggggcgcccaattctgattctgataggtttttccctgtcattcatcatttctgcgggaagcatcagggtttgtaaatttggatgaagtttggctacctgataaaaaagccggctgtttttggcatggaaatacattggaacgacaggtactttagccattctgataagcttaagtgctgttttttcccattccttatctaaaatttctccgtacggattatttttattggaaacttctcctgccgggaaaatacctacgcagcctccgttttgtaaatgcttgagtgtttcacgcattcctgaagaactactgtaagcatcttttctgttttcaaaaggatttacagcgattacatacggctccataggtttgatcttttccaaaaggaaattccccattaccttgaaatccgggcgaacctctgtcaggatcttgcacatcaggattccgtcaatagcacccagcgggtgattggaaaccagaataaacggtcccgttttcggaatctttgccagatcctcctcaaaagctacgtagcttaggtttctttctctcacaaatgagtcgaaaaagtctttgccttccttgtcttttaatttatcgtataatttatttacttcatttattttagcaatgctcatcacagcagatgctaccgggttcttaaggaacccgattttgtttaagccggaagctttgatcagatcgtttttcgaaattaaactcatgtgtgtttagtcgcaattaatattattgtgttaccatttgaagagtattcttggaaatttgttccaataatacatttttttcatggtaaaattgatcaatgtgatccttcttcgcatttcttactgtgaataaagatacatttttaattgcttcggttttaaaaattttttgaagctcttcgttgagctcatcaatatgattaaacttgtcttccaggcacaatgccagggagattgcagaattctgcattaaggaaactttaattttatatttggataaatatccgaaaatcaaactcatatggtcttccgcaatgaaggaaaagtctcgtgtagagattttcagaaggtcctgattttctttaagaatataagtttcctcttgttggtttttttcagaagcgcctacttttgttccctctttggtaggatctacgaaagattttacataaaaaggaatatttttttgctgtaaaggctgcaatgtcttcgggtgaataacacttgcaccgtaataagccatctcaattgcttcctcataggaaatattggaaagcagctttacatcactgaacttccttggatctcccgtcataactcccggcacatctttccagatggtcatcgcttctgcatttaagcaataggcaaaaatagcagcagagtagtcagagccctctctacctaatgttaccgtaaaattattctcgtcagatccaataaatccctgtgtgacatagcagatttcaggattaagatttgaaataaattcttcagtctttgcccagtctaccataccttctctgtatgaattatctgtctttatataatccctggcatccagccattgattggtaaactggatctcattcagatactcacttacgatttttgtagagatcatttctccgcagcttaccacctgatcatatacaaagttgtagttgggggacttgtttcttcttaaaaatgaatcaatatcatcaaaaaagaggttgatttcagcaaaaaccgcgtggttttcagggaaaagtccctccgcaatctcaatgtgtttttgttttatcttttcaatttcagtttgatagttttcttttttgaaataaagctctacaaccttttccaactcgttggtcgttttgcccattgctgaaatcaccagcaaacatttggcaaatccctggctttccagaaccctggacacgtttttaacactgtcagcatcttttacagatgctccaccaaacttgaaaattttcattaaattgttaaaaataaaattgttagataaaaaattacatgagttttttacggacgtcaaaattataaatttacaacgagatatgaaatagcccggcagggtgatagaattaagatttccttaaaaatcaacaattcatgaaataatctgaattttttatgaacatgaagctgcaaatttggaggccggattttcaataatatcctggtattatgttgtgtttggcttgtatctttctgaaatacaagggttaatctcttttttaattaaattttcttaatgcgataaattttccgaaatttgggcaaaacgtaaaaagaaaaatatgtcaaatcaaccattacagactttaggagaatttcttatagataagcaggacgattttcagtattctacaggtgaattctctcgtcttctaagtgcaataagattggcttcgaaagtggtaaacagagaagtaaataaagccggaattgtagatataacaggagctgcaggaaatcagaatattcagggagaagaacagcagaagcttgatgtgatcgccaacgaaatttttattacgtctttgtctcagagagaggtggtttgtggaatcgcatctgaggaaaatgatgactttattgatatcaaatgtggtgaaaacggacatttaagcaaatatgtggtgctaattgatccattggacggatcttccaatattgatgttaatgtttctgtaggaactattttctccatctacagaagagttacagaaccgggaacacctgtacaactggaggactttttacagaaaggagttaaccagattgcagcgggatatgttatttacggttcatccacaatgatcgtttatacaacaggaaacggagtaaacggatttacactggatccatctttaggaacttactatctttctcatccaaacatgactttcccaaaaacaggtaaaatttattccattaatgaaggaaattacatcaagtttcctcagggagtaaagaattacctaaaatattgtcagatggaagaaggtgaccgtccttatacatcaagatatataggttcattggtagcggattttcatagaaatatgcttaaaggcggaatttatatttacccttcttattcacaggctccaaacggtaaattaagacttttatacgaatgtaatccaatggcgtttcttgctgaacaggcaggaggaaaagcaacagatggattccgaagaattcttgaagtggaacctactgaacttcaccagagaatcccattcttctgcggaagtgtagagatggtagaaaaggcagaagaatttatgcgaattgacagcgtaaaataatggaagcaaaatatctgaaatatttattacaatttaaacgcccgagtggaacatctcgaggcgttttgcttgataaggaaacctttatcctgactgtttctgaagagggaagaaaaggaataggtgaatgtgctgttttcagagggttaagctatgatgacaggccagattatgaagaaaaactgaaatggttgtgtgaaaatatcaacctggatgcagcttttctgaaagaagaactgaaagaatttccatccatctggtttggttatgaacaggctgtactgaatcttagaaatggaggaaatctttattttcccagtgaatttaccgaaggaaaatctgccattaccatcaacggtttgatatggatgggagatgcagcgtatatggaagaacagattcaggataagctgaaaaaaggatttcattgtattaaattaaaaatcgggtttgattggaaatctgaacacattatccttcagaaattaagagagaagttttccaaagatcagttggaactgcgtgttgatgccaatggaggattcagtaaagacgaagcgatagttgttttgcaacagcttgctgatctacatattcattctattgaacagcctgtcaaagccggaaactgggatgatacggcagagttatgtgcaaaaactcctattccgatcgcattagatgaagaactgatcggaatcattgaccctgaaaaaaagaaacagcttttagaaaaaataaagccacaatatattattttaaaacctgcattggttggaggattttccggttcggatgaatggatttcccttgctgagaatcagaatatcggttggtggatcacatcagctttggaaagcaatattggattgaatgctattgcccagtatacttttaccaaaaaaaatccaatgcctcaaggtttaggcactggagctttatttgttaataattttgaatccgttttagaacttaaaaatgagctgctatggttcaaaatataactgttaaaagttaattagcataatggtggaggcgaatctggacatgtagtttgcctacaatagtcctgcgcttatgatcacagcacatagtaaaggaatgtcaactgtgacatacaagaggagaaggttttctccttttgcggttttggtttatctcattttatgataataagtattaaacccttttatagtttatcgaatatggatttggatagtatcagttttttaatctgcaatcccttcctgttcagaatatttgaattttttttaatccggtctgtaggaggacctggcagtaatagatcgaatattttgttgatttagaggttgttacacaattaaatcacatctttcacgaaaatagctttcttgatatagtttaatatattagaaaacctttttttaatctgtcccataattaaaaattgtaattccctaataaatgaattagcaatcattgtgccatactgctgttttttagttaatttttaacgtataattcattttttagggactattttaattatttattaagaaataattgtgaaaatgttttcactttctttagatctgttggtaataagatttctgtcgattccatataaattctggaagatatcattttgaacctgagagctggaaaggtatccccagtgatttcctacttcatatttaaagctgtttagcagatcatcttttacaaacgtacaatcgataacagaaacaatatctttatactgatcaatgtcgctcggaccatttttaccaagccttggagtgaggatatttttcgtaaactgagaagctccgagaataatatcctgtctgtttaaataaatggaaatcctgttggccaataacggaagcttattaaatgaatcctcggcatcttcaaatactttatagctcacatcagcatttaaaaggagaacctggtctataacacgaagaatattttctcttttgaggctgtataacatactttgaagaactctgtttcccatagagtgggccataagatgtattctttgattacagggtgcaagatcccggttggaaaaaatatcttttaaaaactgagtgtagaaataaaacaatctcatcagggatgttccggaattgatacttgacgccttatcatcaaaatagcttaacggaataatactgctggaagctggccagcttacgaataaaatatgttctacaggagatgccggattatcaatgaatattttttttagatccagaatagcctttaattcatcatcaaaatcatataaataaccatggatgaatatcaggacgtcacttctgtctttagtggaagacatatttttgtacaattcataaaacatcctttgggttccgcccagattattggcagtaagggatgattttctgattcctttttcattcaacagaacttccagtacttcttcatacccttgcttttcaggttcagaaaaaagcttgtaatttaaaatatttctgttggtatagtcctttttctttttagcctgtggagagagttcctgataattgtcaaaatcacattttgcgatcctgaaattcggaatcgagtattcatcattggaaaaagagtccactttttcgcctttatgccggacaattttccggttgcttaagatataaacagccatgatggttattggttataacggttttagaattcctaaattagtgaaaaatattgaattccaaccattaagggttttaaactatgacttttacaaaagcttatttttccgtaactttgtaaaacttttttgctaaaaacaaaagctactttaatggaagaagaaaaaaaatcactcaattttattgagcaaattattgaagatgatctggcaaacggtctgaaaagagatcagatccgtttccgttttccgcctgaacccaatggttatctgcatgtaggtcatacaaaagcgatctgcatcaactttggactgggcgaaaaatacaatgctcccgttaaccttcgtttcgacgatacgaaccctgaaaaagaagagcaggaattcgtagattctattatgaaagacgttgaatggctgggtttcaaatgggataaagttttgtacgcatctgattacttccagcagctttacgattgggcagttcagttaattaaagaaggaaaagcttacgtagatgagcagccgtctgaagtgatcaccgagcagagaaaaaatcctacagaaccgggaattgaatctccatacagaaaccgtcctgttgaagaatcattagatttattcgaaagaatgaaaaacggagaatttgaaagtggttcaatgtctcttcgtgcaaagatcgatatggtttcgcctaacatgaatatgcgtgaccctgtgatgtacagaattttgaataaacctcaccacagaacaggtacagcatggaaaatttatccgatgtatgactgggcccatggtgaatccgattatatagaacaggtttcgcattcactttgttctttggaatttgaaaaccacagaccgctttacaactggtatttagatcaggtttacgaagaaggaaaggttaaaaacaaacagagagaatttgcaaggatgaatgtttcctacatgattacttccaaaagaaagcttcaaagattagtagctgaaggggtagtaaccggatgggatgatccaaggatgcctactatttcagggatgagaagaaaaggatttacaccgacttctatcagaaattttattgagaaagtaggagtagcgaaaagagaaaaccttatcgaaattcagttgcttgatttctgtgtgcgtgaagacctcaataaggttgccaagcgtgtgatggcagtggtagatccggtgaaattagtaatcgaaaactatccggaagacaaagaagaatggttggaaactgaaaataatccggaacaggaaaatgccgggacaagagaaattccgttctcaagagaattatatattgaaagagaagacttcaaagaggaagcgaacaataaattcttcagacttaaattaggcggagaagttcgtttgaaatcagcatatatcatcaaagcggagagagtagaaaaggatgaaaatggagaaattactacaatctatgctacttatgatgaaaaaagtaagtcaggaagcggaacagaagaaagcttaagaaaagtgaaaggaactttacattgggtatctgcaaagcatgctattccggtagaggtaagaatctacaaccaactttttacagtggagcagcctgatgcggaaaaagatgtagatttcttaaacttcatcaaccctgagtctgtaacaacggtaaaaggatttgctgagccaagtctgaaagacgttgcggtgggagaaccattacagttccagagaatcggatattttacaaaagatcaggattctacagatgaaaccctggtatttaaccgtacggtaactttgaaagattcttataaacctgaataattttcaggaatagaccataaaacaaaagcaggacttcatacaagtcctgcttttattatttaatagcttaaaatcttgaagtatgagattctacttcaggaaatccttgtcctgataggcgggatttggatatttataaaatccttccccggtcaatactcccagttttcctttatcaataaattcttcttttaatttttcaacggcttttatctttagtggatcctgagtttcttcagcttccattttattgatattataagcggttgtgattcctacaacatccagaattccaaacgggccggttggtgctccggtggcgaccatccatgtcttatcgatcgtttctatatctgagacttcatctacccagagattgactgcagcgccaagcaacggaaccaataatgaattgacaatatacccgggttgttccttttggataggaagtgctaccattccaattgcttttgcaaatctgataagcgaatcaaacacttcctgtgaagttcccggatgccgcattacctctcctgtattgtgcttccagatttcattggcaaaatggagggctgcaaacttttccggtctgcctgtagcttcagcaaactgactcggcagaagggtagaagaattcgttgcaaataccgttttttcaggggctacctgagccagcttatggtaaaattctgttttaatggttggatcttcgggaactgcttctatcagaagatcagcatcttttactgcttcagcaagatcagatgaataactgatatttttaaatgtagcatcaagttgtgcctgcgttgcacccagatcttttttataagcttcacttaaagtggtgaatttacctttggctttctccaatacttcatcattgatatcatatacagtaactttgaaaccgtgataggcagtctgaaaggcgatctgatatcctaatacgccgcttcctgctatcgttatgcttttaaaatccatgagatttatttttatatctgttttagaatagttgtttgtttttttaacgcaaagatttataaaaactgattattatttcaagagggcaaaggcagataaatctgcttcacaaagttatacgcttcatcaaatcaaattgttgattctcttctttgctccctctaatacattattataattctaaacctttgcgttaaaaataaagtatgcactactttaaaactattgttttgtaagctaatattttcaatcttttactccttttacccattcctgaaatctggttaagaaagattcgtgttcttctttttcttccggacggtttaccagaatgtgttcaaagtaagttccttttaatatttttcttaaaattccttcccctaagaaaggtttatagtcattcagagcctgagttgcttttaataaatgtctgatatcatactgcaatggattgatgtccggaacctgtttattaaggttaagcaggttgtaaacagctattcttgcagttcttacagagctttccatggtgaatacaacatcattattggtttctacaaactgtcctacaagacctaagttggtacatccttcaggaaccactctcggacggtctcccatcgctcttggcataaacatagatgtgatataaggcatgaatgctgtacgtacaatagtattttcagtaacattatccagctggtctgttattccaaggtggtagcataactcggcaagaatctcgtttccggtacattgaggcatagtttttttgatataattaccttctttatccatcagtaaagcatacacccaaactacaaggatatcatccggctgagtagggaagtgcggctgtctgttgcaggtaaaactcatcacccaattggagtctgtaatggtaataatccctcccgtagcagttcttcctgaataaggatcatttacacacagttctttcagtttctctgtaaaagcagaaggacggcatgttaaggttgcagattcccaggaagatttttcaatatgactacagaatttttcaggtttcccgaatacttcagatttcgcggcaagatttttccagagtttccatccggcactttgtcctgcgctgctgttatctattgtaacttcaggaacggtattgttatcaccgtagaaagtactttcggtcatagagccggtagttacaataacataatcatctttactgattggtatttttacttcctctccgttttgttcagtaataattccttctacggtttttccttccgtgttaatatgaatatcaagatcttttacaagggtattaaactgaatctgtacacctttttctatcaggaagttttttaagggagttacataggtgtcatattggttgtatttcgggaataccaggcatgagaagtctttcattccgtcaatggcatgaaggaatctgtgcatataaagtttcagttcaagtaagctgtgccagttttcgaaggcaaacatagaacgccagaagaaccagaaattactgttcaggaaagattcagaaaaataatcttcaatcgtaagatcgtccagctcttcttttttcttcaacagcagttttacaatcgccagctgatcttttttctcaagtccgaatttactgaaatccttgatctgtccctggttgtgaatgagtcttgctttggaataattcgggtcgttgtcattgataagacggtattcatccaatacactataaggtgcaggcagctccaaagcaggaatatcctggaacatgtcccataaattttcataggtcatatccatttcccttcctccccggataatatagccgtcttttgcgttgccggctccatcaagagatccgccttcaacgttaagctgatcgaggaaaatgatatttttgccgggtacacggccatcacggatgaaatagtaagcggcagacatgccggcaattccgcttcctacaatatagattttactgttttcgtaagactgtaaaggaatacctttattacgttgatagtttccgatctgatcggagaaaggcatcgttttttcaggagtgttaatctgaacttctttgcttgaatccggctcgtggtttacatttccaaactggtcagaagcatttaaaactttatcgaattttgaattgatcgtactcatcttttattgtttttaattaacaatataaaggtacctctattctgaaagcgatatatatccccaagttcagaattattatccccaaattcttatgactggatattttctttaattctatattctgaaggagaaagtgtagtgtgctttttgaaaaagcggccgaaagccgatgctgaattaaactgaagttcaaaggctatttctgagattgtgacgtccggatttccaagcatgacataagcttctttcagcaacgcttcatcaataacttcatgaggtgtttttccgcttgctttcttaatcatttcgatgaggtatttattggaaacgtgaagttgatccgcataaaactgaaccgttcgttctctggtaatattttcacggatcagtttaccgaatttcagataaagatctttctttccttcttccctttccggatttgcagcgttttcctgttctatgatctcagcagtttcaagcaatagattgaaaataatggtacgaataatttcttcagtgaatttaccctgtttcttggattttttgttaagataatccagaaggttctgcagcaataaagaattttttgcagtggtttttacaatactgtatgaacctttggaaaaaagattcattttctcaatgataaaaggattggaaatatttttaatcagaaaatttttgtcgaagaacagcagtttcattgtaaaatcgtcacttgcttttccaaatttcacaatcgtagagggtgcagcgatcaaaaagctgtgagcgtctaccctgtatttctggcggtctatctcaatattgatttcacctgcggtacaaatgcacagagcatagtaatccattctgaaaggagacttcggaaatttgaaaatcggttttccggaagaaatatagtaggattggcagcaatcaatactgtaaaaagataacgtgtcatgtaaattttcgtaggtaagcattcttacgtattgattaaatttttatggtgtttttaagaagttttagtttaaaactcctgttgttactgcaatttacgttttttataaaagcatttgggttttatgtattaaaaaattatttgagatagttgttttaaatggttttatgaatatgttttataaaaaaaggtttaaataaaggcttttgagttatttttatctaattttgcattttcaaatgacaccccaaatattattgtgagattaattagcgtatatacgagttcttttaaaggactctcgcaggaaagctggatgctggcgttggtaatgctcatcaacagggccggttctatggtacttccgtttctgggagtgtatatgaccaatcatttacatttcagtattgaaaattcaggaattgtactgagctttttcggaataggttccgttatcggatcgtggttgggtggaatgatcacagataaaataggtgagtacagggtacagagtttaagtttgctgctcagtgttcctttattctgcctgattccgctttttacaacagaagcagggttggcaggaatcattctggctcaaagtattgtaagtgaaacattccgtcccgcaaactcagtggccatcacaaaatatgcaaaacctgaaaatattacaagggctttttcgcttaatcgtatggccgttaatcttgggttttctattggtcctgcactgggtggtattttatccgctatttcttatgaatttctgtttttcagtaacgcattggctgccttgcttgcagggttgctatatatctggttctttaaggatcgtgcaaaattagccagagagaaagccaaaaaggtaaaagacgtaattgttattaaaaaagaaaattctccatacagagatgggaaatttttgatttactgtgccttctgtatgctgttttccatatgctttttccaactgttcagtacattaaccatattttataaggatatggctcacctgagccaacaaaatatcggatatatcctgggatacagcggttttctgattgtacttctggaaatggggctcgtacagattgctgagaaatattttacattagcttttaccatgctgataggaactttcctttgcggattttcttatgccatgcttgcttttgattacagtatgattacacttgtgctgtctatgaccttactctgtgtgggagaaatatggacacttccttttatgtcaaccattacagcattacgttcaggggataacaataaaggtgcttatatgggattgaacggaatgtctttttccattgcatttatcgtcacgccttacataggaacactgattgcggaaaagttaggttttaatacattatggattggaaccggagtattagcaatggttattgctattggtttctactttattattccttggatgcttaaagataaaaataaggtagaagaagagacaatatagcgcttttacttttaaatcaaaaaggttcgggcaatttcgtagaaattacccgaaccttttttaatatctataaaccatttatgataaagatcttgaaagaatggtattgatgatcatattcgcatgaattctggagttttcaataaaccataaatgagtatcttttcctccgcacacaacacctgcaaggtagaggttggaaatattggtttccatggtttcaggattgtaaaatggattcagacagtctccgttgagttcaattcctgagtttttaagaaattcaaaatccggaagatagcctgtcatggccagtacaaaatcattgtcgatttcatgaatttctcctttttcatctttaaaaactactgtgttttctttaatctcgaccatttccgaattgaaataggctttaatgcttccttccgcaattctgttttcaatatcaggttttacccaatattttacactttttgaaatttcagaatgacggatgatcatcgttacttcagctccttttctgtatgtttccaatgcagcatccacagcagaattactggatcctaccaccacaattttctgttttgcgtaaggataaggttcggtataataatgcttaactttaggaagattctcacccggaatattcatcaggtttggaatatcataaaatccggtagcaataattacatttttggcttggtagtttgctttggaagtcctgatctcaaatatttcatcctttttcgagacattcatcactttttcatacaggttgatgttcagttttttttgtctggcaattccctgatagtattccagtgcttcctgccttcccggttttggagcagtagatataaatggaatctcagcaatctccagcttttcagcagtggagaaaaaacgcatatacaaaggataattgtaaagagaattgacaatggttcctttttctatgattacataactaagattgtttttttgagcttcaagagcgcagtttaaaccgattggtccggccccgataatcagaatatccaacatttccatctaacaaatgtacgatgtaatttttaaaatgagaagccaaaactcctcaagtctcatagtctttatctctttatcttatgtaccgcttggcatcagatttggtgttttctaccaattgcaaaaccttaaatatgaaaaaattattgattgctgtatttgtcatgagccttattgtagcctgtaagaaagaagctggaaagcctgttccgaatgagatagattccatcgcacaaaataaaacagacagtgccggtaccattcagactaatgccaataaagaagctttattgaaacagactaatgatgaggttctgaaaacgcttaaagctaaagactatgttacttttgcttccctgattcacccgcaaaaaggaatccgtttttcaatgtatgctttcgttaatctgaaagaagacaaacatttttccaaagcggattttgaaaagtaccaacctaccaaaactttgtttacctggggagcgcatgatggttccggagatccttataaagcaacgatcaatgattatcttgggaaatgggtgttttctaaagattttacagcatcagaatattcattgaataaattcattggtggtggtaattccctgaataatttaaaggaaatatatcctaaagatgacttcacagaaaattacatcaaaggaaccgaaaaatatggtaatatggattggaaaacactacgttttgtatttgaagaatttgagggaaaatattatctggttgctgttataaatgaccagtggaccgtatagaagttagacgttagaagttagaagtggtaagtaaacttccggctttcagcttctaacttctttctttatattataaaatttcagtcagttggtgggtcagattttttcttgagaactgatcaatatgctgagtgttttcaagaagatcgccatttttccaaagattgaatttttccagaataaattttttgaccatttctgtgtcctgatacccaaaatgttttcctgcctgggtttcttccaggattttggcaacgtcagccttgtccgggccgaatgagagaatctgttttcctgaagccagatattcaaatatttttcccggaataatccctcttgaagactcattcggaaagttagtaataagaagcatatctgaatgctgcatctcttctacagcttttccatgagaaagatacccaaggttcagaatatgatttttaaggcttgaattttcgatggattgtagaattttatcatcaattctccctacaaatttcaatttgaagtcagccgcaaattcagcatgttctctgataagctcatccagaaccttccaaaggttttccggatttctgagctgctccaaaaccccaatataacttagagtaaatgcctgtctgatttgcaaatttgccttttcactattttgcccttctgcttttttaccagaatcactttcatcaaatccattggtaatacaaaccgcattggctcctgcttttctgaaattttctgcatcagtataacttgtcgctaaggtaatatctgcattcttaaatacggcactttccagctggcggtgctttttatccgaacttttggttaatttcaaatgtttgtaataggaaatttctgtccatggatcacggaaatcggcaatccatttaagcttgggcattttatttttaagccctaagccaatcagatggagagagtggggtgggccggaagtaacgatggtatctattttattttctttcaggtatttttccaggaatttaacagaaggttttacccagaaaaccctggcatctggaatgaaaaaattacctcttacccagattgaaagcttggatttccagctttggttttttccgacatcaaactgtccggctttgaattttttgttgcttttattcagcttttcagcaagctgataaggctcccatattttggttcttacgatctcaatattttcaggaacatctttcatcagggtttcatccagcaatggataacttggattttccggagtgtagatgatgggtttccagccgaattccggcagatattttgcaaacttcagccatctttgaacaccaggacctcccgcaggaggccagtaataggtgataatcagtatttttttctgttccatttttaatttaatggtctttgtcattctgaacgcagcgaagcgcagtgaagaatctcactctatctcttcattgagaaattttcaatctggattgaatccattaattaagttttctttcttttgtctggtccagccttttatttgtttttctctatttattgctgtctcaatgtcgccaaaatgttcaaaatatattaaataaaagcatttataccttgaagtgaagcttttttcaatagcttcaggatttttatgccaatataatctgttttttaaatcgttggtaactcctgtatacaatactgtttttattttatttgtcagtatataaacgtagtaattatgagtgcctaacgttttcatttgagattcttcattacgcgatgcttcattcagaatgacattgcgcaacattatttttattatttaaacactttgttcaccagcaatttcttttttcctgtttttgttcatccagaaaattccaaatgcagctaacaggataaataatccaaatgaaagaagagaaaaccattttcctttttcaatcacctcaggttcaaataccattctgatatgatggtttcctgcaggaacatgcacagcacgaagcaagtaatctgctttgatgtaaggaacttctttttcatctacaaacattttccatccgtgaggataatacacttcagagaatactgccaattgaggggttttcgactgagatttaaattcaagttcgtttggctggtatttcgtaagattgataaatgctgtagaatctgcctgaaccggtttgttatcaaaatatgatttgtcagatgaagcaatgacagctgtttttttgttatcaattgttccaatagatttaatttcctgtttagggctatctacaaattttaaatcacttacaaaccatgcatttccgttggcttttggattaggaacaacctgtggctggtcaggacctccgaaaaccatgtacttagcattcagtaagtttaatacattaggcgtttttacactgtcgatgctattgatatattcatttaatacatcatcataccttcttagttttacagcgtggtaaccaccgatagaagctttaaaataagaagtattggtctcactggttacacccagtgtctggttgtaaattctgtagtgagttttgtctttttcagcaatggtttccaatgttttgttaatgttgacattggataaaatagattccagattaggatttccctgaactttttccgccagcagatctgagctttctgtctggaaaggattttcagcaaagattttatctacgtagttttcgtcatttaaataacgcttgtttacgctccagagatcaaataaacttacaactccgatgacaaccaaggcaatattctgattaagctttttctttaaagtcaggaatagtgcagcagcagcaattgccacataaatgaatgcctttatcgcatctattctgaacagtttatatctttcatctactagatagtcaagcaggaaaggagggaaataagtcttttcgttttctgtagcaaaacctaataaagactttccaaagattaaaagaatcaataaaaaacctaaagttcctcctcctacgtaaagaaggattttctgtttgtattcttcagtcagtttttcatccgtaaagaatctgtataatcccagaatggcaattaatgggaataatagctctaccacaaccaggattgaagaaggagctctgaatttattatagaacggcacatagtcgataaagaaatcagacaatggcatgaagttacttccccaggccagtaaaatagtcaggatagaagctcccagaatccagtaacggtattttttccaggcaaaaaagaatcctaataaagcaaggaaacatacaatcgctccctggtaagcaggtcctgatgttcccggctggtctccccagtaagttaccccgctgaagcctttggaaattctgtccatttcagcctgtgaacctacattttcctgaaccagttcctgaactctgttcatgatttctttgccttcaggctcctggcttccgccacccattaatctcgggatgaacaggtttaatgtttccattcgtccatagctccacatcagcatgctttccttatccattccggattttcctgaagtatggctgttattatccagaatctgcttcccacgaactgtttcttttacatattctgaattggccataatcctctgcgaattcatacccactcctataacacatgatgccgcaataattcctgatgaaataagaaaatgcttcatcggtgtttttttctgaatagctctgatcagttcagaaaggaataagaatcccagagcaaggaacaggtaatacgtcatctgcgggtgattggcagcgatttgaagccccataaaaagggtcgtgacgatgaatccccagatgtattgtttcctgatataaaccagtaaaattccggctaacagcggtgcgaaatattcaatggtatttactttaccattatgtcccgctgcgataataatataaaaataagtcgaaagtccgaagaacgtagcgcccagaagagcgtacttccagtttctgactactaccattcccaaaaggaaaaaacctgcaaacagcaggaagagataattgaccggccttggcatgaaattcagattgctgtcaatttttttgatgatatcacccttgaactggcttcccatctgataagtcggcattcctccgaacatggagtcactccaataggtttcatttccggtattggctctataatcaagcagttcttttgcacctcctctgtactgcacgatgtcatgctggaaaagctgtttccctgaaaatacaggagtggagtataaaaatgctaaaactataaatactactaatgaaactgcaatataaattaagtttttattttttgccatgctggttattatcttttatttcttggaatttttaccttttgtcattactctcttttacctcttcatagtctacagtttctgcatcccagttaaggttctttttgttattcttgttcgagttgtgtatgtcctgctgtctcttattctggttttcattgttgaagcgatagctgtaaaaagtcttaaagaaaattcttttcagaatattccagacaaagaaaataataatggcagtgagtactaactcaagaatgtacttcataatttaaaaattaaagttcagggtttaaagtttatatttcaaaccctgaatgtttattcaagttatttagcagatgggttgaccattaccgaagaattggaaacgcttttcatagactgagactgttttccatccgaaatggtttcgatctgagttgtttttacgttgatattctggttggtgatccatcctgtgctttcgtcaaacttaatggttccgttctgaaccagttcactgctcaggctgtgtgtaataggtccctgagctttcttctctgtctttttaggaatacctccggttaccgcaatttctgcagctccgtttcctaaacttttcaatacataattggaagttacctttactgctccgctggcgtcagcattttcagaagtagaccatttttctccgattttcactccttttttaggaataatcatcaggtttttatgaaactgatctttcaatactttttcattgaatgattctttaaggcttgctactacgcttgctttttcattggcatctttaataagtgtccctactgcgttacctacttttgtgtaaacagcatcaaatcctgtaatggaaattacattccctttggtatccatcttcatctgaagtttgtttccggtaagcgctttgttgacattccagatcattttaagttcatcttctttaggaagaggaagcttggtatccactactacagtttttccctgtgcagactgagaacttctctttgctacaaggttaagagtcatttcatatacatttcctttaatatcatccaccacgaagttcatctcgtctgtagattcgctggttgcagtgatcgattttccctgaggatctgtcattgtttttacatctctctgatatgtagtaagaggataggtctttcctttttccagcttaaaagtctgtgttataacgcccgcagaatctttgatagcaggattttctgaaactttcgctacagaatcagcaggaacttctacagttactgtttttcctgttttaggatctacttttgttatttttgctgtttcttttttacaagatacaagagctattgatgatataagcgcaagcgctgcaatgtttctcattaattttaactttattttttactactgtttcttaataaattatctgcaatatcctgcagttttccctgggattctccatccgactcgttagaaagcactaccactcccatattttttgacgaataaatctgaagtacactcgaaaagccaaatgtacctcctgtatgataaacggtttgggttccgtcttcataggtatgtaacctccaatataatccaatagcatctccttcactttttacaagaggagtatgggatgcttttacatacttattactctcatccagatgatactgcatgtatttcaccagatcctccgtagtagatataattcccccggccggagcaaaaatagtggtgaaattcctgggcattacctttcctttttcgttgtaaccggtcaatcgttgtgcagaattcgtaccaagaatagtatgattcattttcaaaggctttgtaatatactctgcaaggagatctgcatagcttttatggtatactttttccaggatatctcctgcgatttgtgttcccgtattggaatatttatactctaagcccggaacaaaatccagttttgcctgatgaagatcttcataaaacttctcctttgaatagtttttataaaaatcggacagcagtattgccactgagtccatcggctttttgaaggtctctgactgatccggtaaaaactgtggcagtcctgaagaatgattggtaaggttgccaatcgttatcggatgctttccaaattcaagattaggataatctccgcccagatatttacggatgtcgtcattcattttgattttatcatccgctaaagcatgagccagaagagttcctgtaaatgttttggtgatggatgcaatctcgtacagacttttggaagtcggaagttcctgttttcccgtttctgttgttccgtaattataaaaataacttttaccatccttgaaaacacctattgaaagtcctacacgtgcaggatcctgcatatacgcaagagcttctttctgtaccatcttgtcaagatcagttgtaagacggttgtctgttgctatttttttggtctgtgcattaaaaataaacggagcaaaaaataagggtaaaagtgattgtattttcataatttacggattgggtatcacagccattttctgtcttaccgcttcatacaaaatcgctccacaagccacagaaacattcagagattgggttttgccttcaataggaagttttattttttcatcagcatgatgcaacacttctttggaaattccggtttcttcatttcccataacgatagcacaaggctcagtcatattcacatcatagattaatttctgagctttttcactggccgcatacactgaaataccgctttgctgaaggaaatctaccgtgtgtgcaagattgttttccttacatattttgatattatagatagctcctgctgaagtttttatggcgtcagaattaataggagcagcgcctttttcaggaatgatcaccgcatctattcctacgcattctgcagttctgcagatcgcaccgaagtttcttacatcagtaagtctgtccagaattaaaagaaaaggcgtctttccctgttcaaataactgtggaacaatatcctccactttatgaaacggtacatccgaaataaaagcaaccacaccctggtggttttttctggtaaaacggttcagtttttcaaccggaacataattgggacggattttatttttcgctaaaatggcctttaattcagcataaataggaccttgaagtgcattctgcacaaagatcttgtcaatcgtttttcccgcttcaattgcttcaatcacgggacgcagcccgaaaataaaatcgtctttcattgaaaatgtattatatagttatagagtgaatttgtcaatcgtgaattttactttgtaagtcaatttgttggatgtatattcacatctgaccattgacttgcgtaagcaagattcactatcttcctttctctcctaaaattgctcttttctgtgccatcacatatccgtagtgaaggctttcatgcatattgttgaagataatggcatcctgaatacttttcagatccattccgaaacttgtggtgtaaggcgtgtaatctgagaagaaatcactgtcataatccttcattaaaatctttgaagtttctgtaagtaaaaattccagatcttccacttctgatttctgaacatttaaattgggcagagttccctttttgtaggtttcaatccaatatttatcaatacggaacggatttccgctcaggtaatagtgcaggagctgctgtgtggcaaccgtgtgtgcaatattccagtaaatattgttgttgaagccatccggaatcagaatcagatcttcatgggatgtgttctggaggatatctaaaaggttttttcttacctgtctgtgcgcttgaaaatgataattcattttgcgaaatttttaatcaccaaaaatagtttaataaactggaaatgacaatttttgaacaggtgattaaagcaaattttatatatttttatgaaaaaaacggataatcttattgagttttaagccttcagcaattcgttaccttgcatcaatacaggaatttttaacaaactttaactcaaaaatggcatttattatgttgattaatgcaagtatttatcagaaatttaccacttattttaaatcaagctatgtcagagatatatcaagctgaagatatccgccaattgacggaaaaagtaaaagaaaaaaactacttattttctcttctgagacaggaaatcaataaagttattattggacaggaatacatggtagaccgtcttttggttgggcttttaggaaacggtcacgttcttcttgaaggcgtgcctgggctggctaaaaccttagcgataaaaacattggcagatgccgttcacggagagttttcaagaattcagtttacaccggatttacttcctgcagacgtagtgggaaccatgatctataatatcaaagacaatgatttttctataaaaaaaggccctgtatttgcgaactttgtactggcagatgagatcaaccgtgcgccggccaaagtacagtctgcgcttctggaagtaatgcaggaaaagcaggtaactattggtgatgaaaccatgaagctaccaaagccattcctggtgctggcaacccaaaacccgattgatcaggaaggaacttatctgctccctgaagcacagagcgatcgcttcatgctgaaatgtacgatcgattatcctgcttttgaagatgaaagacaggtgatgagaatggtttctacttcacatcagccgactgtgaagccggttatttcccttcaggacattgtagatgctaaagaattgatcaaccagatctatctggatgaaaaaattgaaaaatatattctggatatggtatttgccacccgttatccggagaactacggtctttcagaacttaaaaattatatcagtttcggagcttctccaagggcatccattaaccttgctattgcttcaagagcctatgcattcttaaaaggaagagcatttgtaattcctgaagatgtaaaggcattggctaaagatgtattgagacacagaatgggcttaacattcgaagccgaagccgaagagatttcaacagaagaaattatcaacagaattttagcaaaaatccaggcaccgtaatgagtgaagtaattatcagaaaagcagtcgtggctgactgtgctcctatgctggatttaatcagagagctggcagaatatgaaaaagcgctgcacgaggtgacagtgacgctggacgaatttactgaagatggttttggcacctctccggtttggggagcttttgtagcagagtatgaaggagaaatagtcggaatatcattgtattatgacagatattcaacatggaaaggaagaaggctgtaccttgaagatcttgtagtaacggaaagattgagaggaaagcagatcggaaagaaactgtttgatgcgacgctggaacatgggaaatcaaataattacagcggaatggtgttccaggtattgaactggaatgaacccgctatcaatttttataaaaaatacagtacgaagtttgacaacgagtggtcgaacgtatccattgagtttaaagattaacccaaccccggatccctaaacccgaatattgaactttgaatttaaaccttaaacttgtctatgcagataaaagatattgtaaaaaaagtaaagcagattgaaatccggaccagaaaaaagacggaagctgctttgatggggcaatatcatagcgcctttaaagggcaggggatgactttttctgaagttcgtccttatcagtttggagatgagataagaagaatcgactggaataaaaccgcacgttttcgtgaaccgtttgttaaggtaatggaagaagaaagagagcttacgatgatgattctcgttgatatttctgcttccatggattacggaacgaaagttcagctgaaaagagaatatgtggcagaaattgccgccagtttaggattttcagcggcaggtaataatgataaagtagggctgatcttatttgctgataaagtatataaagtaattcctcctcaaaaaggaagaaaacatattctttccatcatcagtaatattctcactgcagattatgttccggcagaatctaaaatagacaaagcaatggaatatatgatggggatttttaaaagaaaatctctggtgtttttattttcagactttgaagatgcttatgattccaaaatgctaagagtggcttcaaagaaacaccaactgctgggaatgcggatttacgatgaaaaggataatgaaattcctgacgtaggatatgctcttttgcacgatgcagaaacaggaaaggaaatctgggccaatacttctagtgcaagatggcgatatacctttgcagaagctcagaaacaaaagctaagagctctggaagaagactttgccaccagttctgcaggttttatgaatatcattgccggttcagattattcaaaattattgtataattactttcagaaaaaataaaaccggatcggtctataactaaaaaacatgaggcaactgcctttattattttaacattgagaaaaatacttttaatattatcctttctgatctgtgcgaatgctttttcacagatattatcctctaacgtagaaaagaaaacccttgccctgggagaaaccaatcatattactataaagattgacaaccttaatgggcagcaggttacttcagctccgaagaatgagctgctcccttttcattttgaagaaaccaaagacagtatcgggcaatctgccaatacctatgaaagaaaaatagaatttgctgtttttgacgaagggaaatttaccattccggaactggaattcaaagtgggtgataagatccttaaaacgattccatacgaaatagatgtcatcaatactgctcagaaagctgatcagattaatgatatcatgaaaaataaagaggtgaagcttgagccgcaggattactgggagctttataagttttatattctggctgcattggctggtattgcaataattattgctattatcatgtttgtaaaatggggcagaaaatccaaaagcgctcctgtagtagctaccaatcagactttaaaagaacttgactcacttaaaaagaaaaaatatattgaaggaggaaacttccgatcgttttatgtggaactgattgatatttcccgaaacttcattacaaaacaataccatcttccggcagatgtccttcttacagatgaccttattgatgttatgaaaaagaataacacaatctcccaggacaacgaaaaaattgtggaagatgtattccagagaggagatcttgtgaaatttgccaaaacttttcctgatcaggagaccatggagagagattttgccaatatcagggattttgtgaaaagatcatccaaagatttagaattcgaaaacttaagaaaggatgtttaattttgagttttacagtccgtggtttttactgctttttctgctgtttatcccacttttgattaaagatatcgggagaaagaaaagaaaaggcataaaggtacctacagtaaagaatatggatcacagtggtggtatccagggggtactttttttgttgaaaatctcaaaatatatcatactttccgctttgatcattgcaatggcaaggccgagaacatttacgatttctcaggaccgggatgatacaaagggagtcgatattatgttatctattgacgtttctttaagtatgctcgcaaaggatttaaatcccgatcgtatcactgcgttgaaagatattgctgtaaaatttgttcagaaacgccccaatgacaggataggagttgtcgcgtatgctgcggaggcatttacaaaagttcctgttacttcagatcatcaggttgttattgatgagattaaaaatcttaattctgcgggtcttgaaccaggtacagcgattggagaaggtctctctgttgccgtaaatcacctggtaaaaagtaaggctaaaagtaaagtagtcattctgatgacggatggagtaagcaatattcagaatgcgattcctccacaggtagctgctgaactggcaaaaaataataatataaaggtatatgcaatcggaatcgggaccaatggttatgccctgatgccaacatcacaggacatcttcggagatcttgtctttactgaaacagaggtaacgattgatgaaaataccttaagagaaattgcacagactacaggaggaaagtacttcagagctacctcaaacagcagtcttgaagaagtatacgatgagattaaccagttggaaaaatctgatgtgaaagtttccaagctttataattatgaagaatattttaagatatttctctggattgctttaggaatgctggtattggatgcattgttgagatgggtgttttataaaattttaagctgatgagttggtctttaggaaattattggtatttatttttactgttgcttctgccgctgttagcttcctttttgatccgttttttaaaatggagaagtaaaaaaagagaaatttttgcagccagtcagtttcatgaaaatttatttgaaaagaaatcaggatttacaaggtattttcctgcattgtatttattggcagttttatttctgatattctcaatcattgaccttctgaatggctcagaagaggtgaaaagcacccagaaactgaacaatgtgatttttatgctggatgtatccaattctatgaatgcagaggatatagatccgagccgtcttacagaagctaaaaatctgatgatggctactatgaagaaaatgaataatgacaaaatcgggattgtcatttttgccggaaatgcaatgtcgataatgcctcttaccacagattataattcagcagaaacctatatcagcggtattgaaacaagctctatgcagattcagggaactgattttctgaaggtaatgcaggctgctgttgaaaaatttaaaaatgtaagcaaggggtccagaaaagttgttctgctaagtgatggtgaggataatgaaggaaatgataatgcagctatacggttagcgaataaagaaggagtgagcattacttccgttgggatcgggactgatgaaggtgccccggttccggaatatgtttttggacagttgatgggatacaagacggatgttaatggcggaacagtaatttcaaagaggcagacggaggctttaaagaaaatggctgaatctacagatggaacctacattgacggaaataatatcaatgaggccccggacagaattgcagaagctgtaaataagaagtctgcaggtgctgaaaccatggtgaaatcacagaatgcaaatcattactatcaatattttcttgcggtatctattctttttttctttttaatttatatttttaatcctaaaaaggactttaatgtgtagatttcctctttatatagaagaaattctacaagtactttaaccgaattttaacaaataaaactctgtttcttaacatataaaggaataattttgcaagtgatgaatactaaaatcatatttttatcgtttattgttgccttctctttctcaggcttcctgtttgggcaggaaaactacagaaacttaatccatgaaggtaaccagaaatttgacggtaaagactatgagggagcctcctccaaatacatggaagcgataaaatccaatgataaagattttaccgctcattataacatggggaatgctctatataaaagtaaaaaatacgaagaagcaaaagcagagtttgaaaaagcagaaaaactttcacagacacttcctgacaagactgccgcacttcataatctgggaaatgcttatatgcagatgaatcagccggaaaaagctgctgattattataaaaaagctttaaagcaggatccctacagcgaggtaaccagaaaaaattatgagattgccaagctgaaagaaaaagaaaaacaacagcaaaaaaacgaacagaacaactcaggaaaaggtggcggcggtaatgatcagaacaaaggtgacgatcagaaaggcgacaaagacaaaaaacaggatcagggtaacggccctcagaatgaaggcaaaagtgaccagggagacaatcctaagcagaatcagaataacgaaggcagaatgccgaagaatcttgaaaatgcgatcttagataaaataaacgaaaaagaaaaagaaaccgccagaagaattttaaacaaaaattcttattcgatgcctgaaagcaacgagaaagattggtgatgcagcacaaattgatttacatattgcttaccctggcgtccgtaattacttacggacaggtaaatctttccatggatgcagataaatctgagtatgcgggtaaggatattatcaatcttactatcgttcttgaacttaacggaagcgaccttgtacaacagacaggtttacagcttcccgatctatcaaaatttaatatcataggaagcggatctgttaccaacacggtgattgacccagctaccaatacattaattacccaaaaagtatccagaattgcccttgaacctaagaaaaaagggaaaataaaaattggttctgtgctggttacggtaaacaacagaatttacaagacagaaccctttgatgtcaatatccgggatatcgttgacaaaaggtcaatggcttccaatacatccagtgatgtttatctgaatatggaaattgatgacagggatgtatatcaggatcagcctactgttgctgtactgagagtatactcaagaaacattgataaccttagaaaggtgaaaaatattcgtcttccgcaacaggataatatcaatgtgcatcccatcaattttgatagatctgaaatagatccgtcaggatatggaaatatgccttcacaggtgctggcgatgtttatggtattcccgaatgaagctggatatgtggaggttcctggagtaacagcatccgtaagtacctattcaaataaaaccaaaattgtttccaataaagttaaaatcaatgtaagaaagctccctgaaggtgctcctgagtgttttaaaaatgctgttggaaactttaatgtaaacgtatataacgcttccaaggaaaaaccggaagctaaaaaaccactgaatgtggtagtgaaagtttcaggtgaaggtaatttaccggatatggaacttccaaaaattgccgcctccccggattatgaagtttttgccccgaaaattacttctaaagtgactcccggaactacagggatgaaaggagaaatcttagctaattatgttattattcctaaaaaatcaggagcaatttccattaagacagaacagtttgctttcttcaatcctgccagtaaagaatatgtagatctgggacaaaaaacactggctttgaatgcattttctcatgatcagattatggaagcccgtactacggtagaaaaagtaaatgaatataccaataatcttcttgaaacggtaaatactcctgttttaaagaccacatcattcaaggtgaaagaaaagaataagattcactggaatattcttctaactaatattgctattctgataagcttgtttgttgtctatctgttatttaaaaattggcaaaaaaaacgtacattagttagggaaaatgtaccgtcaaaacctttaggttcagtggcagaaacagaaaaagagatcagagaattgatgaaaacagatatcaatgattatttcggatatctggaaaatcttaaagataacggagaatatgagaagttctttgttactctggaagaattggatgaagaggtgagaagtcagtatttcaaaggctctgcttcggagttcaggacttttcttgaaacgcataaaggctctttgatagcagaagaatatggcaaattgcagcagagagttcagatggaaaaatataatcctgtaaaatctgcagaagctcttgaagaacttttgaaaacaattgttaatttatattcacaaattagcaaataatcagtttattttcatatttttgcgaaatttttaattacaaagagatggaaatttttgatggtttctcttttaaagagattgttaccagctttatggttctttttgccgttatcgatattatcggctcagttcctattatagtaagccttcagcagaaattcgggcagattgaagccggaagggcagcaattactgcaggagttattatgattgttttccttttcgtaggaaacaagattctgaagcttatcggagttgatgtaaattcctttgccattgctggtgcctttgtgatttttgtcatagccctggaaatgattctgggaattgaaattaataaaacaactgaagcaaaggccgcatccattgtacccatcgcatttccgctggttgccggagctggaactttaacaactgcactgtctctcagagctgaatttcatgatattaatattatctgcggaattattcttaatacaattttcgtatatttggtgctgaaatcagcgaaatggttggaaagaaaaatcggggatgctactttgatgatcctgcagaaagttttcggaatcatccttttggcaatttcaattaaattattcactgcaaattttgcccagctggtgcagaattatattaatttttaagagtcatgaagaagttttataaagtatttttagtactgtttatcgtattcatcgccatcaatctttatgctatcaactggcagacaacagatatcttaggagatgaagataacctgaaatttgtattctcagcagcagctgcaggattaggtcttatcctgctttttgtaatggatacatggagcagaatcggtgtaaagaaataaattgaatatttcaatatagatataaacctctttcctttgaaggaggtttttttgttttgttaggtggtagggattaggtagtagataatagataatagataatagataatagataatagataatagaagattgccattagatttcaatacttctttctatcaatagaaacgggctttagccccgtttaaataaaatatataatttcaattggcttcagccaaaacttatgaaatcctacaaaattctataaaataacaagatttttcaatatggcttcagatttcagttccgtttctctccattctttttccgggttgctttgggctgtgattcctcctcccacgaaaatatgtacagcatctttataaagtcttgcacaacgcaaattcacaaagtagaaaatgctttcttcagtttcaaccttaatatagccggcatagaattcacgcggaaatttctcgtatttacggatattctcgttacaaaaatcttttggaatgccacagacagcgggagtagggtgaagatcccggataatactgtcaagatcatcaggttttatactggtcttaaaatctgtccgtaaatgtttgatatttcctgaaacatgatcatatgtttccgactgctgtacattgttagaatagtttttaagaatgttctgaatgtaggcggtaaccggcttttgttcttcaatttctttttcagaccattcttcagataccggcagggtacctgcaagagccatggtttcgaactcataggttgctttattaaacttacctaatacttccgagaaagctcccatccatgcattctgtccgtcattaaacaaatatctgaaagcattgggataggaattacataaatttttaaaactttctttataatcgattactgtaaagtcggtaaatatttttcttctggagtaaacaagcttaggtagattgttttctttaatcactttgatcacttcctgcaatgttgcacagtattcttctttcgtttcagctatagaatttgttaaatctatgatcagatcttcatttgtaaccgggttaagagaaaattccgaagcatcagattcaattatatctcctctgaagctgatttgatcttgtccgttataagaagaaaagtggacagtattttttgtatttttttcatcagtagtcagaagtctctcgtcaaaaggaagtttgaaataaatcatgagttatgaagattttgaaaatcatcagaggaaaatggtataagtaatttccagcgtgattttcctttctgcaaaggtattactagtctgaaagatgtcaaaataaaaaggacttaaatttattttaagtcctttattttttatgctgttgcaacttatctgtgaataatattattcgtcattgttgtatgattgataagtactcctttttcatcgcggatttcaatttcagaaacgtgcatcgttttaccttttctgataaaacgtgctgtagctgttacaataccatcctttttacttcttaaatgattggaattgatattggttcccacaccgtaatatttttcgccatcaataaagatattagacaggcttgaacctaaagtctccgctaaaacacagctcgctcctccatgcatgatcccaaacggctggtgagttcttggcagaacaggcattgtggctgtaagggtttcattttccagatcaatatcgatgaattttatttcaagtgttttggcaagagttacatctccccagttattgatgaatgctaatatttcttcttttgtctgacctttcatttttaattgctaatgatgattgattaattttgctttacactgtcattttcattccctgttcccataatattgggattccagttggcagggactttagggacaatatcatttttcacataataatcctgaatttcctgcatgatctctgaaaaaggtactgatgctattctttcgtacggaatagtatatcccagataaacaatttttcttttgaaatcacctgctgccagtacaataggaacttttgccgccaatgccatgtggtaaaaaccttttctccatttcggaacccagcttcttgttccttcgggggtaattacaagactgaagtcttccttggaaaactgattggctacaaaattgacaagatcgtttttctggcttctgtcgataccaatacctccaaggccttttacaatactcccataccaggctttggtgtgggcatctttaatgataatttttaaaggcttttctaaagaccagtaggcgaaatttcctaaaatgtattccatattatgagtgtgcggagccactaccagtatacatctgttcaggttgttgacatcgccctgcagaacgactttccagcctaatatctttaacattgctttgcctatcagctttttcatagattcttggattaaaaacaaaaaagtataaccaaactttggttatactttacaaatatattgaaatattatcgctcttaaaacaaaccgctaattaaatctacgattttcattacgaattccattgcaaattgtatcatgatgaagctgtgtttttgtttatttggttattaaatttttagctttacgaaattaaaacatttttttcatattagaaactaaatactgttttattttcacttttctgagagaagaagggtgtgaatttcaaacggttgccatccactcacaccttctaccactctctgaagttaattatttagtttgtatggaaatttcgttttttccgtctttgattttgatgtccatatccttgtttgatttcttgatagtagacacagcagaatcaattactttctttgcctggttgttcggaacttttttaccgtttacaatgatactgtctttatcatcagagttgtattcgatactggaaccgtttaccgtgattttattcttttcaattcttacattgttatggtcgtcatcattatcctgatcgttgtcattgataccatctccatccaggtctccgtccatgttgatgcggtcttttttcattgaaataacaactgttttttgcggaactacaagttcataatctaagctatagtctctgaatctgtgctcatatggatatttgatgtagttcggaagtaatactttattatttaccacttctacagggactgtcatctgaatagggaagttatatccttttccttcttttttgatgatcagataaggcgttttgatatccggttttcttgtaacatctacagagatataatcttcttcatacactgattttttatcagaataaatatcattgtcatatgctttgaagttctgagggatgttgatttgctttacatctacatatactgtatctgaagtagtgttgatggctacattttctacatcctctttatttcctctatagatcatgtctttcttagccatgctgattccgaagtaagttccaagcccgatcagaagaagaaataaacctcctacaacccatccgatatttctcagctttgtttttggagagaaaatcttgatgcttaataagctgaaaaggattgccggaattaaacttccgatcaccatcatcgcagccagtactttatccagtccctgatcatccatatagaatctgatctcattagctccggggaagtctgtgtccattgcgaaaagggcaaataatacaaatactcctataatgcttcctacagccatcagtacgaagaatcctcctacgatgtacttaaatacattccagattccgcttcctgcattgttgatataaggtttgttttcagtatagatttctccgaccctctgagtagattcattggcaaattgtaccagtttattagactcattcttaagattgtcgaagttcataggctttccctgcattttcaggaaatctgctgctgtttcagcttttggaagtacgatccaaagaattacatataaaagtcctattaatgaagaggaaatagctgctgtgaaaattcccaggataaagattccaagccagattgctctcattgcagtaatatccattcctacatattgagctaaacctgcgcaaactcctgctactttttgtttttccggatcacggaaaagctgttttttatctgtataataagctcctgaattactttttctggcagatgttttttcggaaaaataagcttcttcctgttcttcgattttttctgggcttccgatctgtgcaatcaccttttctacatcggtgtcattgatcacttcacgttttcctaaagaatctttgaagatttctaccattctaatttctatgtcatgcattacctcatccgcttctgaagcctccagtgagcttctcagtgcattcaggtaatcgctgagctttatatatgcgtgttcttctatcgtaaaagaaaaacctgcgagtcctattgagagtgtcttgttcatagctttgttttttaattttgttgggtgatttgatttactgaggctgtcagctcattccatgtattgagaagttcatccaggaaaagttttcctttttctgtgatctgataatattttctgggtgggcctcctgtagattcttcccatctgtaagagagaaactctccgtttttaagtcttgtaagaagagggtagagggtcccttccactacatccagttttccttttttcagttcatcaataagatcggaaacatacatttcgcggttattgatgagacttagaatacagaattccagaattccttttcgcatttgcgctttggtattttcagtattcatctttgataagttttgttaattagttatatttttagaaaaatgctcctagctagctgagcctattctaattttacattacaaagatatgtaaataaaatggtattatgcaatacaaagtagtgaaatttttaaaataaattatttaatcatctgataatcaaattaataatttttattgctgttttttgttaaaatgaattttggcaaaaaatgatgaaaaaactttaaattttaacacaccaagaaaagattttctacctagtctaattcatcttttattttatcattcatcatccatcacttattattataaggagcttgggttttgagatcgggataatgattcgtatttttgttaggaaaaaacacctaatccatttaccagtaccatgaacattttgaacagctgtaagcacttatcggtatttcttttattgggccctttatgctttgggcaatatcagtttgaagtaaaaaatatatcaaagaaatataatgcgattttccaggtagaaaattgtaatgatggccagtgtggaggaaaaggaacggtagaattgtttgataataataacagcaaggtacagagttttgcttctgataatcttgttttaaatccggaacagggacaaaaattgattccagggaaactgattcctctgaccaatgaccagcgttcagtaattatagatgactttaattttgacggaaccgaagatgtggccataagaaacgggaatatgggaaattacagctcggcttcttatgatgtatatgtattcaacagcacaagaatggcatttgtaaaaagtgaagaacttacagacctgggctcaaatggttttgatctttttgaaacagatgccaaacgcaaacgtcttatttcctacggtaagtccggttgctgcaggctttttacaacagaatatgctgtcattccgaacaaaggactggatagagtgctggaaaaggaggaagatatgaccaatgaggatcaggtaaaggtaataacaaaagaaaagatcaataataaatggattaccaaaaccaaggtgtatccggcagatcagtataacagaaataaaaagtaagatgaaaattcagaaagaaatcgattttatcctggcagtggatgccttgaaaaatgtgcagcgaagaaactacaatgccgatgattcccgaagggagaatacagcagaacattcgtggcagattattatcctggcccagatcctttatccatatgctaaaaatcgtgcagacattgatttgctgagagtaataagaatgctttccattcatgacctggtggaaatagaagccggagacacttttatttttgatgaaaaagcaatggtaggaaagtttgaaagagaaaaagcatctgcccagaagatctttggaattctgaatgaacctttacgtacagagttctttaacctgtggcttgagtttgaggaagaaaaaacgccggatgctatttttgcctgcgggattgacagaatcatgccgtttattttaaattcccatactgcaggaaaaagctggactgaagcaggagtaacggaaaggcagatccgaaatatgcttgaaaatgcgatcagcagagcatctgatgaaatgggagaggcttttgagcttttaatgaacagaaatcttgaaacggaaaaggttttgaaataattttaaaaagacactgctcatttgtgaacagtgtctttttataaatagccttttatgaggtgagtaacaaataattatcagggtttaataagattccttcctgagaataaaatcctgccatactattaaagacataaaacctcagttcgaaatttttataaggactgtccagtttaaattttacttcttttccatctttagaccaaaccggatttttgaccataataatggtattgcttgtctgctttccatctacatattcaaatagtctcaactgaagagtggctgtctttttcattggttctgtgaattgcaccaccatattgtttgtatctgctttcttaaaatctttattgttggcattgacaatggaaggctgtgagattttctttcctgttttcttcgtccattttaataatggaacatacagtttgtccagacttttatgctttttgtaaagttcaataaccttttcggaaaataaattctgagcaatgaaaccacgtcggatattcactttatgatagatagcggaaagactatccgttttttcttttggaaatttttctctgataaataaatcataaacagcccatgtcatatactcattaaatgaattgatcccaggatatcctgagtttttatcccaatttgccagattgaaacttgctgctatttcttttgagtatttatctgaaacagggtttacatagccatgatcaatttctgaaaatacagtgtgattatcaagaatccttcttgctagattatcttttaaatttccaaggataagatcttctccgatattaggaaagtcaacagttaaggagctgttaatatctctatggcaattctgtccgcctaccaaaggagaaatggcgataatatatttcttatctccttcattggctggtttttctgctattttatctaaaaaagcataggtatcattgatgtaataatactctttatagttatcaattaaggtattataaaactgttgatgatttttataaaaggttctgtaatttgatttcttcacaaaatcattaatcagttccaggttttcatctacttctttagggccaaatgaattgaatgcgaaatctcttttaagcatacctgcattatcaaaagaaaacgcataaaaatcagttcggaaacccaggaattttttccagtcttttctggaatagtttactttttttagcagtggatgatcttttacaggctcaaaataggatataatttcatcataatacggaggaattttctgaacatcatatggatctgtcttaccgtactctgtgagtgctaaaataatatttcccagttcgtagctttccgggagttcaatttttacgtctttttgtgctgttagagataccgaaaggatgagtgtaatgattaaaataatttttttcatgtaatattagttcttctatagtttagggaaatagtaggaataatttcctgagggctaaaattaaagaaaaatgtaatgaattccaatcagtgtttaatgaagatatattatagtgttttggaaaaatattcgggcggccagaggccgcccgaatatttagtatttatagtatctgaattggtttcttgaattcatcaatcgctacaaaagtaaaatcacctacaattgctttttctctttcgtaggagtacatctgctctgtgtaaatttcaacatttactttcatactggtttttcccacgtaggaaaccttcccgatcagttccacaatagttccggcaggaataggttttttgaaatcgatcttgtcactgcttaccgttaccactctttttctggcaaaacgggttgcggtaataaaagctacttcatccatcagctgcatagccgtaccaccgaaaagggtatcgtaatgattggttgtgttagggaaaaccgctttaaagattctggtttcggatgcttcaattctttcttctgtagtcatatatcattattaattaaagcgaaatgagagatatcaaaacaacagaacaatgacaggaactataggaattcctgaaacaattcatcagatcaatacaacttcagatcgcgaaagttacatgttcaagaaaaaggcaggtctcctgacttgtaacatcatttatctccttcccatgcctcgcacagtggatctttgataaagacttcagttacttacagttgcgcgacagtccgtgattttcacacggttcccttttaatctgcagtgatgcagaaccaatttctgtgatgaataagtataaaaacttttcggatgcaaaaataatgaatttattccggattgtggaaaataatctgactgattacccttcctttcttaatagtccacagagttgtatatctgttttctcctgaaccgttgatcatataaagaaaaatattatcgttgtccagggaagttactccaacgttctcaaaatccatggtaggctggaacatatttttgatagcttctcttacaaaaacagaacctcttcccggctgttgtactctgattgatttgatttcagtcatcccttcgagaagatcatttccgattccccagggttttactttatcaatggtaaggagttttccttccgcatctttttcctttttacgatatcctgcattggaaggataaatatcaattaccactttgcttctttgggcagtaggaattttaggatcagaattgtctgtgaaaataagtgatcttccgtttttggatttggaaggggtataggcgggaagctggtcaatataagcaatacgctctttattcaccattccttctttatcaagtgtttcataacgtacaaacggtttgtcatcatcctgtttttccggatatttgatccatatccattctgtttctccaggagcaggctttacataaacgaatacatcgcctttgcgcatacggatcttgtccacaatttttctgtaattgtctttatgaacccgcacattggcatatccttcttcagcttttaccactccgaaaggaactttattctgcccctttacaaaggccaaagaaaaaatactgaaagcagataaatagaatgctttgtttataaaagtcatcatgaaaattttttgatccttcaaatatataaattaaatgcttttcggaagataattataccgctgcagttcatttaaatcttgtatttgtttcagatgaccgtccgaaagcagatatataagttcggaaatatccagaacatctttaaaattatgatcagaaataataaatcctttatgtgctgactcctgaagtataattttctttagttctccagtaacctttggagaaagactgtgaaatggctcgtccagtaaaataaaatctgctttagaataaataatcatcagggtttcaataattctctgctcacctttggaaaggtttttaggtttatcatgaagaaaaggttgtacaaactctgaattaaaaagtaattcagtatttctttgattacaaaaaagaggaaccaggtttttgatttttatattttggggtaaaaagaggtcctgtggcaagtaggagattcggttttttctgtcggaaatgtttttcagaatagtgttgtcatattttataaactgagtatcaccatattcagttccgaagatgattttcagcagtgttgattttccgcttccatttcggcctaacaaacctatgatttgtcctgtttcgcatcctatataaatatcctgtagaattttcctttcattaaaagattttgttacactatcaacatgcagtctgctcataaaaataatgttataatttttacaataatacccgatactattgttcctgcccaaagaaacgtccttgaaaaacctgaattggcataaaagtaatattcacttttaaaccttacttcataaataaagtaatggagaagagctaaaattaaaagaaaacttaatccaaatgtttcaaacctgtggggtagcagaaaagaaataagtaatgaaaacaataaggcggggatcagtatctttttataaaagatccaaagaatagtaaagtttctggccatgttcaatactttatgaatagttgtctgatatctattatccgaatttcaaatgtattaaaaagaaaataataaagacgatatattactattttcatcactttaaaaaatgatattctgaacacttcattaaattttatttaaaatttgactaaatttgatattaatcttttaagctataatcatgaaaaagctagttctattatttattttgttcattatttcattttataaatgtaatgtattgaaggggaaagaaaatacaattgctttgttgttgccgccaacaaatgttacggttacggatataacccctacgagtgttaccgtttcctggactcctcaaattggtacaggaagtacagtatcttataataaagttggtcttccaggatcaggtggtacaacttacactacaagcagcagtataactattactaatttgacacagtgtactacttatgaagtaaaggtaagttatgtgcaggctggaggaggatattcagctcctgttatatttacaactcctatgtggtactgtatggaaaattctacagcaacaattactccttatctatatgcatcaaatgtgacacttaatgcaacagacctacctgcaatggttagtaattcaacaggaacaaaagcttatgcagattatcgatcggattctactcgcaaagtcaaattagttcgtggaagcagcaacaatactatttctgctactaaagccggaccagctgctcaaaatccaacaactatagggatttggattgattataatggagatagatcttttgactctaccgaaagaatactctactcaagtaatagtacagatataaatcctgtggcaacttttagtgtaccccaacaagctggacaagtagactgtaaagttgctatgagagtcatatctaatacaacaccttatttttcaaattgtggacctacagcagaaatacaggattatgaagttgaatttattgatgctgtaagtttgaatgttaatgaacgtgagatggtaaatcgtgaaataaatacttatcccaatcctgttgctgatattttaaatttttcagggacttcagaaataacagattatgaaatttataactccgcaggacagaaattgggagaagggaaaatttataattataaaatagacgtacatcatttaccaaaaggagtttattttattcagttgaaagacaaagaaaagataacccgattaaaattcattaagaagtaaacaaagagagaataccagaaggtattctctctctttatttgcataaattaatccttagattaattaaattctttcaagttcatccgcatcaatggttgttttgaaagttccgtaattgacgattactttattacgtgagattttctcaatagttccaacactggtgcttcctgtaatacggacacgctgcccgactttcatccacacagcacggtcagttttacgtttttcctccagtctttcattggtctcagcaattttttcaatcacttcttcttttttcaactgttgggtaatttttctcttaacgacctgcagacgtttggattcatccttatcagtacctaattttctgaatttttcctgttcaagaagctttacaaaatcttttacaacatcctttctggattttcctttggtatagctgtcgataaatgcttcgatcttatttccgaactgaagcttacggtgttcctcttcatacagcttctggaaattgaacagtttctgctgaagctggtcattaagcttctgaaggttatcacgtttatcctctacagattcttttctttccgcaaggtcggatttcagtttctcaacctcaaatttttcctgctgcagttttacaatcgttttatcgagattgacaatatcatgttctacctttttcttggcagaatggatgataaaccttggaattttattcttttctgcaacttcaaaggtaaatgaacttcctgcctgccctacttccagcttatacattggttccaatgtttcttcattaaagagcattgctgcgttttgggcatttgggagctgttctatcaccagtttgatattcgtatagtgcgttgtaatgatggcaaaactctttttgtcatagaaaaactccatgaaactttctgccagcgcacctcccagctcaggatcagaacctgtaccgaattcatcaatcagcaaaagcgtattggcatcagcctcacggatgattcctgacattttcttcaatcttgatgaatacgttgataaatggttttcaatggactggttatctccgatatcagtcatgattttttcaaagaaaaacatttcagacttaggatgaaccggaacgaggataccactctgaatcatcagctgtaataatcctaccgttttcagggtaatcgattttccaccggcgttcggaccggaaatacagataattctgttatgctccgttaaagtaagtgtctgtggatgaatcgttttattctctattttgtttcttaaccataacagaggatgataagcatctcttaatctcagtgttttatgatgattgattttcggaaggactccattaatcagttcaccaaatttcgcttttgctctcgtaaggtcaaggtcaaaaatatacacttgatatctccatagctgaggttgaaattctgccagttctgcagtaagtttacggagaactttatcgatttcttttttctcttcttcttcactttcacgaagcttgaagtagtgttttacaacactgtccggctgaatgtaagtaatggagcctgttttggaaattcctaatgtccttcccggaaccctttttttgaatcctgattttacagccagcaccctctggtcatcaataatggtttcccgtatatcgtccagaaaatcactctgaccatatgtggtaagcgcacggttgaagttttcctggatggcttttttagcaagctggatttcagttcttattcctttcagagctggggaagcttcattttttacttcaccaaaacggttaaaaaccttatctactttctcaatgatctcttttctgaattccagtacagaaacttcttccaataaagttgggaatgtttccggcatggtagggaaaaacttctgcagttttccgatctgttccgtgatggtttttattttgatgaaagcagcattttccaggcggtagttctcaatcagcatcagtttcagctcactttcaatatcttcatattcatcaaacggaatcgcatttgaactttcgaaacttgacaggtattctgacgttttctttaatgaaagttctgcctcgtctatttccatcggacgaagttgaagaattttttctcttgttttcggagaatacgcaaatggggagatttccgcgagcaattgcggaaactctaattcgtctaaatcttctttatctatatacacagtgcaaatttagtgagaattttgattattacgtatatctgagagatttacagaataaattaaccgggatttaaagttttaacactaaaaaataaacctatgatatttcttttattaaatttgaaatatgaaactggaaacccaaagattattactgagagatatcaacgaaagtcatgttgatgatattttgcgaatccgaagcaatgaggtgatcaatcggttcgtcattaggaagtctcctaaaaataattacgatgcactccagtttattctgacaatcaaagaaagaactcaaaataaccaaaccatctatttgggaatttcttttaaagatcagccgaatcttatcggaaccatctgtctctggaatttttctgaagaccggaaaacagcagaagttggctatgaattgctgccggaatatcacaggcagggaattatgtctgaagctttgaaaacggttttggattttggttttaatgaattgaatttagacgaaattctggctattacgaataaatttaatgaaaattcaaaagggattcttttaaaacatgatttcattttattggaaggaaagaaagataaaggcttccctgataatattatttttagtctgaaaaggctctctgtcagccaccattaaaaatccaaaaggttttctctatctttatcgctgattgaaattacctatgaaaaatgaaataaaatctttaacggggcttagaggagttgtcgcattatgggttgctttttttcattttagttttttcaggaatgaattcattcaggatatagtagggaagggctatgtagctgttgatatcttttttgtgctgagtgcttttttactaacggtttcttattctgaaaagtttagaaatctgaattataaagtaatagaggtcttttacaaaaaaagaatcaacaggatttatcctgtttacatcatatcagttgtttttattgtactgtttttagaaaaaagctctataattggcttcctgatcaatgccacattagtacaatgcttttttaatcccaattatctgctgaatatagtttattggtcgctaagcacagaatggatctgctatttgatctttccttttacgttatggattatcctgcgttataagattcgcagtgaaatcttaattatattaagtttaattctgaggtggatgcttcctcatcttcccggtcatttatatataggttctgaaatgccattgaaggaaggagaatcaacagcatatcttgatcttccttatggccttgtttcccttctgagaaccgtttcttcctattttcttgggattggggttgcccttttaactccatttaaaacaaaaaaagaaaacctcatcatttatattgttactgtaatatttatgtccttgttgtttattgataaaggaccattgtttattcctttattatcagcattgatgatcaaatgtctgtatgaggggaagaaaaactatctgaagacatttttggaaaccaaaacaatatattttttaggcaatatctcatactcattgtatattatccattatatggtgaagaagcagaatttcgttattgtacataattatcatcttaataatctgttattactatctttttcattattaatgtcttacttttcttatatgctgattgaaagaaaagtgaaaatatttaaggtatgattgttgcgcctattttattttaatattattatttttgcaatatgacctggacagaaattttagccccgataaaaagtacggaatactttaaaaccctttgggaaaaagtgaagaatgaatatgcaacaaccaaagtttttccaccaaaaaatcagatcttcagagcattggagttaacggcttttgatgatgttgaggttgtgattattggacaggatccttaccataatgactatcaggcgaatggattgtgcttttctgtttccgaacaggtagctgctccgccttcccttaagaatatttttattgagttaaaagatgacttgggagtggtaagaacttccagggagcttgatgattgggcaagacaaggtgttttgttgttgaatgctactttaacggttcgggctcattcacctaattctcataaagatctgggctgggagaaattcaccgattttattattaaagaaatttcggataaaaaagaaaatgtggtatttgtattgtggggcgcttttgcacaaaaaaaagccgaacttatagatccggctaaacattttatacttaaatcagcacatccttctcctttttctgttcacagaggtttttttggaagcaaacctttctcaaaaattaatgagtatcttgtttccaaagggaagaagcctatttcctggtagaaccagcggattgatctgcttttttgattgtaattccgattttgtattttccggctaacgcttttgctccatcctgttgtttaggatatggggcaatatcctgtagtgtaatcgtatatccgttaaactctgttgattggtgataatttcttgccggaaaatctccgctggcaagattcagaatcattggtcgggtagaagttcccattacctccacctgggcaacagcaactccggcccagatacaattgacaccttcgggacagcggctgtcttcagaaattcctttgaatgtaacattcatctgatattcccttaaaaacttattttctccttcactaaggtatataacaccatcttgctgattattggcgcttgtagatttcgtacctgctggcatttcagtggcttttgtgtttatctttgatttcttttgggcatcgcatcctgttaatgcaaatattcccaggctgagtagaacaattttatggaacatagtttcttatatttaattaaatgacgttaaacatattaagtagtactaccaaaaacattgccactcctaccacaaaactgaatcctgttccgtagatgaacccaatcagtgctcctttggtagatcgtaaggctttattcatatccttactgtcatgaagcaattcaccgatgaatacccctgcaaacattcctatcagaaagcccaacggaatcggaataaatattccaacaatggttcctaccacagaaccgatacttccccagcgtgtacctccatattttctgttggtcttcgccggaatcacatagcttaatactacagaagccgcagtaagaattccaaatgcccagatataaatcataggaagatcagcatctgtcccgaatttatagatcagaagcccgcaaatgcttagcaaaagccctggtaataccggaagaaaagttcccagtatcccgacaaatagtagaataaggcagaaaatatttataactgttgtatccattctttttaaaaatatagatgcaatataaaaaaagtggccttataaaaagccactttgagaactgagttataaaattttattacaaatttaagattacgtattccaggatgggtcctgttttaccgatatttccgcttgcatggttatgaaatgtggtataatagatatttccgctgcttgtagttcctgaacatgagcccacataatcgccatgtgcctgatgggcgctccatgcgttctgattaatggtaatggtaacattgttaccatttgccgtatgatggcagatcgtcatatgatttttgttcaacgacgttcctaccgggattttaggagctgtcgtgtctacatatttattggttcttatcatcagtggctcattacctttctgtaccaatacttcccagaaattaggatcataatgctgaattttttcccataaagacatatcatactgaatatccagtgtgctaaaccctaatgctgctgccatagcagtattggtaacactacagttattatacatagctgaattgccagtgttattaaaacaaatttttgtaagatcaagaaaccctccataaatactgcagcccgaaacatatttatctccgcctacaaggtaggcggcagcccagtccgaagtgtaaatgcttccgccattcgtaataaaagtagagagattactgaaaacagaaagatcattgccgggagagttggttcccgtttgcgctggattacgtgaaccacagttcagaaaaataatatcatactgggaaatggtgttgaaattttttaaatcctgataactgatttctgttgcggtataaccaagacttgtaataatggcctctatttcgtcgtaactgccttctacataagctatttttgcaatctggttcagtttggaatctttgccggcaacagtggttgtctcatttttgttaacggtaatgggaatctcggttctgaaattaagaccattacctgtctggatgtgaagaattgtatttccttcaggtaccgtcaggctgaatgtaccatctgcattggaataggtgtggtaaacctgatttttattgtcaatagtgaatacaatggcaccgccaataggttttgttccgtttttagcaaataccttgccttctacagttccggtaggtattttggaatcttccgggctgattgagtcatcactgcctttacaattgaataacaatacaagggtgcacagcatgatgaacaaataattttgtttcatatttaattgattttgattggtttagttttaatcaaatttaataaatttttaatattaaaacattaaatatgtaaattattttaatatttttcatgtaaatctattatttgtggtttatttttcaattataatcgtggcttgtggcagatttgatattttctgtgataaccgttccataatttttattaaatattttccggtgcataccctttgggatgaaaattgattatgaatagtaaaatgatgattcttaatttcataaatttgctgtaatgaatgaccagttacaagaaaccaaaaattttatacaggagctgagtgaacagctctatatctatattacccgcatttcacctgccgggctggactgggtttttcacattattgtaaagctgagtttacttcttattctgtttttaatcactgattttgtttttaagtttatcatcaattctgtattcaggtcatttcacaatgaacagaagtttccgatcttaaaatctgtttatcagtcaaaaatcaccaattctgtagcccactttgctgctttaattgtggtgggtgctattcagggttccatatttccggaaaatgcactgccaaaaacaaccatttttattataagatgtgtcaatttagggctggtactgatacttgcaggaatgctgtacaggtcgctgactgctttcagaaattatttcagcatcaaacaggatttttataagatcatggcacttaatgccatctcggaaacggtaaaaatcttaggacttttcgtatttacagtagtagggatctgtgtgattttcgggattaaaggaacaacaatcgtaggaagtcttggggctattactgctgtgctggtattggttttcagggatacaatcctgggatttgtaacaggtcttcacgtggccacttctaaaaacttaaaagtaggagactgggtaagcattcccaaatacagcatagaaggaaatatcacggagattaatctgttgactaccaagattaccaattttgataaaacagtgtccaccattcctacctatgatctgatgacgactgagatcaaaaacatgcaggtgatgtctgagtccaataccagaagaataaaaaaatcaatttactttaacatcaattcttttaaatttctgacagatgaagacattgaacgtttaaaggagattaacctgatttcagattatcttcaggaaagaaccaccgaaatcaaaaaagaaaaagaaagcctggtacataaagataaaattgtaaatggaagacagcttaccaatattggtgttttcagatattacgcacagaaatatattgaaaacgatcctgatattgacaaaaacggtacccggatggtccgtcagctggatatcactccacaagggctgcctcttgaagtatactgctttgccaatgattccaaatgggagcgttttgagcagattcaggcagatatttttgatcatctgctggtagcttcaaaggaatttgaacttcaggtaatgcagataagcgtaaaagtgtagaagttagaaaccagatattagaagttagaggctaagctcttttacaactgatgtttaagtaatgtaataaatataaaatttaataatagtatggaggtgtaaatggaaatgataataacaattcgttatctaacttctaacctttcatatctaatctctaaaaataacaatgacaaaactaagcgtaaacattaataaaattgcgacgttaagaaatgcaagaggaggtgaaaccccaagtgttacagaagctgctgtaaaaattcaggaattcggagggcagggaattaccatccatccaagacctgatgaaagacatatcacaagaaaagatgtttatgatctgaagccgttgattaccaccgagttcaatattgaaggaaatccgcacaagagctttatcgatatggttttggacgtgaagccagagcaggtaaccttagttccggacgctgataatgctattacttccaatgcaggatgggatacaaaaaaacaccttgattatcttacagaaattattgctgaatttaaaaaagcaggaatccgtacctctatttttctggatcctttaccggaactggtggaatatgctgcaaaaacaggagcagacagaatagaattgtatacggaagcatacgcaaaaaattatctgaccaacaaggagcaggctataaaaccttattatgatacagctgttgaagctactaatttcggattgggaattaatgcaggccatgatctgagtctggaaaatctgaaatactttgccgacaacattccaaatcttctggaagtatctatcggacatgctttggtttctgaagcactttatatgggattggaaaatacagttcaggcttacttgaaaagactggctaaatggtaattcataagaaattagaagttagagattagaagttagtacaacttcaattatattaaaaatagcataaacaaattatgcatgatttatctaacttctggtttctcacctctaaattctaaaatatggaaattttaaactcaaaaatattcggcgaagatttaacgaccacgccgcttctggtatttcacggattattcggaatgcttgacaactggggaagctttggaaaagatctcggagaataccttccggtacatctgattgaccttaggaaccatggcagaagctttcattcagacagcatgtctcatgatgacttggctgatgatattgcccgttatatggatcattacggaattcagaaagcccatgttctgggacattcattgggagggaaagcagtcatgcagtttgctataaaatatcctgaacgtgttgaaaaattgattgttgtagatatctcacctaaagcatatcctccacatcatcagggaattatcaaagccttggaaactgttgacttcaataaggtaacttcaagaaatgaggtagaagcagttctgaaccaatatattcctgaaaggtctaccgtacagttcttaacgaaaaacctgtattgggatgacaataaaaaactgggctggagatttaatcttaaaaccctatctgaaaaatataatgaatttgtatccaatgctgttaaattcggagtttttgaaggagatacattgtttatagccggggaaaaatccaattatattctgccgcaggatgaatatggaatcaagcaacaatttcctaaagctaaaatagttacagtaaaaaatgcaggacactgggtacaggctgaaaatcctgttgattttgcaaatgttgtgaaggagtttcttggtttagattaaaattttactcttattttgggtgttatgttaaaattttattaaaaactaatattatttctccatgagttgaaatttttgtactttggattttcaaaaaacaataaaaatattaacttatggaaaacaaaaattcaaaaaagaagccattttttgctacattcctggaaaaacaggttaaagatcctgaaacagtaaaaggaggaggtattacttctgtgctggcagatcagattacgacatcccttcaggatcagatcactactcctcttaaggataatgttaccaagcctgataatgataatgtaaccatgaaatatccttctgacggtgatgaggatgttttagaagtatgataatatagataacataagctaaattatatttaaaccaaaactaaaacattatgaaaagcaacaactcaaagaagaaaccgtttttcgcatcattcctggaaaaacaggtgaaggatcctgaaacagtaaaaggcggaggtgatataacacttgccgaaacagatttgatcacaaagccgacagtagacacggtaacgtctccgaaagatgatatgatgcaaaccatgaaatatccatctgacggtgatgatgatgtaatcaaccttccactgtaagatcagacagaatattaaataaaatagcagggaaacttaaacattaagtttccctttttaataaaaccggcaaatgattctctgcatcacccactcacaggatttttataatattgagatcttttttgaatatctgaattccaaaaatattccttatttcagattgaattccgaccgcctgaaccatcttcagaagatcagcatctgtgaaaactcatttgaactgacagatgaatcaggaaatacaattcattctgacgatatcaaaggagtatggcacagaaaagcctggaggatcagtgctcctgaagagctggatcaggattatgaaaggatttttctcaacgaatatggaagcctgaggtataatctgatgacggctttggaacatattccctggatcaacccttatgaaaacgaaaagaaagtagacggaaacaagatatttcagctgaaaactgcacagagaaataacttaaccattcccaaaaccattttctccaatgatgaagaaaaaataacgacatttttccatcagtactgtcagggaaaagccatagccaaacttcatggggtaacctcgaaaacgatgtcaggagaaaatatgatttcgactacagttattgaggaagaatcccttgaacacctttctgatattgcatactgcccgatgattttccagccatatattgacaaagaatatgagctgagaattgtctacgtggacggagatttcttcacaggaaagatcaataacagtgaaaatgcagactggagggtagcgcgtgaaggatatttctggtcagcctatgaacttcctgagactataaaagcaagccttacttctatgatgaaagaaatggggctttatctaggagccatcgatatgatcaaaggaagagatggagcttattatttcctggaagtcaatccccagggagaatgggggatgctgcagaaagagctgggatttcctattgcagaaagaattgccgataatcttatcaaaagaatcaatttccatgaataaaattttaattataacccacaccgcagataatttttctattgaaaaagtaacagaatacattgaaaaaaataactgtgaagtcatccgctttgatgttgatgtttatcctttgcaaaataaactttccaccatttttcaggatggagaatgggtaagctttctcgaaactcctgaagcaaaacaccgtttggatgacatttctgccatctggtaccggagagcttacaatatcggaaaaggattgaaagaagaaatggatagtaaattttacggggccgcaatgggggagatcaggaacaccctttttggcttcttcgaatccgtagatgcttactctttaggaaagccaagtatataccgaagattagacagcaaggaagaacaattgaaaatagcagataaattaggtctgacaattcctgcaacctgccttaccaacaaccctgatgaagccagaaaatttattctgaagcatcagaacgtagtagccaaaatgcagaccggttttgccatctatgaagacggtgtagaaaacgtcgtgtttaccaatgttgtaagcgaagataaactggaagagctggattcactgctgtattgccctatgcagtttcagcagatgattcaaaagaaaaaggaacttcgtattaccattgtgggaagagacgtctatgcatttgaaatagattcccagcagtctgaagatgccaaaatagactggagaaaagacggtattaatctcatcgataaatggagcagaacagaacttccggcagatgtggaagcaaaactgcttgaacttcttgatgtttacaatgtagactacggagccatagacatgattgtttctcccgaagacgaatattacttcattgagatcaatgctgccggagaattcttctggctggataatcttacagaaggaaaccttatttccaaaagcattgcagacgttttgtgtgacaaggctccaagaagaaataatgaagtaatggcttaaaaacaaagcaatttgtaatcatagaagtcctgaaagctgtcaattctttcaggacttttacttctactattcagctgtggttatatttttcctgtttattgatttctgaatgataatattggttaaattaaattgaattatgctttaaaaatcgcaaatttgcagaagcagtttttctgaggagtttttacagatccggaagaattgccggatagaaaatattgttatattttagtcagcaatcaagtaaataattaatgatttttgtaacgggtgctaccggaatcctgggaagagtaattgtactggaacttcttaaaagggggagaaatgtacgggcttccaaaagaccggggagcaatttaaacgaagtaaggcattcatacagcttttatacggagaatcctgatgatttttttaataagattgaatgggtaaacgtagattttgatgatctcgactctttgaaaactgcgctgcagggtgtagatgaggtgtatcattgtgccgcaaaagtgagttttcatcccaaagatgaaaaagaaatgtaccataccaacatcaagggtacagaaaacctgctgtttgcctgtgaaggatcagaagttaaaaaatttcttcacgtaagctccgttgctgttcttgataattttaatgaaaaaggagaattagatgaagattctgactttaatccaaaactggaacactctgcttacgctatttcaaaacatttatctgaaatggaagcctggagagcttcagcagaaggaatgaatgtcgttattattaaccccggaatgattgtaggaagcggaaactggaaccaaagcagcggagagcttttctctacatttgaagacaatagctttaccttttcaggagggtctgcttatgttgacgtaagagacgtagccaatactgcaatcgggctcatggaaaataatctttttggagagcggtttatcattgttgcggaaaataacaggtatgccgaccttgccagacagatcagaacccgtcttgggcttaaagaagcaaaaattcttaccccaactcaactcaacgtggggagaatagcgaacatccttttcggatggctgattccaaaacttagaatggtgaccaaatccaatattgaagctatatcttcattcaacaccatttccaatcataaagtcaaagaaaagctgaattaccagtttattcccgtaaaagaaagtatagactttcacctgaataattatattaacgacaaaaagctgaagaaatgaatcttgcagaggcaattatccttaaaaatgtagaaaaacatcctataaaagcggctatcggatttaaaaagaaagatgcagcctggaaagagctgagctggaagaaattcagtgagattatttttaaaacagccaatgctttaaaagaagcaggtgttcaggaaaatgacagagtcgctatttattcagacaattcatccgaatggatgattatggatctggcctcaatggctgtcggggctattacagtacctgtttattctaccaataacgcagaacaggcagaacatatcatcaacgattctggtgctaaagttgttttagtaggaaaccagatgcagtatgatgcctgcctggaacttttacataaagaggaaaacaatctggaaacgattattatttccaaaaaagcagtgtggatcaaaaaagaatttaacagcttttatctggaagattttatagcaaaagcttcaccaaagctggagatctgtaagagggaatatgatgatactgccacattaatctatacctccggaaccaccggaattccaaaaggagtaatgcttactcacggaaattttatcaaagcgttcgattcccattttgaattttttaagtttaaaaactttgaagaagaattatcgctggcatttttaccgttaagccatgtttttgagagaagctggagcttactttgcttatatggcggggcgcgtgtttacttcctggaagaccctaaaaatgtagccaaagcactggaagaagtaaaacctacggcgatgtgtgcggtaccgagatttttccagaaagtatgtgccggagtcctcgaaaaggcggaagaaggttcatctttgaaaaagaaaatctttgactgggctcttaaaacgggatgggaaacagccgagctgcgaagaaatgaaaaacaggtccctttgggattaaaactgaaagaatctgttgctgatatcctggtcttcagtaaaattaaagaaaaaatgggcggaagactttggtttttgccatgtggtggcgcatcactttcgccggaagttacccgtttctttgaatcagtaggaattcatgttactgtgggttatggattaactgaaactactgcaacgttgacgcttttccctttgactcattttgagcatggtaccagcggaaaaccattgccaggcgtagaaatgcgtatcggggaaaatgatgagatccaggcaagaggtaacggtatcatgaaaggatattacaaaaaacctgaagaaacccagaaagtgtttaccgaagacggatggttcaaaaccggtgatgcagggaaatttgatgataaaggaaacctgatcattacggacagaatcaaagatcttatgaaaacgtccaacgggaaatatattgctccgcaacagattgaaaacctcctgacgaataataatttcattcagcagattatgctgatcgcagaaggacgacagtttgtttcagcgttgatcgttcctaactttgagtttttacaggattatatcaaaaagaataatattccttttaccaattgggaagatgctgtgaaaaatgaaaaggtaatagatctttacaaggagaaaattaaagaattacaaagccacctggcagattatgaaaaggtgaagaaatttaccttaatgccggcagaatttgatatcaatacaggagaaataactcctactttgaaggtcaaaagaaatgtggtaattaagaaatatgcagatattatagagaagatgtactaaacagtacctttaaattaaactatgacgacacaagaatttacaggaaaagaaaatttcaccattcatacacaaacggtttcagagagctgtccgtctaatattgccctgattaaatactggggaaaatatgctgatcagattcctgccaacccaagtatcagttatactttaaatcattgtaaaaccaatacttcaatggaatttatggctaatgaacctttttcagtacaaactttccttgccggaaacgaagaggtgaagtttgccgaaaaaattgaaaaatattttagaaatatagagcaataccttccatggattctgaaaggtaaatatatcatcagaacagaaaatacatttccgcacagctccgggattgcaagctctgcttcaggatttggagcgatagcaaaatgtcttatggcgttggatgcttcatttacagaaaaaacctttgaagaagaatctttgagaaaagcttcatttctggcaagattgggaagcggaagtgcatgcagaagcttatacaacgggcttgtggtatggggagaaactgatgaggtagaaggaagttctgatctgttcggggtgcagtatccggatactgaaattcatgaaattttcaaaaactttaatgactgggttttattgattcatgaagggcagaaaagtgtttcttcaacagtaggacatgggctgatgaaaaccaatccttatgcagaaagaagatttcaggaagccagggaaaactttgttcctatgaaagaaattctgaaaaacggagatatggagcgttttatcaagctggtagaacatgaagcgcttacactacatgccatgatgatgatgagtgatcctgcttttatcctgatgaaaaccggaacgttggaagtcattaataagatctgggatttcagaagagagaccggatctcctttattcttcacgttggatgcaggagcgaatgtgcatcttctgtttccaaacaacggttctgaggaacagatcaaagcgttcatagaagctgaattattacagcacacccagaaaaatggagtagtgaaggatgtgatgaaattctagtatgaaaaagaaaaaactttatattcttattgctgttgccattgctttattacttatgttttttgctgaatatgaggtaggaacagaaaccggcagctggggtagaaacagaactattaattggggatggaacttcggattttaataaaaataatgatgtttaatagaagtgggcttagcccacttttttaatcttcagtaacaacagcctcccggtcgccttcttctttttttccttccttgatcatgatttctgcttctgctttttcttcagcagtcgctttttcaatcaattcttcctgctcatcattgtgatgatctatgaaaaattcgcagtataccggaaggtgatctgaaccgaaattatccagggttttcagctgtttgataaagatatcttcactgtgaaacatcagatcaataggaaatcttaaaagacgatacttggcgtggaaggtagaaacaaaagaatgtcctactctcggatctatcagatgactggtttttctgaaaagtacagatgatcttgaccacgcgacgttattgaaatcacccgccacaataacaggctttctgatatcttttatacgtttggcagcacttaggagatcgccatccctttccttcgatgtttcctcctctgtaggactcggcggtggcggatgtacaccgaaaaaaacaaaagagaatccatcagctgttttcatgtgaatttcaatacttggaatatcatcagccacaaaataatgagtctttgcttctttaatttcaactcttgaatagaaatgcataccataggtgttttcaagagttactttatgctgataaggatattctttttccagtgatctcattgctttttcccaatcgctgttactttccatcgtcatgaaaaaatccggattatgctttttaacaaggctggagaatctctcatattctttattgaactgataaacattagccgaaataaaatgcagcttgtcagaagacctgtgaagctgtctgtgtttttttacaggatacagaggtgtataccttacgagagtccggctgtgatagacaaacaaggccaataaaaatccctgataataccatagatgttctttcgaatcgatgatcagcccaaacagaaaagtgaaaaaaataagataggtaacctgtattttagcaaattcaggaacccggaatatccagtgggagtgctgaatgttgggcagtacagtcatgaccagtaaaagtatggccagggtcatataaataatccacatatgaaactatgaaataatttggttacaatttaaggaaaatgaattttaaaatttattgatcaatttaaatttaattttatctatttttattaatctaaatctgttccatgaataaaatagttgtgttttttcttctgatcagtatttcaggcttcggtcagcaaaataaagatattgaaaaacctatccgtaacttgtttctcggcatgaaaaatgcagatcccgagctggtaaaatctgcctttacggaaaatgcagtccttcaaaccataacgaaagacggtactgtaaaaagtgacagtatacaggattttattgcttcagtttcaaaatttcccaaaggcgatctggatgaaagaattatcatagaagctgttcatacagacggaggcctggcgagcgtatttactccttattccttttatttaaaggggaagctatcacattgcggggctaatagttttcagttggtaaagcagaataatgagtggaaaattcagtatattattgatacgagaaggaaagataactgtaaagaaatacaataataaagttgaattcagaaataatttaaaagtaaaaaatgaaaatccatcatattgccattatctgttcagattatgctgtttcaaagaagttttatacagaaattttagatttgaatatcattcgcgaagtataccgtgaagaaagacagtcttataagcttgatctggccatcggggatcattatgtgattgagctgttctcttttcccgatccgccacagcgtccgtcacgtcctgaagcatgcggcttaaggcatcttgctttctccgtagaaaatgttacagaaaaacgaaatgaattgatagaaaaaggacttgcttgtgaagacatccgtatagacgagttcaccgggaaaaaatttttctttacccaggatccggaccacctgcctttagagttttatgaaatgtaaaattttagtgtgcgtaaccggtaaggaaactcaccgccataatcgctaaaacaatagaggaaatgactacatagacgtagtctttttcttttaaataccctatcagagcgaaaacaatcctcatcagaggagtaatgatcagtaaaagaatacccagctgaatgatggccataccttctcctttgcacagagaatcccagaaatatccccatatcttttcagaagaagtacctaccacaagactggtgtaattttcaggcattttaaaaccttcgaagaacagtttgataaaaccgatcagtgatgtcgccacagatagaataacacccagtctcagaagatttcctacggaacggttcagatctacatctgtaaaattctttttcattatctgaaacttttgttgataccgttatacatcatataaattgaaaggatggtaatcacaatggcaaaaaatacttttaattttttcgtttttgataccatcagcgtctttgaaccgatgaagcttccgatgaccacaccaatcagtaccggagctacaattaccggaataatttctcctctctgaaaatagatcagtgcgctggctactgccgttactccgatcatgaagttactggtggttgtagatactttgaaaggcagtttcatcatattatccattgccaataccttcaatgctccggaacctattcctaaaagtccggacatggcaccagcaaacatcatcattaaaaatccgggaactgtatttcttgcagaatagcttttcaatatgcctttatccggaaatgttccgtatagtttcagcttatcttcaagacttcctttgatcagtggctcctgatgatccggttttcctttaagatttaaaataaccgttaaaagaagaatacttgcgaaaataattccgatggtattcggattaagcattcccgaaacaagggcaccgatgatagctcctgctgtagtagctatctcgagaaacatcccgattctcatattggtaaagccctctttcacgaaagctacagccgcaccggaagaagttccgatcacagaaatgagcgaagcaccgatagcgtaatgcattggaacgccgaaacccagcgttaataaaggaataatgataactcctcctcctaaacccgtaagtgaacctaaaagaccagcggaaattgcgccaaggaagagtatgataatttctgacatactacaattaatgatacaaatataaaattattgtgcttgtctgccaaacatttgaaaaagataaatttaacgtatttttgtatgcatgaaaaatcatttgaaattattttatgtcattctgggggcaacacctcaaggaagaaatattgagcagcacgatgttttcttcggaattgcagagaatctgaaagacctggttccggatatgaaagacttttggaaggaagctgatgggaaaatccacgtagactgttaccaggaagtacaatttgctgacggatatgaagtggagattgtgaacaagggagaaaagtcatctgaagaccagctgttttttctcaatttaggagggtacaagcctggtttctttgaagaatttcatgagcagcacttaatggtaggaccatccatgggcgaaatcgtaaaaagagcaaaagctaccgaattttatcagacgatgggttttgaaggagctgtaagtcatattgatgataagcatggagtagatattgacgatatttttaatgtgagtgatattcttcctgcccatatgaaagaaaaatattctatcattcttaaaaaatctgatgcagaaagtcagaagaacccgatgggacttggttatttaaaaattgataagatccaataagaataaatctaataaaaataaaaaatgaaaataggaattctgggaggcggacagctgggaagaatgctgatacaaagtgcattgaagtatgatgatgagttttatactctggatcctgcatctgatgcgccatgtcataatatctcgtattttacgcagggaaatttcaatgactatgacacggttctgaacttcggaaaagataaagatgttgtaaccattgaaatagaacacgtaaatgcggatgcactggcagaacttgaaaagcagggaataagagtggttcctaatgccaatattatcaaaaccattcagcaaaagatccttcagaaagaattttataaagctcacaatattccaagtccggaattccaggtggtgtggaacagtgatgaaaaaatcatcatgccgttgccattcgttcagaaaatgaataccggcggatatgacggaaaaggagtccaggttatcagaacggaagaagattatcagcatatctggacagaagcttcagttatagaaagtcttgtggatattgacaaagaactttccgttattgttgcaagaaacgaaaaaggagaaaccaatattttccctgtaactgaaatggtggcagatccgaaactgaatcttttggactttaatgtatgtccggtacttttaacagaggatgttcagaaccagattgattctattacggagaaattcctaaacgcagttaattctccgggattatttgctattgaattattccttgataaagaaggaaaagtatgggtgaatgaaacagcgccaagacttcataattcaggacaccagagccaggaaggaaatacgaattcccagtttgagcagatgtaccgagtggtaaaaaatttacccttagctgataccgatgctatcacgtacagcggaatgctgaaccttgtaggagcagaaggatatgccggaaaagtagtttatgaaggaatagaagatgttctaagactgcctgaaacctatatccatttatatggaaaaacagaaaccaaaccgggaagaaaaatgggacacatcaatgtccttgcagattccagagaagagcttatggaaaagcttatacaggtaaaaggaatggtaagagtgattgctgagtaaatcatttataaaatataaaaaggagcggttttatctttaaaactgctccttttgttattcagggtattcaatagaaacggctttagcccgacgctattgatgatttaaatcttttataatcaaggatttttaaccacctcaatattatcctttttataattgtatttaatataacttcctaaagcggttgataaaatagagaattcttcaagcgatgtaagtggagcatagagtttaaaagtacagatatctgttgctgaaataaaaggattggtaactaaatgactatgggtagacatggtcactgttcctccgttttccaatgatgtaaaggcaggaataagccttgagtgaaactttttatgggaaatgatattcccttttttatcagaaacaaaaagataatcattaccgaacggaattactccatgttgtgcggtacctggtattaaatacaccttatagttttcattaaacggaataataatcatattaagactatatccctgtggtactgttacctcatattttgagtcagacagctgaggaataatagtggaacggatattttttaaaatattttcgttttcattaagccccctttctttgaaattttcctttacaggtttcatctggttatttttgaaagaaagttctgcaataatcatatcaccggccttattaagaaaggaggttttgatggtgtcgtttttctggtatgtgatatagcttcctatattttcagcaagtcttttattactgcctacaagatctcctgcatgccaggatgcattttcataagaatagagtagatttccttcagttttgatagaatccagcttctttttcagttctttatctgaaagagtaaggctttgtgcagaaataatgatggacataaaaaggaagagaaatccaatagtttgtttcataggttattttttcgagccaaaatacgaaattcaataggaatagtcttgagctctttcttaaataattatccattcaaatgattttagccgaaacataatttaggtttcggctaaagccaatttttttcctattgttcacaacgggctaaagcccgatcctattgatctattgatgagtgaaattttttaatgatctaataaaaatgattattggcagagaataaacttccaacatccctcttccagcttccatactttctaaatttcttttatttaaaaatcttctgaattacatttccaatctccacaaaatctccgtgattccctacagaacgtacctcgggactgtttttgtcatattctgagaaagggaaaatcagcagatagttattctcgcttagatttctgttcagaagttccggaatcagtctcattcttggaatataggatttcataccgcgtttcgccatcagaataatcaaagcttcatcatctttaagctgtgctgcggttttttctccgtcctgccaggtgctcatgataataaattctgcttctatattagctttctttatgattttctgaagaatatcaataatattttcaggtgcataaaaaacaaccgtagctccggagtttctggcaatgttccataccctcagcaatgcatggaagaatcctgcttcctggtgggcattttccggaatcattacggcatatttcttaatggtggaaagaggctgcgctgcatggtataccaatacattcacatcatcattctgcagataaccgttgtagagattgtaaacgaaagagggagagaatcctttttcatcttctaatccgatgatcaggtctgtgattttctgttctttaattacattattgactccattgatcacatcattgtcgtatctctttaaagcctgtaatgtaacatctgccgcggcagctgcatcagctgcctgatgaagaagtttttcagcattttttactgaagattcattcttatcttcattaatcacattcagggcaaacagatcttctgtattggagtgtgctttgatcaggattcccaggttcaccattctttcaactgttgcttcatggttaatggctaacaggatattttcttcttcatgtgtatttccggaaacggtatcttcattatcgctttcagcaattttctgggcacttgccatcgaaataaaggaggaaatggtacacgatacaagaatcaggaggatacttccattcagtacatgttcattcagcaatcttacaggttctccggtttccgtttcagaaagaataatattatatccaaccatcacagatgcaagggtggccgctgcagaagcggaacttaatccgaagatcagttttccttcctctttagtaagtctgaatgttttttgagtagcaacagcagaaaggtatttccctccgatggaagccaccagcataatagcagccacttccagcgtttcccagcttttaaagaacactttaaaatcaatcagcattcctacactgatcagaaagaatggaataaagatggcatttcctacaaactcaaccctgttcattaaagaagaggtgtgaggaataagtctgtttaacgccaaacctgcaaagaatgccccgataatagcctctacaccggccagttcagcaagcatggccgccagataaatcataaccagtacaaaaatatactgtgatattttatcatccacccgtttgaagaaccaacgtcctatgatagggaatacaattaatacaatcaatgcaaaaaccacaaaagacacagataatttgacccaaaattctgttccgacatctccctgagacatgcccacaattacggcaagtaccagtaaggccagaatatctgtgatcatggtacctccgacagtaatattaaccgctttgttttttgcaattcctaacttgcttaccaatgggtaggcaataagagtatgggaagaaaagaggctggcaaaaaggatagacgtcagcattgaaaaatgaagaatataatatcctcccagatatcctaatacaaaaggaactgtaaaggtataaataccaaaagtgagacttttccatttgttctttttgaagtctcccatatcaatttcaagtccggccagaaacataatgtaaagaagtccggtagttccggttactacaatactactgtctcttgacaatacgttgaatccgttggggccaatgattgcaccggcgataattagtcccaaaagatgcggaactttaattttattaagcagcaggggagctgcaaggatgatgaccagtaccaaaagaaatttcagtaccggatcttctatgggaagactcagattgtgtatactcagtaaaatcataagtgtttttattttgtggaacgtactaattcaacagagaacttggcggtacagccatcagaagtgatggttcttgttcctttgatcttgttgtccgaaatatcattaagaagaacgttcatttctacattctttttggctgtagaatctgttttgaaagacaatcttatttcattattctcaaatttgcccgtatacagcctcaccagattattgttattgataattttggtgacaggctgggtaggatcattatcaaattcccagatatcggtgcgctggtcacccacagcatattcactgcagttggattccgtacagatcacttttccgttccatgggccagagatctcggcaggccatgcagcaattaccacagaatcttttttagcaaaaatactgtctctcattttcagaagtgactggtattcggattctttcttggcaaaaagcttttctttctctaataattgtttttccctgtcgttcaggttcttttctttctctttgtaatcacagcttaccaataaaaaagaggcagccatcaataaaaaaaatgtgtttttcagcatattgtatcggttggagtatacaatataggaaaaatgaaggaaatatgaaacctatgacacgaagctctgattttaattgtatttaataaactcaaaaacagaagaatagaaagcctgatattcctgatgttattttttcttacgactcgattctttgttttttaaacatggctggattgtaattaatcacaaaaactcccacaatgatcagtattgctgcaatgatgaatttggcagaaattttttcgtcaagaatcagccagcttaaaaaaatagagatgattgtattgatataagccaatatggatacctgaacgggagaaactttggtaagtgcatagtgaaaggcaaaaaatgcagctacagaaccaaggcaggataaatacagcatggcagaaatacttttcaggctccagtttccgaaattataattttctgtaaaaagaaatgcaaaaatgatttgtacaatccctgcaaatgcaaactggtaaaaaaggttcagtgaaatatttccactttgaatattaagctttttcgtgaaaattgttcccgaagcccacccggcaatagcaataaataaaaacagaataccaagggcataatccggattcttaagatcattgatgccgtcccagaatatgaacaggattccgctaaaacatagtacaactcctgcaaaagcccgccagctgaatttctgaagtcctaaagccatgcttccgaaaaacaccagaataggagagcacgcacttatcagtgaggtcaggctgctggtcacttcttcttcagcaacggttgtcattccgttggcaaccacaagcattaaagttgaaaagataagctgatatttcaggttgttccatccaatccatttaaactcttttttataggtaagaataagaaacatgattacagcggcaagagattgacgtattcctgctacaaaccatgcgggaatagtttctaccgcaacccttatcgataaaaacgtagtaccccagacaatagcaacggtacatacagccagtgtaagtttataatctttcaatttaatgtggtgtgacagcaaatatatctattttaaaagggattgtaatggatacagatgcggttatttataggagtacagatgaaaaatttacgccaaaaaaatcattattaattatttaaatagtaaaatgtacatctattgaaaaaataaattgttccagaaaaattgttgcctttcacctttacgttttaattttttatctttggacatctaataaaattgaagatggtaggaattattatgggcagtcagagtgatctgccgatcatggaacaggctgcaaattttcttaaaagccttgatatcccttatgaactaacggtagtttcagcgcacagaacaccggaaagaatgttcgattacgcaaaaacagcccaggagagaggtttgaaagtaatcatagcgggagcaggaggcgcagctcaccttccgggaatggtagccagctgtactacacttccggtaatcggggttccgatcctttccagtaattctatagacggttgggattctgttttgtctatccttcagatgcccggcgggataccggttgctaccgtagctttaaacggcgctttgaatgcaggaattttagccgcaaaaattttaggaagcggtaatgaagaagtggcagctaaacttcagaaatatcaggattctttaaaggataaagtactgggaacagtagatgatatcaaagctcagcatcctaatcattttgataaatagtttattttaaactcaaaatagaagcctcactttacagcgaggctttttgttttactttttaatgaactttaaagagatagtctggtctttcaaaatgagttgtaaaatgtaatttcctttcaaaagaggtcctatattgatcatatctttgtttggatttccttcttgcacaacccttccgcctgcatcataaattttatagctcttaatatcatttaatccttcaatatggatatcatctaccgcgggattaggataaagtgaaaacttttttctgacttgtatgtctgatgaagacagcaggcagtttcctacagtatcacccgacatcgtccatcctttattgataagaatattccttttgtctgccgcatttgaagcgtatttcagaggtgctgtaatatctaaatcgacgttatttgcagtgttaggattgtctgcccatcctgccagtgttttactgaaattttcacaatccattcctgtctgcataaaagcttgggctccgttattaacgctggcaagattccagcttgcaagggattgattaaaattcggagtttccttaagaatctggtctattctcgtaaccttggtcatgtcccaattttccagggaatgattaaaggctgtgcagccatgaatagcatgggccatattggtaattttagaagtgttccaatggtctaaagattgattgaaagcagaatcaaaatggaacataaaacgaatgtcttcaaggcttgaagtatcccagttattcataggttgattatagcttgggcaaagagcaaacatccatttcatatcagttacattcgaaacgttccagttgtttaaagtctggttaaagagtcctcttcccgcaaacataaaactgagatcagttgcagaggacatatcccaactattaaagtagggaggattaaactgatcaggaagtgagctaataatggtgtcaaaaataagggcaaacataaacctgaaattcttaatcttagaagtatcccagttttgcatggaacttgcgcctgtaaagctttttgtaccataaaacatgtaagaagcatcctcaacattacttaggttgggaatgtctgtagcagtgatctgaacaagtttacattgactgaaggcattgttcattgatgtccagacaatatttccccattgttctatttccagtattttatcagcgcttccgttgacctgccagatagggaagatctgatcaggaagctgtgtctcctgtacttctccaaattttatttgtttaaaaacgccatttccgttacttacttttactctgtattttgcagcatccttatctccgtatgacatcccgaaatcaataaaaacttgctttgtggaagttacaccaacaaggcttccattatgctggggaaaatctacttcttcccagtaaatgtcatagttttcgccaattccgggaaaccatatttgttgatcaccagcctgataaggagcacttactgtaataggctgtgttacagtagaagcaggcttccagatggtgataaattcattctgggcttttatcatgcataccatcaaaattaaaaagactggcaaaaattttttccgtatcatattggttatttcttaattaattttgaagaaaatgttttttctttcgtgataagctgtatgatgtaatttcctttgggtaaagcgcttacattgattatatcattgttaggatttccttcctttacgagtcttccgctggcatcataaattttgtaatttttaatatcacttagcccttcaatatggatatcatctgctgcaggattaggataaagcgaaagttttttattcagctttacatctgatgaggacaataaacagtttccaacagtatcaccagtaaatgaccaacctttattgatgagaatacttcttttgtctgacacattggaagcatattttaatactgttaaaggacctaatgagatattgttcgccgtattgggattatctgcccatcccacgagtgttttactgtaattttcgcaattaagtcctgataatgttagagaaccggtaccattggtaagagaggccaaattccagtttcctaatggctgattgtagcttgttgcaccattcagtatatgatcaattctctctactttagtcatgtcccaattttctaaagactgattaaatgatgtacaaccatgaaatatatgagccatattgataactttggaagtgttccagtttaacggctgattgaagaccggaatcatatgaagcatgaagtgcatatcttcaaggtttgaggtatcccagttatccagacgctgattgaagcttaaacactggccaaacatccagctcatatcagttacttttgatacatcccagctgttgagagtctggttaaaatgagttctgtttgaaaacatatagctaagatttgtggcagatgacatattccagctgtcaagataaggtgggttgaattgctctgtcagcccagatggcaatggtgtatcaaataaaagtgaaaacataaaactgaaattccggatcttcgaagtatcccagttttgcatagagcttgcacctttaaaattggtagtaccataaaacataaaagaagcatcctccacattattaaggtttggagtatctgtggcagtaagctccataagcttgcatagactgaaggcgcagttcatagtagtccatgaaatattaccccactgttctatttctagtaatttatctgtacttccattgatctgccaaatggggatcagttgctcggggccgggaagtagctggaccgttccgaatctgatttgtctgaatgtaccgctgccattgctcacttttaccctgtattttgcatcggacccggctgataatgaagtgccaaaatcaataaaaacctgctttgtagaagtgatattggtaagagttccgttgtgctggggatatcctacttcctcccagtaaatatcataattttcaccaattccgggaaaccatatctgttgagaatttgcctgatagggagcatctacatttactggtggtaaaacagtagaacccggtttccagatggtaatgaattcattctgggctttcaccaggaagaccagcataaaaaaaaagaatgttggaaatttttttaaagtcatgtttaacgttttataggtattagttgtctttgcttactgtttaataaataggcgagggtagatcttattattcattaaacctgttagagaatgaatgtggaattatcagcactttcctatatgattgtaccggagattttttacaatgaaataataatgcagggagagaaaaggtaaaatttttgtacatgtcattagtttgtgaaataagcaaagctaaaatacgaaaaaatcaatataattttaatttaaatgtaaaatttataaaattttgtattgtttagcaaggttgtataatgaaacaaactctccggattggagagtttgttttattcctgaatcatgttgtcccgggtgtttttctgaacggctatggctccgaaaagagcgagcaaaaaggcaaaggcataaaaacccttttcacttggaaggatggtggcattccaaagccctattgccagtaagacaatagatgataatgtagcaaaccagcagattccgtaataaatatccgtaacctgaatattttctaatctgtctcttacggctttctgcaaagaaacaacagcaaataagccataaagcaggatggtgaaataatatcctttttcattcagctgcatttcagctcttgcaagaccgacaatgaaaccgatcattcctgctcccaatgctacccatgatgcagcaacaaatgcattcgacactctttgttttttcatagtttaatgttttattttaatagggctaagatattcattttttataaatacagccctaatagagggaaaatataggggaaaaccgggataactgcatgaagcaggtttatgttttgactaaagccaatagatgttatttttatttagtgtcaacgggctaaagcccgttcctattgaatgattatgatgatgaatcgaatttcgtaattccaattttcatagcttcgattgtaactttatctccaaacgtaagaaagaataggagagttggatatggaacgtctggtttgaagaatatgagtgagtacggagtcaacacaaaaaaaaactctccaaaataggagagtttatcttattgcgtgatgtattcataattgtactgaacagaaagacttccgtcagcttcctttccaacaacctgaaccggtaatcctgagctgttgtattgtatggtgtaagttacagtctggctttgctgccatactccgttatttttaaagcttattttttctacgagataattattcttgcttaaagtataagctcttcccatcataattttgatatacttattgatattggtgtaaggattgagtttgtcatcataagaaaaatcacttttgttgctgtaagttatagttcctccccatgttgacgtttcagatgaaatattgtttccattataaacatacgtatcagtgccaggattggaacaatcaggattctgacagagtgtggaagagatcacctgcccgttagcgttataattataggtggctgttctgttataattagaatttgtgtaaatcgcttttacgtttgccagctgatcaccattgtaagtatagactgaataataatctaccgtaccatcaggcttataataggttgtttttgagggttttccggcattgtcatattcgaaggttgaagttcttccttctgaaattgttttgattagttgtctctgattgttataactcaaagttgaaacaattgtttcaggattggaaggattatcgtaataaatagtggttaccttactcagcaatagctgaggctgttcagaagtgttggttccctcattatcatcattactgctgcagctgttaaagaataagacagcgcccatcattcccagaaataataattttctcatggtattttttttgtgggcaaaaataaggaatactgtataatgttatataaaaaaatcccactatcttaaaaaatagcgggatcatatcatgtttagatttcttttagtatctgtaatactcaggcttgaacggcccttgtacttctactccgatgtacgcagcctgctcaggagaaagagtttcaagctctacgcttaattttttaaggtgtaaagcagcaactttttcatccaagtgcttaggaagggtgtatacttcgtttttataagcagcagaattgttccataattcgatctgagccagagtctggttagagaaagagttagacattacgaaacttggatggcctgtagcacatcctaagtttaccaatctaccttctgcaaggatgatcacttctttaccttcaacagtatagatatcaacctgaggcttcacttcagacttcgtatgaccatagtttttgtttaaccatgccatatcgatttcattatcgaagtgaccgatgttacaaacgattgctttatctttcattttaaggaaatgttctcctcttacgatattgaagttacctgttgtagtaatgatgatatcagcattgtctaccacagtgtctaatctttttacttcataaccgtccatagcagcctgaagggcacatattgggtcaatttccgtaactgtaacgatagaaccagcccctctgaatgaagctgcagtacctttaccaacgtctccgtatccgcaaacgaccactctttttcccgctaacattacatctgtagctcttcttactgcatctacagcagattccttacatccgtatttgttgtcgaatttagatttagttacagaatcatttacgttaatggctggcattaccaaagttccgttcttcattctttcatacagtctgtgtactcctgtagtggtttcttcagaaagacctttgatatcttttgttaattcaggatatttatcaaaaaccatgtttgttaaatctccaccatcatccaggatcatatttaatggctttctgtcttcaccgaagaataaagtctgctcaatacaccagtcaaattcttcttcatttaaacctttccatgcatacaccggaattccagcagcagcaattgcagcagcagcgtggtcctgtgtagagaaaatattacaagatgaccaggtaacttcagctcctaaggctaccagagtctcgataagcacagccgtttggatcgtcatgtgaagacatcctgcgattcttgctcctttcagcggctgagacggtccgtattcttcacggatagacatcagaccaggcatttctgcttctgcaagggtaatttcttttctaccccattctgcaagggagatatccttaactttataaggaaggtattgtgttgtagtactcatatgtaatgaataattttaaattcaattgataacgaaaggcaaaattacaattaataattaagatataaaaacgacagatcaagttcagacttatgagattaagcatgaaattctgaactatgaaataaagctctttctatgcttaacctttgtacgttcatgtcatcttcttcaaatggtttcttttcactatttttgtccaataaaaaaagaatgccactttaccgagatttttcagatgataatgcaacgatccttgtttggaagtatgatgaaagtgaagaacttgatatcaatgaacttctggaaccggaaaatgctgaaaaggtaaaagattatcatcctaaaaaattactggaagtcctgatggtgaggaagctcttaaaaggactgaagcccggttccaagattttatataaagaaagagagccttttctttctccttatgatgcggaaatttccattacccattctttcccgtttgctgcaatagcgatctctaaaaataaaataggaattgatattgaaaagtttaatcccaagatcttaagggtaattgataaattcacgtatgaaaatgaacggggattcattcctgaggacaaagcggatactttttttacaattatatggagcgtaaaggaaagtatgtacaaaatccatcactcaaaatactggtctttaaagaaaaactatgaagtgaagcctttcgagctgaagcatcttcacaaaataagctgccgtgtctatgacgaccagttttcagatgagttcaaggcaagggtagagttttttgacgattactgctttacgattgtggaggagtaggatctgtttcgtttctgtatttttcgattacttttctctgttctttcgctacatcatagatcagttccagaatatcctgaatgtttttaagctctgtcagatgggaaaccttgtcggtatctcttctgtccacgatgtcattttcctcaatttcagtttttcttttcagcagcatatcttcaatagaagaatcttccggctccagacggctttccatttttaatgtttcattgatgtcatttccgttgagaagggtagaggtctgccgcatttctgcttcaatttttctgctccagctttccgcatctatttccggatattgctcattactttttgcatattgagacaaagatgcggtataggctgtaatcagatgggaggtcgccacaaactgatggacaacttccagttttttctgctgatttttaggatcagaaatcattctctggaaattatccgaaagattagccagagagataattgcatttttccgttttactttataatcttcaaggtcaaaatttccctgtaagaatttggaaattacactctgaaaatagataaggttatcggcagcagactttttcatcagatccagattttgggtatgttcccaaaccggcagcacaatataagatacagcaaaagcaataattccggcaatggctgtatcaacaattctgtctttaaagataatattgactttccctggatttaaaaaattaaagctgaggaagacataaatcgtcataaataacaccgcccagaaatatcgtcctttcagaaaactaaagcacataatcatgctgataagcagaatagcaaataaaatcccgttaatatgaacgaaatacaaaatagcataagcaatagttgcccctgcaatagttccgtacagacgaaggagatttctttgtttagtaatagaataggctggttttaaaatggctgtaatcgtaattaatatccagtaagtatgtcccagtccaagaaaatcaaacatagaaaaaagatatcctaacagcaatgccgttgtaattctgattgcatgtcggaaatgggatgatgataaagaaatattatttcgtaataccttggcgttaagtttcggctcattaggcataaatttccttaagtccaaccctgtagataaactttttgccagctttatatcctgtgaaaataccttatagatctcgttgatttctttagtgatctcataaatacgcatcaggatctgacgcaggatcatgaaattttcgaggttgtcaggagaaagctgtttatttctgagttcgaaataattataatttaaattctttaattccagttccagattgaacatcgctttggctcttgtaccgctttgaagtgcaattccgatattggtgatctcttctgccaaaagattaagataatcatgaatattcaccagaatcatgctgtcttcaaaactctgctgcagcttttgataatcactttcagaggtcatcagcttttcatggaggtccatggaattcaggaacatcagcatcaataaacggctggtggtcgtagattcattgacgatagttctggttttgaaaacggtttctctggtatcttcctgaaggttctttatttcaatctgctttgcgataacctgagtagtcagtttattaaagtccgggtttttctgataataattagctttaatctttaaaaagtcagccagctgaagataattttccccaatcatctggcttgccagcttataagggcgaatggtagttacaataaggaaaataagtaaaaaccatgtacatccggaggcaaatatcaggagacttttgaagatattacttcctgtaagatgtccgtcaataaagattgcgagtaccacaagagataatgagcctaccgcagccagcctctgaccataaaccccgatcagggagaaaaacatcccgaaaacaatgacttccagaaggaccagtattttgatattcattacaagacttgcaatgagtgccacaaatacaaaacagcagatcgcaaaagtaagggcatttcttcttcggataaaaggtccgggctgatctgtaagtgctacgaagctggtacctaacgggaaaaggaaatattcttttaagattccgaagtgggcgaggactaaacagggcagaacagtagctaatgtaattctgatcgcagaatatacatactgactggttacaaattttttgagttccgccgaatagttcatactacaaaaatagctattgaatttaagaaaatggccataaaaaagagacttttctcaacttaaatattatatttttttaaagtgctgtgttattatttaaaatagaccaataaatgaagcacgattgataattcatagatcaatgttggttattaaggtcaatggtgaatttttgcttcgcaaagtgaatggtgaaattttacagtgtaaaaaataaattgacaagcgaagcgtattgacgattgacgattcaagtatcaaaaagtgaattttgctttacaaagtgaatgatgaatgtttgcagtacgcaaaaaattgacaaacgaagcgtattgacggttcatcattgcctataaaaaagcctcataactaatatagtatgaggcttttttatatagctgttgctttttttaacggtctacgttggatgtttcgtcaccgatgttccaggtaagcccgaaacgaagtgtgttatccaatgcactgttgatcttggacatgttgatcaggtaagaaaggtcaagcccgaaagaacggtattttaacccaacacctgctgttgcaaactgtcttgctccctgctcttcgctttcatggaagtaacctcctcttacagaaaatgcgttgtcataagaatattctaaagcaccactgtacatgatactgtttttatttttgaaagattttccgataccggccattggccctacgttcgggatctggtaaataggctgtcttgtatttgggtctattccggcatattcagatcctggaaccaaaagttttgaaccttccacagaaattccgattctgttcatatcatccaggtacatatcatatccaacccctaatcttgccatggtaggaagataagatcttgattcttcatttcctgtataatccagtttaggacctaagttctgaactgctaaacctgcatttattttaccatcatagccaccaatactggagaaccttggagagttatagtatgctgaaacgtctactgcgaaactgtttgccgctttaagggtagtatctgtgttgaatcctccggctaagtctgaacggatgaatctaccggtaacagctcctgagaatgaatcagaaagtttcaatgcgtaggcaacgtcaattgagaattcgtttggttttgatgtacccattgatgcgatttctgtacctaccagctgagtcaggtctacctgtcccatattgaaataatagatactcgcggaaattgtagatctttcttcctgcccaagaaacttatggaacgaagcatataataagaatacatcattggtaagtttccccatataaggcgtatagttaagacctacggaagaacttgacctgctgaaagggtatttagccgcattccagaattgtgaaaatgcatccggagaggttaccaccccctgatctcccatacctcctgatcttgcatcaggtgcgattcttaggaaaggagctccggtaagaactgggtttactttacctaaatcttgcgaatagcctaaaaaaccagcactcaaaccaaatcctaaaagcagtttagtagttaaattcatatgttgtcttttatatattatcagttttttattaatattattgtctatgttttattttattatttcaaaagtaccattttttctacagctgtagcacttcctttgcatttttcttgattttgactttttgcaaatatcttaaaaatatacgtacctttcgctactgtagaaccaaaatcatctcttccatcccattctattgcctgacgaggggttctaaagccctgcaggaacggttctgcaaccaccggctgtgataaagttcttaccagtcttccggttattgtataaatctgtacgttcacatccagaatgtcatcacaattgtgttcaaactgaatataggtcttgtttgtaaacggatttggccagttcagcggacggttgatggtcaggtgctggtcagattcatctttaacttcaaaatttaacgtagcagttgtggaattattgtttatatcccaaactttaaatgttaattgatgctgaccgactgccagatttctgaaagggtaggttacattccccttctggtactcggcaagacttggatttaaacagccgtttccttctcccggggcgtaaaaatcatttaacacaaccgtattgataatctgcccgtcaagatataccgtaatatcgtgtcccactccggatcctgttgagttgattcctgtatcatcagtaagacacgcaagaagcataggattctggttggtaattcctccgtctgcgaagttggtattattcatgtatagctttactttcggaggttggttatcattgattccgtttggattgatatcacccacctgtaccgcctggttgttgaaaacatccgttgacttgttatctgcgtaggctaatattcttccctgccccacagcataattaatgtctttaggtacatagaattccgcagtaaatacaccgtttacagcagttccagcagattttacaatcgcacttccttcttcggtatattctaaaaccggagataaaacaccactgttatttaaggtttttttgtttaaccttttatcaaaaatattgatgcttacctttccgttaaaagtagtattcaatgttccgtttggattattgacgtgtccttttatttttacgaaatccagacctctgatcagtcccggaaccggcgtttcaatattatcaattaccagaagtctttgtggtctgcttaatttcatagcaggatcccccaggaagtttacttttaaatggttactgttgggtcctttttgctttttagcaagtaagtgggcatttcccaacgaattaaaatcgtcattggttagtttaaaaatattctgggtaaaggtattggtaaaatcacgtccgtaatctactccgatagcacggctggaagtaatcatggtagaagctccgccctgcttcattttaataaactgttctcctacagagttggttgcaggctcatcccataatgtaaattcacaggtgatggtagagacaaacggaaatctgctgtatacattagagaaattattggcattctgaacttcagaacttgtaaggactctttcctgtgcccacccattgattcctccatgcccgaaataaaacaggtacaaactgtttccgatagcattggagatcgcctgattgacctgtggatatcttcgtccgccggaagtactctgcgcggtaaaagcatccatatataactttttaacattatattctttaagttccggctgacccggctgttcaaatatactggatagtgaactgtccatcacattatggaaagggcttcctccttcattgttgtcatcaacaacaaaatcaagtcgcatacgccagtctccgaaaggggttgactgtccctgaagggaattgtaataagccagtgttttattgatcatatctccggcttcgcttgcattggctgccggaattctaccaaccggaagatccgggaggttgttttcaattaataatgtattttgtggcttggtcattacgatataatcatccgttacaaatgatgatacataatctgaagactgctcactctggtagctggccacaacatttgtattgttcggaactctgtttttataatcgtatgaagcatccccgagaatgaatacatactgaagtctgcccacaggagtattgagcttggtaacgaaatctcttattgcagtaaggtctctgcttccgctgccatattcctcatagatcttattgatgtcaacaatttctaccttatagttatgattggtctgatggtagctggcaagtctttgcgcctggcccatcatttccggaacggtaaggataaggtaatctacgttttgtatagcagacagattctgattggaaattcttcctacgaattgcggactgaaagctgcatcagcacggaaagccacaaattcattattgaaattctgatcagaagcagtataagcaaagttgaaagaacctgctccggccttattcacccttctgctggcattggtaatatccgttacatcccatacctgttctatggcagccgcattgctgatgctgaaaccatagttagtgttacttccgcttacaatagaataatctctgaagttcatctgtgagccattgaaagtaagattttccttatactgaacttctacataatcaaaataaaagcttccgttgggattcttggaaatatcaggattatacaccaatgtaaactggtttccggtaagatttgttaatgttccggagtaggtgacagggtagaaggtatactgatagctcgaagtatctgaaggaatcgtctgtatcggctgtggatttaagttgttgatcttaaaatcaatggtattctgctgggaattatacgctaccacctgagttctgtatcgtatcacatcattggcctgtataggtgaattggtagtaagcgttactgttttttcattggtgaaaggagtatcttccacccacgttcttcctacctttaacaggtttttctgatctttgttgatcacctggtagctgtcgtaccttgtgatcaactgggcagggagatttccgtcaacagtgggaactctttttcctgcacctttgtcaaagttgatatagtaatatgagaaatcctcatatatatttttaacattattgcttgggttgatacgggtttcatgtcttttaaaaccatttccgttggaagtatcataaaggttatatccgtccgggccctgcgcatagaaaagagcataatcattgtcattccatacaccgtcatcttcacctactacctgaatggcattttcctgtaatgccccgtatctcggatcctgattgtactcaggaagcatgacgcctccgtttccataaattctgaaattctttgggtttacagaagcaggattaattccgttatctttcaaaaactgtgatgtgattttgaatatcccggacttgtctacttttattttataaaaattgccgctggatagcggattggctgtagttcctattttattaacggtgccggaggtattaacaaatgcggaagcttctgaaacattgaacgaagataatctctgaacacggccttttacatttttaaataaagcaatgctgatactggcatagctgtctccttcggatgaatagtaagaaacgtctgctacatcatggtcaggaagtctgcctttatccagttcaaataaatcctggttggaaacgttctcccagacaaggtctgagatttttaactgcttttctccgattttttgcttggttactataaaaacattattttggctgaaagaaaaaccctcatttttaaaattgggaagaattaattttgtgtcaccaaaatcctggattttggaaccattccattcaatggtgtttctttgggcgtaaagtgttgatgcaaaagcgattaaagataaaagcgtaatttttcgtttcatgtttactattgaaattgctaaattacaaaataaatgaaaattttagaattaaattgtgatacaataaaattaatttgttaacgtttttcaaaaaaatcaaatgtttacttgatttattgaataatttattttttctttgtactttgaaaatatttatatcgactatgaaaaaactaaagttgttttcattaatagcattaagttctacacttgcattaaccagctgtggcggatcaggaaccagcaaaggtggcggtaccaaaaaatttgtcagcaaaacaggttggaaaccaaacgaaaaacagggttggttttttgcaggaaagcaacagaagcagaagggttggcctgggatggtatatgtagaaggtggaacttttacaatgggattagtgaaagatgatgttatgcacgattggaataacacacctcgcagaatgcaggtaagttcattcttcatcggagaaacagaaattactaactacgaataccgcgaataccttacatggttgaagtatgtattcccaccaagtgacccgagttttaaggaaatctataacggtgctttaccggataccttattatgggacaacaaattagctagaaacgattataatgaaacgtatctgcgttctccggaattcgattactacccggtagtaggagtttcctggactcaggcaaacagatactgcgaatggctgtcagacagagcgaacgaaaaagctttgatgcaggctggtattattgctaaagatttatatatcaatgaatctaacaaccaaggagggacagcattcaatatggataaattcaaatcgaatgatcctgaaatgcagggatacatcaatgaaaaaagaatgcagcaaaaaaccggtatgaaaaccacaaaccagagattgcttgctgctaacagagctcctaatgctgccatggtacagaagttcagacttcctaccgaagtagaatgggaatatgctgccctaggtatggctaaaaacagagaatataaccaataccttggtaagaagcctcaaattgaaagattaagaggtactaaaggaagagacagaggaatgttccttgaaaacttcaaaatgggtaaaggtgattattccggtatcgcaggatggaaaaacgacggatcagctcagacttctgacgtaagacaatacccatctaacgacttaggaatttacggtatgtacggtaacgtgtctgaatggaccgctgacgtttacagacctatcattgacgaagattacaacgacttcaattactatagaggaaacatgcctcaggctatcgtaagaaacggagacggaacttataaaatgatcgacgaaggtagtatcaaatatgatacattagctgacggaagattagtgtacagaggacttccgggacaattcgaaagacagactattgctgactacagaaactacagagacggagacagacagtcttctttagaatactacagagcagctgattctactgattcatttgacatgtacaactctcctaagaaaagctttgttgtagatgcaaacggtagagtgaagctgcagaaagattctaaagaaagaacttcaggtatttctaacgatgttagagtagtaaaaggaggttcctggcaggacaccgcttactggctggatccgggacaaagaagatataaaaaccaaaacaaggcttatggctggataggtttccgtgttgcacaggatgccagaaccagcgataagagtagaactagaagataatatttatcaaaaaatacttaaaaaaaaccttccggaaatccggaaggtttttttatttttgaaccatgaaatcgctttgcctaaaagtctgaaaatacttgtacagatctggcgattgtatctgatttcaatatatatatattttccacatgaatatagaacagttttatcccttatttctgcaggccgcaaaagtgaccatcgacagcagaaaaatagcagagaatgatattttctttgccttttccggtgagaatttcaacgcagcgactctggctgaaaaagccatcgatgacggaggtttggccgtaattgttgaacttccggaatttgaaaacagagataaaaatattttctatgttccatcgactctggagtttttacagcagctggcaatttatcacagaagaaagctttccattccttttattggacttacgggaagtaacggaaagacaaccacaaaagagctgattcatgctgttctctcagaaaaatttaatgtacagtatacgtccggaaatctgaataaccatatcggagttccgctgaccattctttctataaagcctgaccatgagatagcggtgattgaaatgggggccaaccatcagaaagaaatcgaatttttgtgtactatctcacaacctgatttcggatacattaccaattttggaaaagcgcatctggagggattcggaggctttgaaggagtgataaaaggaaagtctgagctgtatgattatcttaaaaataacaacagaacgattgttgtgaatgaaaacgatcctatccagctggaaaaaactgaaaattatccttctaaaattactttcggtaaagaaacttccaattataattttgaatcgttctcagaggaacattttgtagggttgatttatcagggagtaaaagccgtttcaaaactgacaggagaatataattttaccaatctttgtgcagctgctagcttagggcttcattttggaatcggttttgaaaaaataaaacatgcgctggaactgtatacgcctaccaatatgagatctcagattgtgaaaaaagagggaagaactctggttctggatacgtataatgccaatccgagttctatgactgcctctttaaataactttatcagttttgaaggcagtaaaaccattattatcggagatatgctggaattgggtgaagagagtgagagagagcataagaacatcctaaaactggctctggatcttcatttcgatgagattattactgtcggaaaacatttcaaggctgtcaattcttcagatcttgcttttgaaaatacaacggaactcgcagaatatttgaaactgaataaaattcaaactgaaaatatactgctgaaaggctccagaggaattgctctagaaaaaataatagactttatttagggtaaggaagctggaggttgggagtgggaagtttctgaaggcaatcgaagagtgttctctttttattcaactttataaaatttcattaataaataaacacttgaagaagtagttggccggaatataacttccggcttcattcttccagccctcttacttatttcttcaaatcccagaattcttttacaatcagtttaatatttttaaatgtacttggaaaaacttcattttcaatttctgatgtcgttttccaggcaacttcagtaataccttcttctatctgcggcttggaagtgtcttctccgtcgaaattcatttcaaaccagtgggtacacttcaatattttttcaccatttctttctacataaatgtgataagtagtattgatgaattttacaagctctacgtcgctcaagcctgtttcttcctctatttcccgaacggcagattcttctctggattcacccttttccatcttacctttgggaagatcccatttgcccagtcttctgatgaaaagaattttcccttcaggattattaacaagacctccggcagcctctataattctgaaaagcttctggaattcctgccatatttcatccaaattctccccatatacattcagttcctgcgcagaagtattctccagaagatccaatgcgatctccaaagttgtataattttcatacctaagctttttttcaagttcttcaggatgcttagatatcaataattttttttcgttgacaaaaactttatacatttgtaatagttaagaatttaaatacaaaaataaaaaatgaatttagaaggacgaaagattattgtcaataaatcatctaaagaacttaccgagttactgaaatctcctgaaaattataaagattttatgccggatggtcttcagaaatttgaaacaagagataacggatttaaattcggattacagggaatgccggagattgcgttaaaaattgacgaagtggatgatcacaaagctgttttaagatctgcaagctccagccttgatttctcattaacagcaacattgaacccgatcagcgacaaccagacagaggttcagatgttatttgaagggaaattcaatccattcatcaaaatgatggtagaaaagccgttacagaactttatcaatacgcttactgataaaatcgaagcttataaataatacaaaacctccaaaattggaggttttttgttttatgtaatttctatgctataactcctgagcaatgatcaacattacttcccgttgcagaagacaaaacgttgatctcattgttcatttttaaaacacccataaaggcaaatatcagagcttccttataatcgataatttccttttcaggaatgattacttcggcttttgttttggctcttattttttcaatcagaaatgtgttgtaggcacctcctcctgtgatcagaatatcttttatactgtttgcattgatgacattagagatctgttgagcggtgtgttctgtaaaagtagccagtgcatctgtgatttcaatattttgaagaaccggaaatatatgctggttacaccattcaactcctaatgatttcgggtgaggatgttggtagaaatctaatacgttaagctgattaagcaaatcttcatttattgtacctttttcagccaatgttccgttttcatcaaaactcttatgaagcttttgagccaggtgattcaaaacaatattcaccggggcaatatcaaaagcaattctctttccttctgatcgtaaggaaatattggaaaatccgccaaggttaagacaggcactgtatcctgagaaaagtaattcatcacctataggaaccagaggcgctccgtttcccttcatcaggacatcctggcttcggaaatcatagatcacgggtagtccggtttccagctttatagccctgccgtcgccaatctgaagggtaaaacctttctgtggctgatgaaaaacagtatggccatgagacgcgataagatctatattttcaagctgatgcagatggataaattctttaaccttttgtccaaggtaaaagccatatgctgaatgcagttccagaaggtcttcagcagcaaggtgaattgaatttctaagcttgttttcccaatcttcagaataggggaatgtttcggctttcagaattttaaaggtccatgtgtcctgcttttcaaattcagcaagacagatatccaagccatccagacttgtcccggacatgattccaatagccagcgctttcatttcaggtttattttttattttcagaaattcttttcgaactgaaatctcccgaattgttataaaacgtgtactcggaaaaatcatctttggccgtcattccattggctcctaccaatgtagagccgtcttccatggtaacatataccgtatctttggtatagattctgttttttttctgatcccagtaaatactctgcatggcaaatctctgcccttcgttggttcttattcttacatcgcctttggcttcgtagaattttttgtattcaaaaatacgggcgtatttcgcggtgatccttccaggaactttaggtttctttttatcaaaaaactcaatatcaattccttttctggctactacatacgggctgtcgatcagctcatacttttcaataatgggtgctttggcttttaaagtaacaaaaccggagtcgcgctgtataatattggcgttattgataatttgtgaaggaaaattcttgctttggttgccgttggctttggtaagatcctcttcacaggatgtcagtataaaaaatatagcacaactaaaaaggcatgctatatttttatatgatattttttctgaaaaattcattttagttataaagagtctttctgaaccatttgtcggcaaaattgaagccgattctaaggttgatgaaattctggttgatcaggttgttttgaagagttcctctcttaccaacttctagcccgatttcaagaccgctcattcttgtgatactgctgtttttgaatggtagcattaccccggcagaaataccgaacttgttaatgctgtttccttccagtttaagatttcctctttcgtagaatgctccatatctgtagatcacccttgagaagtagcttctgaagttattatagttaggaaggtaccatccccctgcggaaattctgtagctatcctggaaatcaaaagttttaccgaaataattgatatcttctccctttttataatctatctgaccagatacaaaccaatggttctcgcttccgtacccaaccccaagggaagcctgtaacggaagaaggtttttggattttgtttctttttgctcgatgattgtttccgaatcggtcatctttgtagtttcctgagcatcagaatatctgtatgtactgttagtgtactgtgtcgtcatgttacttgtgttcccaaaagtagcagtggctcctacggtaaacttcttgtcagtacgtgtatttaaagtctggtagcttgtaccaagcgtaaaattaaaatttctgattctgtttttagtctcataaccatttacatattcccctaaataagtaccaagattactgttgtaagcacggaattcattaaggtcattaagatctccgaaataaagattagcttttgctcccacagataattcctgattaatcttataagaaacagcaagctgggcagtatttaatgttccactacctttgaagctgtttttgtatagaggagtcgtattatcactggcaagctgttccgttacgatgtcgtagcttttggaactgtatggctggtaagagattcccattttcacttttgaagataatggaaaagcgatcgaaatattggaaagatacgtagaatgctttgtagatttcatatcgttatagttcgatttgaaataattgttttcgttggtagcttccagtctgatacttgtaagttcaaaattggcgttatttgccgggttggcaaaattgaaactactggtaaaatcacttataaaagcagtagatatacctcccattgaagtagtttcgatcgtattatcatatttcacatctccaattccataagctgcataaggagagttgcttagactctgtgcattcagaaaatatccaactgatatgaatgatactacaaagatttttttcattctttatttttaaaacaatgcgcaaatatcttaaatattaatgaattgtaaaaattatatgtggttaaagtttgttaagggcctttcttcagaagaaaaatgcaaattttcacgcatatatatagcaattctttatataaaaaaattattcggaaaaagagatttctttatcagattcactctttattttatagattaaagagacttaattttatgaattgaaataagattttttatctttgaaacatgaattgggagaatatcgccggacagacgaatctgaaaaaacttcttagagaaagcattgctaaaaacagagtgagccatgcccaactttttgtaggaaaggaggggtacggaacactccccatggtactggcctatgcaagagaaatcttcagccaggaaaatgaacatgctgctgcaaaagtagagcatctcaatcatctggatctgcacttcagctttccggtttttacggataataagaactcattaagtaagaataaatttgatgaattcagagaaatgattctgtcttctccttatgccagctatgatgactgggctgcctttttggagtcggaaaataagcagctatttatttctgcagatgaaattgatgatcagaatcagaaattttctttaaaaagttttgaaggaggaaccaaaatacttattgtctggagagcagataaaatgaatgtggccgcctcgaataagtttttaaaatttctggaagagccgccggcaaaaacggtgattcttcttactgccgaaagtaccaatgacatccttcctaccatcctttccagaacacagattgtagaaattcccagaattcatgatgaagatattgaaaactatctcaaaaagaatttttctgtttcggatgagaaagtaagagaaattgttcatgaggcacagggagaccttaatgaagccataaaattgctgaactcaggtgacaagtccaatgagtttgaaaagctctttgtgcaatgggtaagagatgcatttatggtaaaaaagaaacccgaatatctcagaagcattattttctgggcaagagaaattgcaggttggaacagggaaaagcagaaaaacttcctgaattattgttctgaaatattcagattagcattgcttcagaattatcagtccgaagatcttgtctataaaaaaatcaatgcgaatgggttcaattgggcagggttttcaaaatttataagtggtgccaatattgaaagcatcctggaggaaatcaatacagccgatcttcacctgacaagaaacggaaatcctaaaattgtctggacggatctgggaataaaattatcaagatatattcataaaagcacataaacaaactccggttacagccggagtttttattttaaagtacaatcagttatcatattgcttttagttttcttctttttttatctattatttaatggtaagtattcagaaaattcaaatactgttattagaaattttcattactattaaataaatgtgaactcttttttaagttgtttttcattaaaaacagtctttccttcagttttagcatctattatagaaactgtcttttctttgcgataaattaaatctatattaaaaaatcaatcaatcgtttgatttgaataaaaacttatgtaaatttgcgccctgaaaaatgaataccaacatgatttcaaaagaagagaatatattatttgccgccgaagagctctttgctgagaaaggattcgaaggaacctctacccgcgaaattgcaaaggctgctaatgtaaatatctctatgatctcatattattttggctctaaggaaaaactttatgagaaattagtagaatatagaatgaatgaaggtcagtttttttcgaaagatcttttgggaagaactgatatcaacgaatggcagaaaattgaaagagtaattgatcagttttctaataagatccggactcaaaaatgcttttacaggattatgcagagagagcagctgcataccaagaatcctcagattgtagaatttttgaaacagactaaaatgggattcctttccatgtattcacagatattggaaagcggccttaaaaatggaattttcaccaaaaaaccacctatctatctccttcattccaccgtaagcggaactttattttatgcattcaatgcaaaagaaatgtataaagaattcctgaatgaaacagaagatgaggaagcttttgacgaaaaatactatacagaacttaataaacatattaaatatttactaaaagaccttttaggttatgaagagaataaataactcagtgattgcattatcactattcataggaatagcccatgcaaatgctcaggagaaaaagacactttctcttgacgaagctgtgcagctgggaatccagaacagcaagaatctcaagatcgatgcagccaagatcgaagaggctacagctgatcttctggaagctaaaaacagacaactaccggaattaaaagtgtcaggtagctatatgtaccttccgattaaaccgaatgtggatataaaacttccgggtgtttcaggagcaggaggtcccgaggtacatcaggtagcttatggctcagcaaatcttagtgttccaatctacagcggaggaagaatcaaatatgggattcagtcggctaaatatctggtagaagcttccaagctgagcactgagaatgataagattgctattgcttataatgtagctcaggcctataataacttatttaaggcaaaccagtctattaaagtttttgaagaaaatcttgcagcttcccagaaaagagatgaaactttcctgaaaatggaaaataatggtttgatcgcgagaaatgacagattaaaagccaaccttcagacttcaaatattgaacttcagctattggaggcaaaaaataattacaatattgccaatatcaatatggatcttctactaggtcttcctgaaacaacggtacttgaagtggatgaaaattatattgaagaaggatcagatgtgaagcctgttgatttttatgttaatgaagccagagaaaaccgcaaagatttgcaggctttagcacaacagagaaaagcagcagaactgggaacaaaagctgcaaaagcagaaaatcttccttccattgcattcaccggaggctatgtggctgctgatattcctaagtttcttaccgtatataatgcaatcaacgtaggaatcggggtatcatacaacttatccaacctttggaaagaaaattcttctttaagacagtcacaggccagagaaaagcagcttgcggctactgatgaattactgaatgataacattaagcttgatgtcaacagagaataccagaacactgattattccaaaaagagaattgctgttttcgaaaaatctgctgagcaggctaatgaaaattacagaatcacaaaaaataaatacgacaacggtcttgcaaccatgactgaattgctggatgcagacgcagctcagattgctgccaacgttggcgtaatcaatgctaaggcagatgctgcactggcatacagaaaactattacagacaacaggaactttaacaattaaataatcagatcgaaaccaaaatggaaaataataatacacaggcagctgaacctaaaaagaaaaaaagtttagtttttcctatcattttagcggcagtagtaatcgggggaggaatctacggttacagagcttatacttacggacagtatcatgaagaaactgacgatgctcagattgcgtccaatatggcaccggtaatttctaaaatctccggatatgtagctgaagtaaaagtaaaagacaaccagtttgtgaagaaaggagatactttggtgattttggataacagagatcagaaaatggctcttgaacaggctcaggcagcattatctacagcgaaaagtaatatttccaatgcagaagctgctacaacagcaacttcgaaaaatatcgggtcctcagaggcggcagtaatcactgctaacgctcagatagaagcggcaaaagtaaatgtatggaaaacatcacaggacctgaagagatatgccaatcttgtaaaagaccattctattacagaacaacagtatgagcaggcacttgctgcaaaacaatctgcagacaaacagctacaggtattggttgaccaaagaaatcaaatcgctcagcagactcatattgcatcttctcagacggcggcaagctctcaacagatcagtgttgcaggatcagtggctaaacaaagagaagtagatgtagaaaatgcaagactgaacttatcatatacagtaatcctggcaccggaagacggatacgtaggaaaagtaccaacacaggcaggtcagtacctgcaggcaggatcacaactgtttgccttggtgaaaaacgaccagaaatgggtagtggccaactttaaggaaacacaggtcgataaaatggtggaaggccagaaagtaaaaattgagattgatgctttccctgaccaggaatttgaaggagtggtaagctcattctctccggctacaggagctactttctctattcttcctccggataatgcgagtggtaacttcgtaaaagtagttcagagacttcctgtaaaaattgactttgtgaatcttgacaagaatattgcaaaaagattgagaacaggaatgaacgtaaaggcagaagttgctttgaaataacatttaaattgttaaaagtcaatgaacttcgttgtcaatagtgaatcagctttgctgtcaattaaaacggtaggctttataattcaccattcatttgcgaagcaaaattcaccattgatttttcacatcgaaaaaaacttatgcaagattcattagtagaatatggagcgcggagagtgatcattacgattactgctatcctttgtgcccttcttgaaattgtagactccacgattgttaatgttgccttgaatgaaatgaaggggaatcttggagctacgctttcagaagtgggttgggtgattacagcctatgctatcgggaacgttattattgttcccatgacaagctggctctcacagcagttcggacgtagaaattactttgcggcatccatcatcatatttacggtattttcatttttatgtggaaatgccaccaatatctgggaacttgttttcttcagattgatgcagggtatcggaggaggagccttactggtaacctcacagacgatcattacggaatcttatccgattgaaaagagaagtatggctcaggctatctatggtctgggagtaattattggccctacattaggtccgccacttggaggatatattgttgataattacagctggccatatatattttatattaatattccgatcggaattgcagccactttaatgacgctgcagttcgtgagaagtccgaaatatgctgaaaaacgtaaagtttcagatgtcgattggatcggtatcggcttattggctgtaacggtaggttcattacagttcattctcgaaaggggacatgaagaagattggtttgaaagcggaatgatcgtggcctttacagtagctgcaatattaggatttatattattcctctggagggagcttaccttcaaatatccgattgtagaactccgggtattgaaaaatggaaacttaagaatcggaacggtgatgtcgtttgtattaggatttgggctgtatgggtcaacattcatcgttccgctttatacacagagtattctgggctggacggcacttcagtcaggagccttaatgattccggcggctttaacaactgctttcatgatgcctatcatcggaagattattgacgaaaggagcaaaacagcagattttggtttctctgggattgttcattttctttatctatagcttctggggatataaaattctgacaccggacaccagcaaagatgctttcttctggatgctgattgtgagaggagcaggactgggactgctgtttattccgattacctctttgtcattaagtacgctgaaagggcaggagattggtcagggtgccgcttttaccgggatgatgagacagctgggaggatctttcgggattgcagcaattacaacctttattgccaatgcaggccagaaatacagaaataacttaatttcccatctggatgagaacagttttgatgttcagcaaaggctggctgccctgaaagcaaactttattgcaaaaggaatgacacctgatgctgcaatgaatgccgcttacaaaatgctggatctgtccgtaaccaaacaggcaaccgttctttcctacatggatgtatttctttatctcggggtcatattcctgatatgtattccgtttatcctattcataaaagaaagaaagagcaaagaaaaaatagatttgagtgaagccatgcactaaattttaaatcaaaaccttcgaaattttcgaaggttttttttatgttattttcttacgtaaaatagtaggagacaataactttctgtttttattttgtaacataaaaataatatcacttgttggagagtttatttattttttctagctttacatagttttaagacttcaactacaatctcaaatactaataacttattatatgaatcaaatccagctgccggaaacgtacgtggcattatcacatttcagaaaacatgatgtttatctccctgagatgaatcaggctcagattattgcagatttctttcccggaacttttacagagcttacccagcgcctgtctgatattacaggagctttctatggaggaatgcttaaacaggtaggaaaactgtatggagcagaagcggtagaagagctttccagcacttttatgtatgatctcgggtcaagaatggctttaaagaaccttgaaacaaaatccaatctgcagcctgggattccggctgttgcaaaaatattgataggagcagtctttacatccagtcccgaatataattttgagtttaaagaattaaatgaccataaatgtgagctgctgatcaaaggcgtggaccggtatcataaaatcacccagagtctgcagattgcagggctgctaaaatggccggttataaaacctttcatacagggagtttgcgatactatggggctggatgttttacttgaaataaaagtcctgaaacttgatccggacagctcttgcagttatcatgtcatagtttcggaaaaatagaatgggaatactgaatactggaaaattaaaatacattcctgaaatatcaatagaagcggactttagtccgcttttaccattataaattgagaatcggcttcaaccaaaacctaaaactcacatcctgtgcccaagctcctattcaatcctctcaatccattcaatcccgctgatatcaatcagttttaaggaatgaatttcatttttttgaagaatatcgtcaatattcagggtcatatcggcttttgcccccaatggaattaccagactatgtttccctggtttcactttggcaacataatgattttgaatattcttttcaggaattccggcaagttctttgtgatcaagctcttttaaaatatttccttttttgtccagaatatgaatgcctatcaaaaaagagccgtatacatcggcaccttcagttctgtatacttcaaatttcagatctgagtaattatgggagatgtttgaaatttcaagcttcggttttactgatttattgtgaaaggttccccacacgccgccatggaaatactgattggtaaaaagggttagtccgaatatggttaacgatcctgccaatacgaaaactttaggttttgagatgggtaaacttccggatcccagccattgaaaccattttttctgagtaaagtttttgttgtttttcataaaataatagtccagtgaataagcaccacttcccgaaagaaacagagcaaatccacccgcgattcccagaacacctatctgccattcatcaagacaggttgttcccagccagccggaacccagtaaaattccaaaagcaagactgaagataccgatactcatcaggcgggtaaataatccgagaatgatgaataatcctacaatagcttcaataatggtaaaaatcatcatggagcgctgtaatgtatcgggatgagtaaccaggtattcaataacaggttttattccaagtgcattaggtaaaaaatgattgaatttttccccgacatatcccttttcatcaggaataagtttgttttccaggataagtctgcgccagaacgctgaaaaataagtccacccgatgaccatacggagggataaagtatataagccggccaggtccgaagactggctgtttacggtatgtttcattgaaattaatattgtattgtaaaaaactgatttttaaattgacttaaaggttttaaatcagattaagtttcagccttttaaacagaatatatttcggagggctttttcctgttgaatgaccggaatagatattgagaaagatcttttcttcaacagagttgtgtacagctggagtaaaaccagataagaatttattatactggttttgaactttgatttttgaaactgataggcctgaagaagcagatgccatatcgcagctgaaagaaaaagaggaagtggtttttaccttattcaatccactgataaactcaatgtcaaaaatatcaagaacattccttttaacagagcacggagacaatgaaaacaccaaaataagcatcgtaacaacagctttgtaagttttcatatggaatcctgaatggtgcatgattacaaaactacactttatttcaatgtaagcttaataaatttcaggaaatcattctgctgatctacaaataagtaatgggaacagttatcaatcagtttaaagtttttctttcccacaatattgttaagatcatcaagctgtttctctgaaaatataccgtcatttttaccatatacggcaaaaacagggattccttttttccggatattttttaaaactgtagtattatcaagattattcaaaggttcattctgataaaatgtaagaggagagttggggtttcttatattgtttttataaaattctcctgcctggtattcctttctcagcttttcactttctgaagtagggttaggcatgtcaaagaagccaagttttcctgccatttcatagcatctttttctgtatgcagcagaatttttatccagattttctattgctgaaatctctgttagctgtacaggatcatttttgaaatgttcttttgcctttttaagaatatggtcataggtttcctgctgggtaaataaagcacctgcaagagtcagcgactttaccttttcaggaaattgtgccataaacagggttccgataatcccgccgaaactgtgggcaataatatgggcctttttaatattatacgcggaataaataccttttaaatcctcaaaactttctttaaatgtcatggttgcgttttcatcttttgaacgtccttcaccgcgtctgtcatacacaatgacataaaatcctttatcagcaagtttttgcgctgtagttccttcaaataaggtggcatttccacccggtccgccatggataaaaataacaggcggatttttatgttcaccataagctttagagtataaattctgcgctttacagaacatggaacctatcataaaaagaatggaaaacagtgctttcattttaattgttttgagtcgtctaaactactaaatattctctgagcaaaagacaataaaatgatttgaaataatattaaattttaaaaattaaaatactgctgacgtactgttgtcacaatcctgctttatctttacagtcggaaagttttacataaaatataaaaatatggacaccaataattttgacaaaataataaaacgttccttagacatcagagaaaagtatcatcaactggaaatcaaaagtatcggatcagagtggacattggaagaagatgctctagcttaccttactgatgcagcattggtagggagaaatgtgatgtctcatcagaaaacgtgggtaaagaaagattctgcggatgaactggaacataagttggcagaaaatatctggtggctgattgtcctggcagatcgtacagggattgatcttaaagaagggattgaaaaattcttaactaaaacagaaaatatattgaaatgagttattgtttggcaatagaaggaatgaagcctgaaagcagaaaagagctgcacaagaattatcatgacaactattatgggtttcctattcacgatgacaatgaattgttcggaagattgatccttgaaatcaatcaggctggcttaagctgggaaactgttcttaaaaaagaagaaagtttcagaaaagcctatgataattttgatattcagaaaatagcggcttataccgaagaagaccgggaaagattgctgagtgatccgggaattatcaggaataaactaaaagtaaatgctgcgattgaaaatgcccaaacaatcattgaactgcaaaaggaatttggttctttcgaaaaatggctggagcatcatcatcccaaaacattacaggaatggatgaagctgttcaaaaaaacattcaaattcaccggcggggaaattgtaaatgaatttctgatgagcaccggatatcttcagggagcccatcatgaaagctgtcccgttcactcaaaagtactggcacaaaaacctttgtggaaaaaagctgaggaaaagtagaatacggattactcttcaattaacaagcctggattctacggaatgacaaatagaactgtctgacatgtgcatgaatgatgtcattccgtaagagtctcattattttaatcattctttgatgtctccttcatcagttctttatgttctttgccccatttttcaaactcaaggataatggtgttcagtttatagcctatttctgtaagttcatattctacccttggaggaacttctgcatacactgttctggtgatgattttatcctcttcaagccttcggagctgaagcgtaagcatgcgttcagtaatgttctgaagcttttttctaagttcaccaaacctcatttttccattgatcagataacagcatattgctaatgcccattgtcctccgataatattggaagcataaatttccgggcactcatcagcaagcgcttttttattggcataattggttgaggtttctttgattttagtcattacttacattttttatagtaccatacaataggttgctaatgtacgaaatgtacgttacgtgtagtaattttgtaatagaaatttaaacataatgaaaacattagtgattgtgacacatcctgatatagaaaaatcagtgatcaataaaaaatggattaacgagttaaaaaaataccctgaaaaatatacggttcatcagctatatgaagcttatcctgacggaaaaattgatgtagctcaggaacagaaactgatggaatcttatgataaaattgtatttcagtttcctttttactggttcagcagtccaccgcttttaaaacaatggctggatgaagtggttttgtatggctgggcctatggaagcaacagcggttttaagctggccggaaagaaaatgacactggctgttactgcaggaatagatgaagaagggtatagcaaatccggagaatataaatatacgatgaaggagcttttccgaccttatgaactcacttttgattatataaaagccgattataaagaaccttttgtttactacggaattgaaagagattcttccgatgagtggatcaacagaagtgttccgatgtatctggagtttctggataatttataagaataaaaggtaagttggacttgaattaagcgagttcagcttacttttgtatgtattcaaaaggttctacattccaatcctgaatatatttctttatggtattgctgtcaatgttaaatgggacatccttatatttccagccttttgaaggaacttttaaatctataagataattttcaatagagtagatgtcgagaacttttgcatttttgggttttatagaatcaaagatgatgagaaatttatctccttttttgtaaaaacaacttgttgttttaaagtatattttattatcaacctgatatttgtaatctgttcctaaaccattgttgtttttttgatgccagtctgatatagcttctccaatggtgtatttggggcttttgagcaggtcatttacccccaaattagaactaattaaacagaatatgataaatacaaaagtgactattaaaataatgatgtgaaatttttctgaaatcaattttttcatgctccggttctatatttctcattgaacttctgcagatctattgcctgctcctggaaatattctttaaatgtatctgaaagatttatatctttaaatttcacaagggtatatccgctgtcaaaagcaataatttctaaaatgctttcctgaattaaaaagtgatcaggttcccaaacacttgtatcttcaacagataagatagaaaaggctgaagtatcgggttcaatagtatttggaacggctgaaataatcccccaaatgatctgagtattgctttgatagagctgttcaaattccggatgatccaacacaaaataatctttatcaaaattaatgggaagagtctgatcagatataaaatctaaatccgtcaaaatccatttataaacggcaagattattccaaataggttttaaaacctcatgaagattagtatggaattttacgttttttgtacttctgataatccagttcatttattccttatttaaaacccggtttattcttttctctgcttcttcttttgtaatgccattataaaaatcatatacaaacggatgctcatagctttggtgaggataaacaaatggacgcccgatagaattattgactaccacggttgtaggaacactttcttcaaactcataatccggaaggtaggtggaaagccatccgaaatattcagcttcaaattccttattatcatagttttcaacatattcatcgaagtttttttcactcagtgaaacccagattccataatccagatctctacagtcatccactacttcctgtacaagtacagtacggataaacctgtgggtatcttcttcttcttttatgacgcacagatctgagctgagttctgtatttttcaattcttcttcagataaacaggaataaaaataagggtaagaataggcaattgccggccagtcttctttttcctctccgcagcattggcagatgtattttgtcattgtattttatttgtaaatgttgataaacttaaattcctatcctaccgtaggagtatcctcttccttcagtatttttttctccttcatggtaagcatcattctttcatatttatacttttcccaatcaaagctgttgagaaaatcaagggcagcctgaaatcctctgttgaacagttcttccttttcctctcttttcataaagaaattcagccagctgctggtcccacagttaacggtctgtatgctgtacagtttataaaaggtatgtttggtaagaaatgttttatcattaaatcctttcaaggtacttatgatatttccggcatagctgaatggtgttttaaggatttcttcactggttttccctttttccgaaaggatagcagaatcacttgtgagctgcactccaaaaaggggcattctcggataaaaaacttcatccgcatgaaacagatcaatagggaagttggaaatactgccaccatcaataaaaactcctgcaggattgatatcttcaggcttggtattcatccagtatcgccaggcatattttacagaatcatcgtctttattgatttgtttctgaaaaggctcaaagaaaaaaggaacagccatagaagcccgtacaaattctgccggactgatgtgcttcagctcctcttcagaccagtaaaggttagccatcgtgggaagttctaccttaatttgggcattgatatcggtggtaatgaccacatattcggatttgagaagataaaacggattatttttataataatcgttattgacagagctttcgtagaaaatccggtatcgggtctggtcaatatgctcctgatttttgattttaatcttttcgatgctttgtagagccatctgataatattcctgcccgtttccatatcggtaattaaggttgagctctctttctttctggataaattttttgttaagatgggcaaccgttttgatcccgaattgatccagcgcattctgcatcgttttctgaaaagtatttccgggattcagtccgctgttttcttttctgaaattgttgtaaagctttttgatacagaaaaataaaataacggccggtatcagaggaatcagaaacatcagtttcgcattcaggatcgttgttgaaggggccagaaaagggatactgaccagaataataaaaaggatagcggcaataacagcattgatcttaaaaaaatccttgttgttcagcatcgcatgaagggtggtttttacatacgtcttcccatccatgaaatctgaaaaatcccagctgaaaaggatatccttgatcagctcacttttagattcttctttggttttacaggctgcaataagcattgtattaatggcgccggcacttgttcctgccactttcagaaaacggatgccaaatatttccagaccgtaaagatagcctaccaatgcgcttccccagacaccaccaccttcctgaacaaactccacatactgatttccggattgatccagaagatcggaaaactctttgccggaaatattctgatgtaaggccatcagcttttctttggatgcctttgaaagggacgaatcttcaagaattttattgaggttttcagcggtcatggtatttttgttttattgggatgatgattaaagacaacaaataatcaacgggtcatattagataggagataggttttggtgtcaatataaaatctgatcaccattgttttcgccttacataaataaacgtagtgatcacaaccgtagccattgctcccaaagttataaaataaccatacttatgatgaagttcaggcatattgtcgaaattcatcccgtaaaccccggcaataaaggtgattggtaagaagtaaacggaataaatggccagaactttcatcacctggttggccttctgatccgaaagcgccaggaacatggaaataaggttggtgatctgaatattcaaatgatcaaaatccgccacaacatctttatgtttatcctttaaatcaacaaattcggagtcctgtaaattcaagagtttaaatttatcaatagcgtccgtagagatgaccagcacccgtgaatttaatcctgattttcttttcagtttgtaaagacggcggatctggctggtatgattggtatttttaagaaaaatctcgttttcaatattatccatcgtttcgaaaaggcttaaagattcatcatcaaaactcttcataatcaggatagcaatcatgagggtgatttgctgaggagtaacgtcctgctggatcaaggaaaccttttttttggtttcggtgatacttctggtcttcatcctgtggatggtaataatggtattttcaaccagaaaaattccaatcttggtgctgatatcactgatcgtattcagattttttctttccagctcagtactttcacggagcaggaagaatttaacgttcccgtcttcttcatatttcggaaggtggttaggatccatcgtatcttcaagaagaagattgttgatttcatatctttcatgaagaaatttcaggtcttctacagtaggagcctctacatctacccattcgcactgggaggttctgtatattgtatcaattggcataaagtaaaaatactaatattttgaaaaactatgtgttaaataagttttatctttgccaaaattaaaaaactatatgattaaaagtacaataaaaggtgtgggattttatgttccagataacgttgtaacaaatgatgatttagcaaaactgatgactaccaatgatgaatggataacagaaaggacaggcatcaaggaaagaagacacagaaaaaacagatatgactctcaggaaaccagcgcttatctggggtttaaagctgcagaaaaagctattcagaatgctggtcttacctcaaaagatattgattatattatctttgccacgctttctccggattattattttcccggatgtggtgtattgcttcaggacatgctgggatgtgatacgataggagcattggacgtaagaaatcaatgttcaggattcgtatattctatgagtgttgccaatgcatttatcaaatcaggaacctataaaaatattcttgtggtaggagcagaagttcattctttcggattagatttttctgatgaagggagaggagtttctgttattttcggagatggggcaggagctgttgttctttcggcaacggaagatgaaaatgcaggagatattttagcaatgaatatgcattctgaaggaaaatatgcggatgatctttgtactcagttcccgggttcaaagttcggatggagtgacagaatgagaaaagaccctgaaaatgtaacgaacaaagaagtatacccgattatgaacggtaacttcgtgttcaaacatgccgtaacaagattcccggaaacgatgatggaagctttgaacaaagcaggaaaaaccattgaagatcttgatatgttcattccacaccaggcgaacctgagaattgcccagtttgtacaggaaaaattcggattaccaaacgagaaagtgttcaacaacatccagagatacggaaacacaacagcggcttctattccgattgctttaagcgaagcaattgagctgggaaaaatcaaaagaggcgatcttgtccttctttctgctttcggaagcggatttacttggggcagcgttctgtttgaatactaagcgaagctttattttcacttataccacaactcaagagctcaattcccatattttggaggaggcggaaattcaaagaattttgacggggtggttatacatcataaaaaaacgcagaactctgttctgcgtttttttattttgggtcttaataatcaattaaaggcttttcaatagtttttccgtgtcagaagaatcctgtcctgtactttttgcaagttcaatagacttttcagcccatatttttgcatttttcttatcacctaccttattgtaaagattggctaaagtatctgtattggcaaagttctgatctttttttacagattcctgcgcccatgcaatcgctttttcaagagactccttgttatttacattttcaaagaagttccatgcaagggaattcagttcttcagaacctgctgcagaataatctttgtaaaggtcaaggattaatttttcatattcaggaatatctttattctttaaagctctgttggctttcattctttttaagatcttgtcagcctcttctttactcaggaatttctgggattcagacataaaatagctgtcattccatgttttggtatctgcattgtatgcttttttggaaatagtattcagcttaatatttttatcaaacttttcatatttatcttccgggaagaatttaacgatatcagcttttttatcctgaaaaatcttgtacaaaggactgtctgtagtctgaacccctgaaagaagcatctgaatatcttcctgatctaaactggctttctgctgaaaataacggttcatcactttaccggcaaattcagcatcattatacatggtaagccctgcaagattctttaaaaattcggggtctttttctccgttttcaaattgctgcttcagagaagtcagccttttgttgggatcttcagcatcttttgcaaactggataaagtctttttcttccacatatcctaaagttctgtgtaccgcttcaccgtttccgtcgataaacaggtaagtagggaaggcttttacgttatattttttggcaagctcaattccttctcccttttccatatcaattttagcgttgataaaatgggaattataataatcacccacggactgaagcgggaaaatatttttaaccatcagcttacaaggtccacaccatgaggcataggcatcaataaaaaccagttttttttctttttttgctttggcaaggatagaggcaaaattgccttcttcaaatttaattccctgtgcccatgccagcacacctataaatatggaggaaagtattgctatttttttcataaaaaactttttattccctgcaaatgtaataaatatgatgacacatgagccgttcatattgaaaataattatacaggaactttagcttaaaaacagagatcatgtgatatgaaagataatcagttattattttagtcttattattaaaattaatgtaaatagctattttgtggtaaatgattaaatttcaagataatattttaataaaaaataaaatatcattagttttgtaaaaaacaaaaagacactccgtgaaaataatgatgaattattataaaatcaaaataataatttgtttttttatgcctagaagtcttctgaaatttttgtttttgctgataacagcagttcctatattcgctcagaaaaaaaataactttgatcttatttgtgaaaggacttcttccgtcacagctcataagaatttacccaaagccatcaaaactgccgattctctttacatgtcagctcaaactcctacagagaaaatcaggtgcctcatcctttcttcagaactttatcaccatgcaggtgaacttaaaaaagcaatttgttacagtgaaaatgcacattcggtaattaataagattaatgatcctcaggagatgaccgtggtaaccagattacttgcgaggcagtatagacaggtagggttatacgaaagatcaaaaaaatacatactgaaaggacttgcagctgccggcagaatcaatgattttcaaaagagtaatgaggcggcaggattgctgaatcaggaaatggcattttatgaaatggagatggggaattatttcaatgccatacagcatatcgaatcttctctgaaaaattttgaaaaaataaacagtgataaagaaaacagcattgcagctgcttcttatcagctattgggagacgtttacttcaaacttaatgattatcctgtttctgaaaactactatagaaaagcagaatgtctacttaaaggcggaagctgtacgctgggtttggtgtataacggattggggggaatccgtcttaagcagaaaaactggaaagatgctgaattctatcttaaaaaggcagagaaaattgcagatacatcccggagtcttaagcttaaaaaagcagtgtattccaatattaatgattattatgaaggaacgggagataattttaaagcctcattgtatgcagtgaaatatgtacgtgcctatgacagtattgcagcccgcaatcagagttttacaatgaaagcctttgatggttcaaaaggaaaaactaataataaaaagaacgggcagatgaacagcgtaaaaaatgcggctattgtgattctctttatttcactggtcggtctgctcatttttatcagaagaaagcagaaaaaacagcgctcaaaattacgaaacatgatgagggcccagtttaatacagtcggcggcagaaatcattatcctttacaacaatctgactctgagttctctaatatatctgtagaagaaattgatgacaaagaatctgaagcagaccgcagaagaaatgattctctgatgacttcagaaacagaatcaaagttgcttgaactccttgaagactttgaaaggggtaatctttataacaataaaggcatgtctctttcctttcttgccggtgaactgaataccaatacaaaatatctgtcttatgtcattaatcagcataaaagtgcagatttcaaaacatatatcaaccgtttacggattaattatatcgtagataagctcattaatgatgaaaagtacagacagtataaaataagtatccttgctgatgaatgcgggttctcttctcacagtaaattcgcatcggttttcaaagcggttacggactattccccatctgcctatatcaaatatctggataaggaaaaccaatctgataaagatgttcattttcccgaaaatgattaaaaatggctgtttttttaatttctatcttgtcattttcatgaaaatgaacaacctattattttaaagaaacgcctttctatcatatatttgtgccagtttcacaggacaaaacattatcctgatacttcttatcgctttttattccgctttctgaattaaggtcattataagtgaaacaacaaatcctctttttaatcttttaaggaaatattctgtatcagaatatcaaccatattttataatcggggttgattgcccggttttttttcagtcaagtttttttaagtgcaaatccacagaaagtctgtggatttgtgattttatttaactttggtgctgtcggtttttatttttgatgtgtctgcagttgctggtgaaggtatggaattggcgactgcagaatcacccattctgtttcttaaggagtctttgttgtgggcttctttgtattcctctcttttttctttgttttgagcacagcttccaagaaaaagaagtccaagaactgctcctatccataattttctcattgtagtatattttaatgtttggtattaatcaaatgtaggaatttaattaaaaagataaaagataaaagataaaagataaaagataaaagataaaagataaaagataaaagataaaagataaaagataaaagataaaagatcttgttattaaacaactactatatatatttggaagtcaaagggaatttcttctgttttttcatcaggttttgtaggattaataatgggttagattcctacggaatggcaagaccgattgtatcatgtatttggtgctgcttaattctttttatcattccgaaggaatctatataacgttgttttcaacaagtttgaagaataaacgattttttcattaagctattatttgtcaggatatcaatagaagtgggctttagcctactaacactataatcaagattcatccgacttaagccagaacttaattttctcatccataattatatcaagccccttactctttaactttttatcataaaaaaaatctgcagcgcttgcaactgcagattttccatgttaagttaaacgtatataaatactatttgacaggagacgttgccatagaatccctttttatcttgatagtgtcaggattcgtcatttttgtagtcatggtatcagtagttgtaggcggtatacttttttgtgcactgtctactgttgctgaatcacgattacttgttgacattgtcgattctttggttccacagctcactgcaaatattcctattccgatggctgttagcaataactttttcatattattttattttggggtgtgtaataacgaaaaatcaacaattattcctaacagggactttagaatcgtaaaatataggtaaagtttgttaaaagatgttaggtagcaggtagtagattgtaggagttaggagttagagtgagagagtaggagagtagatgggttagagagtgtaggacattgtgtattaagtattggaggactaaaagtgtattttatggatacaataaccttaaaccataaaccttgaacttttaacaccacccataactcggaaccggaaccccgaatccgcattactccacaaaaaagccccgaaaccgaaattccggggctgttttaatcatttatcaatgatcatttatcttttattatcctaggtatggatatttgtagtttttcggagaaacaaaagtttcttttacgcttcttacagaaacccatctcagaagattcattttagaacctgctttgtcatttgttcctgaagctctaccaccaccgaaaggttgctgtcctactacagcaccagttggtttatcattgatgtagaagttacctgatgcattttctaaagctttataagcttcgttaattgcgtaacggtcttgtgagaatacagaaccagtcaatgaataaggagaagtagaatctaccagcttaagtgtttctttccagtctttatcttcatatacatagattgataagattggaccgaagatttcttccaccatactttcataatgaggatttgtagtttcgattaccgttgggtgtacaaaccatcctttagaatcatcatattttccgccgatagctaccgtagcttcaccggaagcgttcgctctgtcaatatatcgtttacatttttcgaaagaatttttgtcgattacagcgtttacaaagttagatgtatcttcaggagaaccgattttgattgtgctcatctgatcttccattacttttttcacatcagcccaaagagatttaggaatataagctcttgaagctgcagaacatttttgcccctgatattcgaaagcccctcttaccaatgcagtagctacagcctctacgttcgcagacgggtgagcaattacaaagtctttaccccctgtttctccaacgattcttggatatgttctgtagttgtggatattatcaccgatcattttccacattccctggaatacttttgtagaaccggtaaagtgaagacctgcaaaatccgggtgagccaatactttctcagcagtttcttttccgtctgtaaagatcatgttgataaccccggcaggaagacccgcttctgttaatacgtccatgattacttttgcagaatatacctgcttgtcagacggcttccaaaccactacgtttcctagcatggccatacaagtcggaaggtttcctgaaatcgcagtaaagttgaaaggagttactgcaaagcagaatccttctaatggtctgtactcaacacggttccagattccgttgtcagaaaccggctgttcagcatacatttctgtcatgaactctacgttgaatcttaagaagtcgataaactcacaagcagaatcaatttcagcctggtgtacgtttttagactgcccgatcattgttgcagcattaatcacatctctgtaaggaccagccaaaagatcagctgcctttaagaaaattgctgcacgctgttcccagcctagttcattccattcttttttagctgccaatgccgcgttgatagcgtcatccacatgctgcataccaccctggtaatagaatccgaagtcatgagcatgatcctgtggagactgaagctgcacttttgtatcagtttttacttcctttccgttgatgatcattgggatttctaccttttcagcccacatttttttatacgtggcaataaggcttttaacttccggagaccccggttcatatgaattcaccggctcgtttaccgctaatggtacttgcgaaattgcttttgacatattacgttttattattttattaaattaaataagatgtgtatacaaatttacgataattataaggaaagaaaaaataccaccttactttgtaaaataaacttaattgttaattaatccttagtagataatattttttgagccaatataattgataataaaacatgtattaatcttgttttttaaatagaagaaaaagataaggtgaatattcatagttataggaataaggacaaaaaaatatttgtcatagttcataaagagtgcttatgtgctgtaaataaaggatttgtgactgaatgttaaaaatacataaaattgcatttgttgcgattttgaacattttaaataatttttttgatagccggggctttcagattgttctaattttacagcattattaacaggtatgaaaaaaagagtcttatttttctcttttgtgatatttttctcagcgttatgtgcaggtctttttgcacataagggaaaagctcagccatactctgatatcctttcaaaaattcatcttcttcagcagaaatctgatcagcagacccatcctgaaatgtacagtttttcagatgtgcaggatgttcaggattccaatgactgggagaaagtgaaatttgattactcagtgcttgcgcagcagtggttatactacttctttgccggctacacttacagtacaaaggttgcggccgttcaaaaccgtatttatattacagcaccaaggtacatcctgtatcattccctgcagattgcgggctgctaattccttttttaaatcgtaatgacttttatggtttgtattgatgtgaatacagatccgtaaaaatcgttttcacactttacatttttaaatatttctatttgccttacaaaaggtgaacaggattctctttgtccaattttaaataaaaaatactatgcacttaacaccgagagaaacggaaaagcttatgctgtttctggcaggcgaactcgctctgaaaagaaaggcaagaggccttaaattaaactaccctgaatccatagcactcatcagccacttcctgcttgaaggtgcaagagatggaaaaaaagtagccgaactgatgcaggaaggcgctaacctccttactaaagaggatgtaatgccgggcgttgcggaaatgatccacgatgttcagattgaagccacgttcccggacgggacgaagctggtaaccgtacacaatccaatccgttaatacctattcatatgataccaggagaaatttttgtaaaagaagggaccattatctgcaatgaaggcagagaaacggtaaaaataaaagtaaccaatacaggagaccgtcctattcaggtaggttcacacttccacttttttgaagttaacaaagcgatgaactttgaccgggaaaaagctttcggaaagagactgaatattgtagcaagtactgcagtgcgtttcgagccgggagaagaaaaagaagtggagctggtagaaataggaggaacaaaaaaagcaatgggcttcaataatcttgttgacggacaggtagattccgaagaacagaaaaaagcgagccttgcaaaagttaaagagttaaactttaaaaatcactaagatgagcttacaagtagacagaaaacaatacgccaatatattaggtcctactgccggagacaaaatcagactcggagatactgaaattatcattgagatcgaaaaggatttcacccactacggagacgaagccgttttcggaggcggaaaaaccgttcgtgacgggatgggacagaatgttacggcgaaaagagatgaaggtgttttggacctttgtatcacaggtgcagtaatcattgaccactggggaattgtaaaaggagatatcggaatcaaagatggaaaaatcgtaggaatcggaaaggctggaaaccctgataccatggatggtgtatctcctaatatgattatcggagcttcaactgaagttcacggaggaaaaggatatattgtaactgccggaggaattgatactcacattcattacatctgccctcaacagatcgaaacctctttgtatagcggaatcacaacaatgatcggtggaggaacaggacctaatgacggaactaatgctacaacagtaactccgggaagattcaacatgcagaaaatgcttgaagcagcagaagaatattctatgaaccttggtttcttcggaaaaggaaactgttcagctgaagaacctattgaagaacaggtggaagccggagctttgggagtaaaaatccacgaagactggggagcaactcctgcaacgattgatgctgcactgaaagtagccgataaatatgacgttcaggtggctatccatacagatacattgaatgaaggaggttttcttgaagatacgatgagagcaattaacggaagagtaatccacaccttccacacggaaggagcgggtggaggccacgctccggacatcattaaagcagccatgtatcccaatgtattgccggcttctacaaaccctacacgcccttacaccatcaatacaattgatgaacatttggatatgctgatggtgtgccaccatttgagtaaaaacattcctgaggatgtagcgtttgcagactcacgtatccgtcctgaaaccattgctgcagaagatattcttcatgatatgggagttttcagcatcatgagttcagactctcaggcgatgggaagaccgggggaagtgattaccagaacatggcagactgcaagcaaaatgaaagagcagagaggtgatctggctgaagataaagatagcggaaatgacaattaccgggccaaaagatatgtggctaaatataccatcaacccggccattgcccatggtatttcagaatatgtaggatcagttgaagaaggaaaattagccgatttagtaatctggaaacctgcattattcggagtaaaaccggaaatgattgtaaaaggaggatttgtaatcgctgctaaaatgggagatcctaatgcatccattccaacccctcagccgattatttacagaaacatgtttggagcacacggaaaagctaagttcggaacttgtgccaacttcgtttcgcagatttctattgataacggaaccattgcttcttacggattagagaaaatgatccttccggtaaaaaactgtagaaatattggtaaaaaagaccttatccataacgataagacacctttaattgaagtgaatcctgaaaactataaagtaacagtagatggtgaatacatcacatgcgaacctgcagaaaaacttcctttaacacagttgtattacttgttctaagataaactttatgcataaaacctgacaggtttcaaaagcctgttaggtttattcaacaacaaaaaaagatttatcagaccctattttaaaacaattacagaactacgtttacaatgaaatatttaaataaaacagttttttctcttgctgtagccggaatttctctgctttcagggaatgtaagcgctcaatttctgggcgggcacaggcttaaaagtgatgaagacggaccaaaagggcaattcatggtttatggctcgttggattactcaaaaatcactaccccatcaagcagcagcagtaccgtttccagtgcaccgcttggattgggttattttatcaataataatgatcttgtcggggttaattatgcctactcacagaatacggttgatcacaatgtagtttacaaacagaatgaagcgggaatctggtatagtccttcattaatgcttggaaaatactttgtattgatagggcaggtagatgctcattatgtttggggacagcaattgtcaacagcggctgatgcgatgcagaactttaatggattccgccttcgtgcttatcccttgattggaatattacttggtggcggctgggcactgaaattcaaatttgcagaactgtctatgcttcagaccaaaacaaaagaagaaggctggacgaaaagctatatagcaggaatcagtggttcaacattcggggtaggaatctccaaaaacttagactttagaaaaaaatccaacaatgatcattaatcaaatcataggcaatcttgctgaaaatcctacggaaaaaaccatagattatcttgatctggaatggtttgaaaccaccaaaagaatccagcgcaaaaaaaccagacagggaactgatgttgccatcaaatttctcagagaaggacagcgcttacgtgaaggagatattctttttgaggatgcagaaaaaataattgcaatcaatgttctggaaacagaagccattgtgatgtcgcccacttcactgctggaaatgggtaccgtatgttatgagatcggaaacaaacatattccgcttttcattcagaatgataaagtattgcttccttttgaaataccgatgttcagatggctggaggcaagcggttttaagccggaaaaacaatctgtgaaactgctgaatcttcttaaatccaatgtagagccccacggacatagcagtcttggatccacaatttttaccaaaatcttaaaaatggcagccccgaaagatgaatagcatgaatataaattttctgttaggtttgcttcatttggcggatcctacacttccgatcggtggatatacgcattccaacggacttgaaacttacgtgcaggaaagaattgtacataatgtagatacagcgaaagagtttgtacagaatatgcttcagtacaatcttaaattcaatgacggagcttttgtaaagctggcttatgaagcagcagaaaagggagatttaaagcagcttttagaactggataatgaatgtaatgcgataaagtgtcccaaggaaatccgccaggccagccagaaattaggagtaaggctgattaagatattcaaaagaagagagcgttttcctctgatggaagcattcgaaaaagcaattcaaaacagggaggccaattctcattactgtattgtttttggagtctatgcctgtttaatgaaaattcctttgtatgaagctcttttagggttctattacacttcggttgcaggaatgatcaccaatgctgtaaagctggttcctcttggacagctggatggacaggatatccttttttctctttaccctgtgatggaaaaaacagctttagaaacaatagaactggacagagacatggtaggactttgtaatacagcctttgacatccgatgtatgcagcacgaaagattgtactcaagactttatatgtcctaaaaagataaaaggtaaaagagcaaattagcgaattgctctctgctgagtgaaacgcccttgcgatcggaaaatattcacaatcaaaaaaacttagcgcacatagcgttaaaaaataaaatttaaataaaatggaaaacagaaaatatataaaagtaggagtagcaggacctgtgggttcaggaaaaactgcattactggaaagattaagcagaaaattattcggcacgtatgaccttggagttattaccaatgatatttatacaaaagaagacgcggaatttatggcaaaaaacagtcttcttccccatgacagaattatcggggtagaaacaggaggatgcccacacacagccatccgggaagatgcgagtatgaaccttgaagcggtagatgagctggcagcacgtttcccggaaatcgaactggttcttattgaaagtggaggggacaacctttcagcaacattcagtccggaccttgcagacgttactattttcattattgacgtagcagaaggagaaaaaatccctagaaaaggaggaccgggaattacaagatcagatttactgatcattaacaaaattgaccttgcgccttatgtaggagccagccttgaggtgatggaaaatgacgccagaagaatgagaaaaggaaatcctttcgtctttaccaacctgaaaacagatgaaggactggacaaagtaataggttggattaaaaaatatgcccttttagaagaagttgaagaaccgaatctggtaagataaatggacagtcatttaaaaattattgcaggattcaagggaggagaatcctatgtgaaagatctttatgtctcacttcctttcagggtagtctctgtaggacagcgaaaaaatgacaaaaagctctatcagatggtaatgagctcctctccgggaattctggatggagaccactatcatttggatgttacgcttgaaaaaggagccgcgcttcagctgcagtcacaatcttatcaaaggcttttcaacatgcaggacaaagcgcttcaggaactcaatgtctctatggaagatgaaacttcttttgcttacgttcctcatcctatcgttcctcacgaagattccaattttaagagtaaagcgaagattcatatcgggaacaacagccagatcatcatcagtgagatcattacctgcggaagaaaacattacggagaagtctttaaactgaagcgttttcagaatgtaatggaaatctatcacaacaataagctggttgtcaaagataatgtcttgattcaacctgatatgatcccgatcagcagcatcggaaatctggaacagtatactcatcagggaactctgatcttctgcagtacaaaggaaaatgtagacaaaaacggattggttgaaaaaatagttgaagcatccgcgcagcatcatgaacaaatggaagtaggggtttctgcaatggatgacaatggttttgttgtaagagctctggggcatggaggagaattgatgtacaacttcttcctgcatattcaggaaatcctttggtctttagaataaaaattaaaatgattctttatttaagttacagagaaaatattcaatagaggcgggctttaacccgcaatactaaaagatatgcttccattggctttagccaaaacttaatagagaacggaacagcaatagataaatagaaaatggacagtacagtttgggcacttcttttaagcgccgtttcaataagttttatacacactgcttcagggccggatcattacctgccattcattgtgatctcaaaatccaaaaaatggagcggaatgaaaaccgcagtattaacggttgtttgtggactcggtcatgtattgagctccctgattttaggttttatcggggtgtttctaggatggcagctgaataagatttcatggtttcaggatatcagaggaaacttctctggatgggcactgctgattttcggaggcgtttatctgatatatggtctcattcaggcaatcagaaacaaacctcacaaacattttgacgtgatgggtgatgatgtctatgtatatgaacataatcacagcgaagtggtaatgcctcagaaaagaataaaagtaaccccgcttgtattgttcatgattttcgtgatgggacccagtgaacctttaattcctttgttgttttattcaggagtaaaactctcaatgtctgaaattgccgtattggtaatttcttttactgcaactacagtattaaccatgcttggaatggttcttctgggacgctatggatattcaacattattcaataccgaaagactggaaagatatatgggagtggtaagcggagctgtagttactgtttgtggtgtcggaatggtctttcttggatggtaaaagggttttgggtttcgtgtggtagagtttgagggtaagagagttgagagtggaattgtttaaagtttaaagtttgaggtttaaagttgttatcctttcactaataaattgacaattcaccattcacctgtaaagcaaaattgattctgtctccaatgtctattatctatccgtctcttatcttactatccacaatcattaatacaattaaaaaaactatggacgaatttttcaaaaaactaccttttttagacaatatattaaaaggaatcgggcagattatgctccaggaaaacagatggaccgggcttctgtttctcataggaatcttcatgggaagctggcagtgcggagttgcggtattgctttcaacggcagccggaacttttactgcaacgaagcttaaatacgatcaatctgaaatcaatgcgggactgtacggcttcagtgcagcgctggtgggagtagcattggcatttcttttccaaactacggtattgatctgggttttaatcctatcaggtggagcattggctgcagttatccagcatttctttatccagaagaaaattccggtgtttacttttcctttcatcattattacatgggtattggtttttgcattgcatcattttacccacattccaccttctgctatgctaagcagtgaagtagttcctacagaatatgatgactttctaacatgtaccaatgggtttggtgaagtaatctttcagggaggggtactttcaggaatgattttcttcctggctgttttcatcagttctccggtagcagcgttatacggattagtcgcatccattcttggtgcaggattatcacaactgaatggagaacccatcaaagaaatccacatgggattatttggattcaacgcggtgctttccgctatcgttttttccggagtcaaaaagacagacggtctatgggttcttattgctgtccttattaccattgccattgatgatttcttaatagacaatcattgcctggatatcgttggcggagtatttactttcccattcgtagccggaacgtggattacacttttaattcagaaggtatttcttaaagcgaaatctaatggttagatagtgggagagtttgagggtttgagggtttgagagtggaagattgtttaaagttcaagatttaaagttcttttacgatgattgacgattcacttgcgaagcaaaaattcactattgctattcctctgacttctaacctctggtttctaactcctaaaatcattaatacattatacattttacattgtacaaaaaaaataaaaaatgaaaataacaaaaatagcagctgcatttctggtcatgacattcagtggaaaaatgatggcgcaggaagcagaaaaacagttgctgatcaaagatgcagatgacaaatttcccattaccgatgctttggtaaaatatgatcacggaaacagccatacccatacaggaccggacggcacttttgccattcctgtaaaatcccttcctgatacccttgtgatcagccgtcagggatatgatgaggtaaaatgggtggtaaccaatgatgaagataaaaataaagttatttttttacagcataagccttttcagatttccgaagtagctatcaatcacagctcgttcttatcagcgattactaaagttgatctgaataaatttccggtaaactcagcgcaggatctgttgagaaaagttccgggactttttattgctcagcatgccggaggaggaaaggctgaacagctttttttgagaggatttgatgccgatcacgggactgatgtaagcgtgaatgtagacggaatgcctgtgaatattgtttctcatgcccatggacagggatattctgacctgcactttgtgattcccgaaacagtaaacaatatcgatttcggaaaaggggcgtattacatggatcgcggagactttaatacagcaggatatgtagactttcagacgtataatggattgaaaaacagtataattaaactggaaggaggttcatttaattcaaaaagagtattgggaatgttcaatattctgcatgatgatctgggcagaaaaaatgcgtatgtagcagcagaatacaactatacagatggccctttcgatgtgaaacagaattttaacagagtcaatattttcggaaaatacaaccaatggcttacggataacgattatttcaacattcagttttcaacattcaattcttcctggaatgcttcaggacagatccctgaacgtgccgtagatgaaggaattattggaagatggggaagtatagatcctactgaaggcggaaaaacctcaagaacaaaccttctgatgaattttaagcacattatttcttcttcggagcagatggatgcgatggctttttattcaaaatataatttcaatctgtattctgacttcacctttaatttaaaagataaggatcatggagatgaaatccagcagactgacggaaggaatatttatggagccgaagtaaaatatacaaagactttttcctttgccaacagttctttaaactggacatcaggaattggattaagaaatgatgatattaatactctgcagcttaatcatgtttatcacagagatatgctgcttgacagattatccgatgtgacaggaacagaaaccaatcttcatgcttattcagggttgatctggaaaaccggaaaatggacgatcaatccggctttgagagtagatcattttattttcaatctgcataatctgctggatgccgaactgctgccttccggacagtcaaaagaagcaacaaggctaagcccaaaactgaatttctcctacgcacagaatgacaatgtgatgtggtttctgaaaactggaatgggctttcactccaatgacctgagagtggttgttcccaataagagcgaaaatacgcttccatattctattggagcagatttcggggtaagattacacccgttcaaatccttgatcattactccagcagtatggtttatggatcttcagcaggaatttgtttatgtaggtgatgatgcagtggttgaaccttccgggaaatcaagacgtttcggggctgatcttggagttcgcttccagccgttggaaaacttttatctgaatgcagatatcaattattctcacgcaagatttactgaagaagaaaaaggtcaggattatgttccgctggctccggtagttacgagtacaggatccgtaaactgggacttcctgaatggcttttctttggcgcttcagtacagatacctgggagcaagacccgctgtggaagataacagtatcagaaccaaagcctattttgtcaatgacctcatgctttcctataaccgtcagaaatggggtgccaatcttcaggtcaataaccttttcaacgtaaaatggaacgaagctcaatttgccaccgaaactcagctgaaaggagaagcagaacctgttacagatcttacctacacacccggaagtccttttggagtgagagtagggttgtattataagttctaagtgagagagtggtagagttttagggtttgagagtgaagaatgtgagttccgggtttcggggtttttattctcttgcttttttgcccttttaccttctctgctgattcagtattgagttaaaatattttgtataactttattaatcataacaaggatatggaagttctgtccaattttcaatataaaaaactttttcttccgaatattacggacaaaatattagctaacaatgctgatatacagctctatcggatagaaaattatcttaaaggaattcttatgccggtaattccataccgtacaacgttcaattttattattttcgttaccaacgggcatatcagacaatatcttgaaaataaagaatatcatgctgaaaaaggaggtgtgatctttattaagcaaggaacaattaccgcaactgttgaactgtcagatgatattgaaggtttctttctagcttatgaaaataatattctgtctgaacaggaactgcccaagcataaaagcagtattttcttcatgaccccttttctcaatctggatagcctgacctatggaactattactcagcttctcccgatcatggaacaggaattgtggctgaacaacctcaatgtgaatgacgtagtggtaacgatgcttcaccttatattgatcaagatgctgagcacagattctgatacccaccataaatctgcaacacgccctatggaattatcccttcagttccgggatttactctttaaatatcatgtaggagaaaagagagtggcattttatgcagacaaactgtctgtaacagaaagctatctgaacaaatgtgtgaaaggagttacccaaaaatccccgaaacagtggatcaacgagatcgatatcaattacagtaaagcattacttcactccagcaaagatattgcagagattgcttacgaactgaactttcataccgcatcccactttacccagcttttcaaaaagattgcaggaatcaccccaaaggaatacagaatacagtttttgaacaacaacaggatttcaatataataaggctggaagcgggaagtcagatgctgtaagtatgaagtagcctgatcaaaataagttgagaattcagaaagttattttaggagtttcataacttccatctccctgcttccattcttccatcttctacatcctctcgttttccaggattttcagcaccagcctttcttcctttgtaagatcggcttttccgtcattttcttcaataatttccagttcgtcaagatactttttgatggtattgttttcgtaaagattgatgactaaaggatgaacgtaatattttctgcagacggccgatgtatttcccagattttctgcaacgatgtctaaggcttcttttactttctttttatactgagtgtcattttcagcatacccgatttccttgaaagcgatcaaagcacttaccgttccggaccatgtcctgaaatccttggcagtaaaatcctcaccgctgatctctttgatatattcattcaccatacctgaatctacagaatgacggtttccttcatcatcaaaatattgaaaaagctcttttccgggaatatccttacacttctgaacgagtctcgccagccttttgcttctaagatcaacatgatgcatcaccccctttttgcccttaaaagtgaatgtgattttttgtccgtttactttcacatgcttacctttcagggtcgttaagccaaatgatccatacagtttttcataaatagaattaccgatacggatgttggttctttgcataaggcttacaattaaggccagaattttccgcttttcaaaatttctcaatgcaagatcctgttctatatgcagcctcatttctggtaatgcatatccgaactgaagcatcctgtaaaattttgtatgatttcttaaagcgctccaaagaggatggtaacggtactgctttctctttttgacatcaaaacctgttgcctgcagatgtccgttttccagtgcgcagatccatacattttcccaggccggcggaatgaccagcttattgatccttgtaatctcttccttgtctcttattttttcaccgtctttataataggaatatttctttcccgtttttttacgggtaattccggcggtctctgcatcggtggtatatacaagatgtaccgcctttgcagaagcttccgggtccttcatgattttaacaatttttgaaggtttaaggtgagaaatgatttccaggtctgtattcttctccataaagcatggttaagagtttttacccctcgaaaaaatcagtaaaagaattcctgctattacacagactaaaagaattccccaccacattcctgccttgaaaattgttcctactgcctcacagcttgttagtatcaacaagctaaatatcgtaatactgtataagcttaattttttcataatcgtatattttgtgatgttagactcttaagtgatcagctctccagttttttatagatcttttaatttcatctcctgagatgttttcatgaagggctctgtataaaagctctttgaattcatcatcatatgcaaatctcaatgcggcaatctggtcaaacttcagtttttcaacagtttcatccgatcttatgttgaagatttcaaaataccgttgctgaaattccaggatcaccatccggttttgaagtcccagtgcataatgctgccgtgtcataaatgcaaggtagaaaagcagaaaaatcacaatagaaaacaggatccagatcaaccggttttccgggtcatcccagattttataaactccaaaaatctccaataggatgagtataggaagataaataaaatgatgtggcggataaaacttcctgtggttattgtagttttgctgtttcataaggtagaatgctgcaataatctttccaaaatttactattttgataataaattgttatttgtggtatgtttagttggtttattttggcttctccgtattgatattctttgctgtaaaattatattgttcatatttcaatatctaaatatgtttttggtgataaaacggaaatcaacgtttgtatcggatttattagtatggtattgatattcaggtgatcacttttctcaataaagttgtttaaactttacaaaaccatagaagtcgaaggttcttaaaatacctgagttcacttaagtaagtttaaaatgaaaccgcagaaaagttcacataggataaaaatcaaagattttcacaaaacttaagtgaacttactatgcataaagttggcttaaaaaacttaagtggttaaaacttttgtggttaaaaataatgactataaagtttaaaaagcttgaaaaagaattcctttaaaaataacaggttattacgtaaaatagctgttgatttcatcttccgactttaaatttttcgtaactttcggtggttaaaaaagaaaagaatgacttcaaaggaaaaagttgctgcgcttcgtgaagaaatgcagaaaaataatgttgatgcatttattgtatattctgcagacccgcatatgagcgaataccttcctgaagaatggcaggaaagagcttggttgtcaggtttccttggttccgccggttttgtggtggttaccaaagacaaagccggactctggacagacggaagatactttacacaagctgctattgagctggacggttccgggatcgatcttttcaaagacggtatggaaggaactcctaattatatcgactggattatttcagaaattccttcgggcggtaaagtggctgtaaatgctttggcggcttctaatgccaactgggaactgctttctcaaaaatttaattccaaaaatattaccctgacagatcttccgcttttaaaagaagtatggaaagacagaggaactccatctgctaacccgatttttgtacatccggtagaaagagcaggtaaatccgtatcagataaacttgctgccatccgtcagaaaatggaagagcaggaggctaccgtacacatcatatcaagtctggatgatgtcgcatggacattgaacctcagaggaagtgatgtagacagcaaccctgtatttttaggatatattgtgattactaaaaatgatgctgtcctgttcacagggttggaaaaaatggaagtagcggctagaaaacaaatggatgatgcctttgtgaaaatgatgccttacgaagaattttacaattatctgaagaatttcaaaaatgaaaaagtactggtttctccaaacagcaaccaacagatttttgaaacactgaaggccgacaaccagtttatcaaagctccggttcccggtaatctgatgaaagcccagaaaaatgaagctgagctggaaggtttcagaaaagtgatggtaagagacggtgtggctatggtgaaattcctttactggttaacacacaatgcaggaaaagaagccatgaacgaatattctatcggagagaaactgagaggcttccgtgcagaaggagaaaattttgtgggggaaagtttcggttccattgtaggatataaagataacggtgccatcatgcattattctgccaaaaaagaaggtagcaaagaagtaaccaatgaggatactattcttgtagattcaggaggtcagtaccttgaaggaactacagatattacaagaactttcgctttaggaaccccttcggaagaatttaaaagaaattcaacactggtattacagggattaatccgtttatcaatggtgaaattcccgaaaggaacaaaaggtgtacatttagatgccatcgcaagacttccgttatggatggaagggaaggactttaaccacggaaccggacacggagtaggaagtttcatgaatgtacacgaaggtccgcagaacatcagaaaagatctgaaccctcaggaacttcttccgggaatggtgctgtccaatgaacctggatactatcttgaaggacattacggaatccgtcatgagaaccttattgctgtaaaagaagcagagaaaaccattcatggaacattctatgaatttgaaacattaacattctgcccgttctttaaagatactgtggtaaaggaaatcctttcagaaagtgaaattgcatggctaaacagttatcacaaaacctgtgaagaaaagcttgctcctcatctggatggagaaattaaagaatggttcctgcaattggtaagtcctctttaatatgatgaatgattgtaggttgttgataatcattgctttaaatcctttttgtaaatcttaaacaaaagaattgttagataaaccagagtcctgtaaggtatttcctgcagggctttttctttttacacaaccgtatttttacggatataattctagggattccactgatggataaaagctgagccctgcctatatttgtaccaacaaacatcattcatatattcataaataactcaagtaaattcaaagcggtaatcatctcgtcctgagatgatttttttttattaatcgaaaattatagtgggtaagctcaaagcaattcacgaaattgatagggtctttgctaaaattctgcaaaaattaaaactttgtgttgttccggtatagaacctccgtctttttatttattttcgtaattcattagaaacatccttatttaaaaaaatgatacgtgattactttcggagctttaatctcttttcacaaggtgaaattgaagagtttctgcagcttttcgaaatccgaacgctgaataaaaatgactattttgtgcaggaaggagaaagatgcagggaagtagcgtttatcaactccggaattttccggtctttctatacttccgataacgggaaagatatgacctattgtttcaagtttcccaatatgatgattgctgcgtactcatcatttatttcaggatgtcttagtaaagaaagcattcaggcaattactgatgtagaattgctgattctgaaaaaagagaagatggatctcctggtaaaagatgccctgaactggactcagtttttaaaaatcattgcggaacaggaataccttgaacttgaaacccgttttttccagcttcaaagagacaatgcggtgcagcgatatgaagcattgttaaagaaccatcctgattatattcagaaaatcccactgcaatatcttgcttcctatcttgggattacacagcgccacctgagccgtatcagaaaggaaatttctttttagacatttgtcctgtctgttaaaacagatgcactatacttttgtcaaaaaaagttatggagcaaaatattttaattattggaggaaacggattagtgggaaaaacaatatcccggatcctcaaatccagaaatcctcatcttactgtttttatcgggggaagaaagggtggaaaaacagacaaagagctgaaaattgatgttacagatcctacttcttttaaggttattccggaaaagaaaatcagtctcattattctttctgtaaatgataaagaagatcatgtacttcgtttcgcaattgatcaccagatagattatctggatattacgaagcctaccccggctttggtaaaggcttacgatattgccggaagatcagatatcaacagcaggattgttttcagttcgggctggatgggcggaattgttcctgcattggttaataccctttcagattcaggtgatattaatgaggtgaagctctttgtttattattctgtgaaagatctggcgggggatagctcggctcattttatggcagaaaacgtagcggttccttttgtacattatagaaatgataaacccatttccatcagacattttttagatacggaaacttttaatttttcctttggaatagggaagagaagtgcatataattttgatgtacctgatttgtacattctcaacaaaatagaaagaatttctgatgtgagcgtgaaaatgacttataattcaaaattcattacctggctgctgggggcatttcaatatctcagaatctacaatattttatctttaaaggagagaaaaatgatttttggatccagtggcaccggagatcaggctgtctttgaaattgtagttgatgatccttcgggacaaaagaaactgagtctgcagagcttaaaagggcaggcagaactaaccgccttatctgctgttctacacaccgaagaactcttgaggaatcctcatgaaaataaggtctggttcagtcatcagctgcatgaacctttatcattactggcacaacttaatgcctatgattctatcaatatcaatgtgataccatgaaaaaaatagcaattatcaacggacatccccataaagattccttcaattttggagttgcggaagcttataagttgggagctgtagcatcaggagccgaagtcagggaaattgtcatccgggacttagatttcaacacaaatctgcagtttggataccagaaaaggatggagcttgaaccggatttgcttaaagcatgggaaattatacaatgggcagatcatttggtttgggtgcatcctgtgtggtggggcggacttcctgctttaatgaaaggatttatagaccggttatttttaccgggaatggcgtataaataccgggaaaactccgtgtggtgggataaactgttaaaaggaaaaacagctcatatccttacaacattggaccagccgggctggtattaccgtttgttttttggaaggccaagcgtcaatcagcttagaaaatctgtcctggaatattgcggagtaaaaccggttagagttacttatatcgggattatccggaattcgaaggatgaacagagggctcagtggcttacgaaagtaaaggtgctgggaaagaaacagaaataaggtccccggaatttttaacatatgatgtaatgataactttatccggcaataattttctattgtcagataaagtttcattgttaaagaaattacttaaacttatcaaaaatattggatatatattaaaaccatgaagaaggattaagaaataaagcataattaagatgaatcattctgatttttaagcttaaagcgaagcttatcttaatactctcaacgccttaatacaatcttaatgtttcaataaacaaaagtttaaacaagtttaaagtaaaaatactcttgttcccatttttacagtcctttttttccttcaatccaatatgcctgtgattttatgcatttcggagagattcctctggctttaagaaatttcctgatcagtgacattcgtcctccgtttccggtaatataaaagataacttcatcatcgctaatagcttctttttcttctgtcagaaaatcattcagtgcctcaatcattctcatggtattgtttttagggatatgatagccgtataaattgagattttcaagtgctgaagcttcttccagttcatgcaggcatataaactgtaagccattttcttcaacaacttctttaatggaaagggaacttccgagtgaagtttcatctcctacagaaaaatgaattcttgcatggggttcaaaaaaacgttttcctcttggtattaaaattcttacagaatctccggtagataagcggctgataaactggcttcctacagctttgtcatcatgtacatgaaatatcacttcaaaagttccggtctccctgttaaaattaaatggtgaataattgcgaaaatctctatcactgacccggattcctattgcataggcgggctcaaactgaacatcctgtaaatcactttcaaaatatatccggcgaagaccaggagtgatagattctatgcgggtcacggtacaatctttaaattttgaggaccagacattttctacagtgtcattgatccatttcggtaggcttggcataagtcattttttattgcaaaggacgttgcaaaatcagaaaatacctatagcggtttcggggaattaattggactattcgtggttgagtttattggttttgattccggaattctgagggcgactggtcttccagttttgaaaataaacggctgaagtaggtatgatcactatacccaagctcataagctacctcttttacgctcagattggtgaaaacaagcaatcttttggcttcaattaaaatctcctgatgaatccagtgctgggcgggctttccagttacttcacggaccgtttccgttaaatatcctcttgtaatattcaggagttctgcgtacccggatggacttttcagggttttgaatttctttctgaccaaaattctgaatgctcgcgatagttgcaaagcacggctttcgttagaaacagggaaattatttttctgagaatacatcatcataaacattcccaggaaggcattgaggaaagactgaacaaccagaaagctgtctttggcagacagcatttcatgagtatacgaatcatgaagcatccctgctgttgtgctgattttttcgctatatttcttatctacagataaaggttgtatctcaacaaggcattcatcaaaaaaagtccgtacggcatcaggaacaagttctgctttaacagcaataaaccatccggaaacattattcattaaaagtccctgatgtacttgcccgggcaatacacagaaaagagtggaatcttttgcttcaactgttttaaagtctaccatcatttttacatgtccgctttccatgcaggtaaaaatataatgactgtcccggtgtattcctttgttcatgagagcgtcttcaggcctctcattccatttatccattcttttgatatggaatctgtggccggaaataccactcagatcataagtaggaattgtctgtttcattgctgagcctgttgtaatgaaggataatacagccacaaaattacatattttcactgttttatactccggatattaatctgaaattcgcagtgcattacatcacgatgtcttttgaagtcagactttatatgaatatacactggtatcttcagtatccctttcaggcaattccttcctttttctccaaaagaaataagcaacagcagcagtcgcaatgggaagagcaatgccaaattcatcaatataataattggtatttcccgtatctagagtaagtggtgtaaaaatagactgtataaaaaggttgtgactggcgtgcaaaatagcgcctgtccataaactcccggattttaaccttagccatgtgaagataaagcaggatgcaaatatcatcactgtaaaacataaaagagccagccatttggggccgcccgtattataattggaaaacaggagaagaggataatgatagatagaccatataaggcccatccagagagaggtaaaagtataagaattaatcttggccagctgtggagtgagaagaccccgccagcctatctcctcacctaatgccgagcctacagagcgcaccatcccaaagctgctcatcagaataatgtacaggatcaaggtctggccatcagaaagatcccaacccatacctttacccgcttctgctacaaactgatgattataaaacccgccagctccactaatccagatgatgaggtaaggaacaaggctataaagaataggtatgcagtaagccataatctggtatttcgtaagaccccatttccagcccagggaagaaacaggtattttccggatccggcaggtaagaagtgctgcaatggccggacaccacattacaatagttgcataagatataattcctccgccgagttttccggtacggatacacatataataaaccgggaggcagaaaagaagggtaagaatcaggtaagtggcaatatttttcctgatttcggatttgggtatcgtattttccatagactgatctggtgttggagtttataaataattgaaaaacagaatattatttttaaataaaaatacacttatttctaatatcaataataactttattactgttcaatttaaaaaagaagtcttctgtttttaattttggaaaaatgtaaattagccaagataaatttttttccgaataccctaaccatgtctaagctaaaagtcataagagaacaaaagaacctcactcaggaagaactgtcagaaaaatcaaagatttctgtaagaaccattcagcgcatagaatccggaacagagcccaaaggacatactctgagagtgctggcgcaggttttggatatagaagaatctgaattactatatacccgtgtacaatccacaaatgaaaatactggaggtgaagaaacggatgaagaagaaaaggggcctcagatcaattattcttacatcaaaatcatcaacctttcatcacttattttcacacttttgccaccactgaatatttttgttcctctgatgctgatgtttaccctgaagcagaacaacagcctggcaagacagatcatctcagttcagatgatctggacggtaatggcgcccattaccttcatgctcggaatctttctaaagttcggaaaacagtttacccttgtccttatgagcctgattgttctttccaatgtatttattattcttcgaaatgcagccgaaatagaccggaataaaaaactctatttcaggctgaaattcagtatgatataaattctgtcaggactttgtcgggtttttgtcgggtcagtttttaatgaaaaatctgttaaaaatctaacctttgtcaaaaaaataataatgacaaagtcttcacaattgatcctttctttttttattctgttgatgaatgtattgcatgcacaggtagaaaaaacagatcctctttataaaactattatgtcgaaagatagtttgctttttactgcggggtataataaatgtaatatcggacagatggaaagtctgctaaacgacaggtttgaattttaccatgataaaggtggttttgcagacaaaaataaatttatcagtgattttaaaaccggattgtgcaaatctccggaaacctatcaggtaaaaagaatcctgattgataagagcacagagatttatcccatgtataaagacggaaagatctacgctgccattcagaacggagatcacctgttttatgaaaaggcagggaatcaggctgaaaaattagtaggcgaagcaaaatttacccatctgtggatattggaaaatgctgaatggaagcttaagaattcattgagctttaaccatcatccgaaacaaactactgataatgaagcgatttttgataatgatcagtcgatgcagagctggctgaaagaaaataatattcccactcttggattaggaattatcagagaaggaaaattacagcaggtaaaagtttttggcgaggtaaaaaaaggcatttcagcgcctcaaaatgccctatttaatgtagcatcgctcaccaaacctgttacagcaatggtaaccttacgccttgtaagccttggcagatggaagctggatgaacctcttgatacctactggacagatccggatattataaatgatattaggcataaaaaattaacaaccagaattattctcacccatcagacgggatttccgaactggagatggatgaatgccgataaaaagctgaacttccagtttgaccccgggacaaaataccaatattcaggagaaggtttcgaatacctgagaaaagcattggaaaagaaatttggaaaatcgctggatcagcttgccaaagaactcatctttcagcctctcagaatgaatgataccaactatatctgggatcagaatactgatgcatcaagatttgtaacggggtataatgaaaaaggagagggctatccgatagagaaaattacaaatgctaatgctgccgatgacctgcataccaccatccaggattatggaaattttatggtgagtgtcatgaaaggaaaaaatctgaagccggaaatattcagggaaatgataaaaaaacaggtaaaggttaaagaaaataaatattttgggttaggctttgagatttatgatctgggaaataatcattatgccttatctcatagcggagcagaccagggtacccgctgcattgccattattttacccgattcaggaaagggaatcattatttttaccaatgttgatgatggttataaggtctatgaaaagctggttcttcattaccttggagaagatgggaaaaagattgtagacatagaaaccagataactgtttatgcaatgaaaatctttgtatattcgggatatcaatctggaaataaatgcgataagcgtatttatttccaggatatctattatgaacagaaataaaaagaaagctatgtggcaatactatatcatctctgcagcaggaatcattctgtttgtggcagctttgctgagtttcagaaacactcttacgttcttaaaaaaagcagaaaaggcaacggcaaccgttacctcactgcggatagatgattctgacggagaagtatatatgccgctctttagtttccgtacccgtaataatgttgaatatacttttgaacttccggaaggcaccaatccttcagcatggtcagtaggtgagacggagactgttatttatgatccggaagatccttcttctgtaagtttatatacctatttcagaatttttgcatggccgttaatactgatctccatagcactgccattactggtgattggcagcgggtattttattgcagaaaagtttttacaataatctgaattcttattttaccttttcaaggagatataatttagcaccggaaaatcctaatttgggcatcaggttaccttccagaaccatagttttactgttgacatcaataacagaaatatagttgttggaattatattctatatagttttctttttctttcgtggaaggattctttccgaactccattgaatacttcacccaatcttcatcctgggtgctgcagtgtaccggcttgaatttggattttttagccttgaaaacgatctggtcaaaaccttctgtacattccgaggtaaatgaaccgtcaggattctgatctttagaaaagtcctcaaatgaaccacggtaaacacccactactttccaggtgccgtccagacggtcttcatctatttttcctttggccttacttaccgcccagctgattccgttaaccgttccctttacggctttatatcccagatttacagctccggatacaacttttgttgccgttcttaccacacatgaattgagaaccagtacagccgaagccagaaatagtatttttttcattttgtcaaattttatcctgcgaagatagtattttaaaaaaagatctgtaatttttatcaggaaagcaggagaatttgttttattgaatgataccctttatttcccgtcaaaatacttcttaagatcagaaatattcctgatatgaagctcttcagcctggtttctgcgcatcatcagtgcataagcattgttgaatcccaagggctgcagccattgaattccatattgtttttcaaacgctgaattcacataatggtatgttttatcaggactttgggaaacctctctgattgtttctgctgaaggttttaaaagaaccagaagtccggttccagtatattcagggtaaaaatcaattgcgtcattcaataaggcatcgaaacagatttttgttcctcctaaaccggttttggtttccactttataatcagtatacccttcaataagcatagtgtacatttccgcaaggatatattgttcaccaaagatttttgaaccaatccggatggttcccgaatttcctttccggggacttttatacaggttattgctgatgagaaaatcctttgcaatcctttccggagtctggtggagatgatcagctctgtaattcaggtccgtcatgatggaatcattgaattttccggccagtaaatttaaggttttctccagatccggaaattttttcagtgttttagtcttgataatgggagccgcataatatggaggaaatattttttgatcatcatccagcacatacagatcatatgctttgattcttccatctgtagaatatccgctgatcaggtccaattctttctcataagcggccttatacataattgcatcactcactacaagagggttaacattgagtccatatacggaacgaagcccgatatcaccgtcctgtcttcccataaattccggggtaaaaccggctttaatggttcgatgtgatactgatgtcaaaagatagcctgctcccagaacaataaggctcgcgggaagaatatatttcagcttctgaaaaaatctatagcctgatttctggatcatagcaatgatctgatccagtacaacggccagtaatgcggccggaatggctccggcaagaatcatattcgtattgttgagcgaaattcctccgaagataaattctcccagaccacctgctgccacaaaagaagccagggtagctactcccacattaataaccgctgcagtcctgatgcctgcaatgatcaccggcatcgccagagggagttttactttaaaaagaagctgcctcctgttcattcccatggctttggcagactcaatcactgcaggattcacccctgtaattccggtataggtattccggataatgggaagaagagcatagatcagtaaagccgcaatggccggtttcggaccaatgccgaaaacaggaatcataaatcctagcagggcaatacttggaatagtctgtaaaataccggcggcgcccaacaccagactggaaagcttttttttcctggatatcattatgcctaaaggcactccgatcacgatggccagaagcaatgacaaaaaggtaagaccaagatgctgaatgatctgcacagacagcttttcgtgttgttcagcaataaattgccagagactttgctgctgtgtcataccatctgtgattttttataatgattaaacgctttcactacttcttcataaacttcagcattttgatgatcagaactcagttgctgcaaaacatcccagacacttgtattatctgtactgtccggtctgtagtatgaattttcaggagtaagaaacggactgatatggtgcagcgcagctactttatattctaacagaagccggttttcagcaaaaaaatcacggacaaaatgcgtggcaggctgataaagcatttccctgggagtgccggtctgtatgattttcccgtgatccatcagacatatcctgtgccccagttcaaaagcctcctgcacatcatgggtaaccaggataatggttttatttttaagttcttccagcgatttaaattcggaatgaatatcagctctggtaatattatcaagtgctccgaatggttcatccatcagcaaaacagggctgtctgcaatcaatgcccttgcgatgcctacccgttgctgttgcccgccgcttagctcatggggaaaccgttgcagaacttcttcagaaagatggagctttgccaggagctcatgcgttcttctttccgttttctttttgtcccatttcagaagttcaggaactacggcaatattctgctgaattgtataatgaggaaataacccggaatgctgcatcacaaaacctattcccattctcaaatcctcgggtttctgatctttgatatttttaccattaataagaatgttccctgaatctgcttctataagacggttgatcattttaagcgttgtagttttcccgcatccgcttgtgcctaaaagaacaaggatttcctgatcagatgcctgaaaagaaatatgatccactgctttttttccgttaaaactctttgagattgattctactgtgatcataggtgaaaattaccgggcaagtctgattcctgtgaactgccattttaaattaggctgaaaaaaattacggtaggtctttctgctgtgtcccggaggtgtagcttctgatgctcctcttaaaaccatctgattcaccatgaattttccattgtattcacctacagctcctgcttctttcttaaaatgaggatagggcaaataggcagaattcgtccattcccaccgtattccccagtcaaagtagtcagaagcaacttcccattcttcttcagtaggaagacgcattcctttccaggaagcaaaagcagaggcttcgtagaaattgatatggcacaacggggcatcgggatcggtttcctgtagtccgttgagtgtataatacatccacttgccttcaatataatgccagtatagcggggattttgcagaattctgtttcacccagtcccatccttcagcatgccagtgcctgaaatcttcatacccgccggcttccataaattctaaatagtctctgttggttaccagctgactggcaatttcaaagtctgtcagatatactttatgccttcccagttcattatcaaaacaaaatccttctcctttaaaaccaatttcatacactccttcagaaaagctgagcatttcggtagtttttgaatcgttttgtacagatttttcttctgtataagccggaaaaagcggattatgtcctaaaatatacttaatatcagtgattaataattcctgatgctgctgttcatggttaagtcctaaatccagaaggggctcaacagcttctgtcagaaatgaactttcaagaaaagctttcatgtgttcatccacatactttctgtattggtatatgtctgaaacagaaggacggctgaggtttccgcggtccgtccggattacccttgccccaatagtttcgtaatagctgttaaaaacaaaattatactgatggtcaaacactttgtaatcaggaaaatgaggaacaaggatgaaggtttcgaaaaaccaggtagtatgtccaagatgccacttcggcgggcttacatcaacaataggctgtactacataatcttcaatttccagtggggcacagatttcttcagaacgtgtgcggacgtccatatactttttcgtaatatcttttgtggtggtctctgatgtcatgtcttttagtttttgatgattggtttaaaatgaaagaaacatgatttattttcactttgcagatgctgtgcagttttttattgtacctgccagatcacatctacaaaccattttttagaatctctgatctctccggttatggaaaatcccgatttttcaccgagctccctgatcttttcaggcgagaacttctgtgaaatctccatatcaataatctcattttcttcaaatgaaatcctcgtatcgccaatcgttacctgctggctgataaggctcaccagaaaacttctgcaggctccggagacagggtcataagtctggtaatgctgaaattgtttcagatcaaaattaccgccaagttcattgttgatacggctcaggagattaagattaaaggcagcggtaatcccttcctcatcattataagcattcagaacagtatgcgggtttttcttcaggtcaaatcctaccagtacacggtctttggaagacagacttttgttcaggtgcacgcagaaatcttcagcttcttccagaggcatattcccgatattgcttccgaggaacaaaaccacttttctccggttggataatgcggctgctttttggagcatttcaaaataatcaccttccaaacaggtaattttcatttcaggtaaccggttgctcagtttttcttgaagtatagaaagaatattccctgaaatgtcaatcggcatataggtaaaatcaatccctttgctcacaagtctttcgagcagataggttgatttcattgcatctcctgcgcctaattcaatcaggtcaaaagattcggttccgggaataaggagttctataagttcatctgttttattcttgaaaatatccagttcacaacgggtcagataataagcaggcatagccatgattttctgaaaaagatgatcaccggttttatcgtaaaaatattttgaagataattttttaggagtactctgcagtccgttcaaaacatctgaacgaaatatatctgcagtattttttgcagtctcagtgtgtgaatctaactgtacattcataaatcttattttgtgtggttgggtagagcactgcaattatcctgccttttaaaacatgaaaatttttttgctttatctaattaaatataaacaattttacttttaataatttgattttcataatatttttatcaaatgttgtactttttatctcattattcaatcaaataaccctgagctcagacataaagtcaaacagctttataatggttctttatttccaatatcactattggttcccatgcaggatttcaccaccttccagggacatttcaatagcctggttactatacatgaccatttgtttttcataatctccaacagcttccggaatactgtttttgctgatcagataacgggtcagaagagcagcatctgtaaaggctgtattggctcccactcctcctgcagggctcatcgtatgaacagcgtcccccaaagcggtaatatttccggatttccacggttcctttggtaaagaagaccggataggagtgacagataaggaagacctgtctgcatactgaaataatgccttaagctgaggatgccactgatgggtcactttatgaacagcatttaaaatatcttccgttgaatggctgtagaaatcagactttaccattccaaaaactttgggattgccgataaatgcccagtaaaaataatcggagatcgggctgagaagatcccaggacggatcttttcgggaaaaatcaaaagacataaaatctgtgattaaagaaaaccggtcaccaatgatcactgaagtgccttcctgtaattccttggcaatggcgtgccgggcttcctcagaatgaaaagttctcccatagatggtaatattcccggtattgatttttctgtctcggcaatactcctttccgattcctgaatgaactccatcagcagctactaccaaatctgcagtgtaggtaaagccgtctgaaaatgtaagttccacttcaccgctttctgtttcctgccagtctgtgagttcttttccaaaacagatattgtcctgtaggccctgaagcagaatttcacgcaacgtcatgcggttgggtttcaggtcgggcatttcttttactccgtcactccaggattctacaagaggattttgagagctttcaagagttgttgttaaaaccttcattccgctgtagcttgccgcgcaggtagcaaggaacagcctgtacagatttccgggaaggcattcctctaaagcttttctgccgggctcattcaccctgattctgtatccttgtgaacgggtgtttattgctgcgtctttttcaaatacggtgcataggattccattcttttttaatccctgagcaaggcacagacctcccagtccggctcctataacagcaatacgtttgctttttaattgttgtaccatcataattgttgatcaatctttttattatttcttataattgacgggacaaaattagagcctggggacagggaataggagagctatttaacggtgatgatgggacaaatcatggttttcagatctgaactgtaaagcggtcattcctgttccttttttaaagaaccgtgaaaaataaccaggatcatcatagcccaactcaaaagcaatctgttttacgtctatatgggtgtaaaacaacagacggcgggcttcccacagaattttctgctgtatccagaagctggcaggatatccggtaacatcttttacggcttcattcagatagagtggagtaatattcaggaaatctgcatactgctttacctgtttggttgtcctgaaatgctctgtgatcagctttttaaactgccttgtaatcgaatatctttggccacggtgctgaaaattttctgtttctgtttctgttcctgaaattcttgaaataatgattccaaccgaggattcagccaatgatcttgtgatggaaggaagatgtagcgcaggatctttttctgctttttcgaaaagagggggcaggtcaaaaataatgtcattttccgtaacggctgaagactgatggagccattggcagagatccagtatttcgcggtaagattcaggaataagttcagcttctatgaataaaaaccatccttcgttgtctttctgatgaatatactggtgaatttgcccgggaccggcaaaacataaggaaggaccttttaaatatatcttgttaaaatctatttccattacaaagtttcctttctgctgaagaataaacatataatgatcatccctgtgaatttcagcctgtttctcatggaatatggataagggtatcacccggacagctgaattttccagttgattgtgatgggaaggaattgcttttttcatatattttacgaagatacgtgataatgatgattgataaatgataattgatgattgatgagttgctcaggtagtttatttatactgctgtctgctttaacgtccgaaaatctggattcaccgcttaatatgacctgttcaaagtttttgtattgagttccggttctgctttatcataattttaccattataaaacctcacgattatgaatactacattgaacttcagtaaaaaaataagatccgctttatccctgatcatttttatagggacgggattattatcactaaaagcacaggctccttccactggtgaaaaagaccaggaaagtacagctatcagatcagcttttcagaatacaaagaaaatcagggccgggcttctggatgttggatatgcagaagtagggcctcaaaatggcaaacctgttatccttctccacggatggccgtacgacatccatagttttgaacagtcttctgccatacttgctgaaaaaggctaccatgttctggtaccttatttaagagggtacggaacaacaacttttatatcacctgatacaaaacgtaatggccagcagagtgctgtggcaatggatattattgcttttatggatgcactgaaaattgacaaagccatcattggcggctttgattggggtgccagaactgcggatattatggcagcattgtggcccgagcgctgttccggactggtggcagtaagcggatatttgattggaagcccaaaggcaaacgaaaagcctctgcctccgaatgctgagtttttatggtggtatcagtattacttttcaactgaaagagggtataaggggtataaagctaatactttagctttcaataaactgatatggaaaacagcctcgccaaaatgggcatttgatgaccagacctatgaacgttctgcagcggcattcaataatcctgaccatgttgatatcgtgatccacaattaccgctggcgtctgggattggcgaaaggggagaagcaatacaatgcgtttgaagccaaattggcaaaatctccatctatcaaagttccgacagtgaccctggaaggagatgccaacggagctgcctttcctgcccctgaaagttatgcttcaaaatatacaggtaaatatgcccaccatacgttaacaggtggaatcggacataatttaccacaggaagctccagaagcatttgcagaagcgatcatggaagtagatgctatgtcacaggccagatagaacctgacggattaagaaaaaaccaccgctcaatgcagtggtttttttattgtatcttattaaaatgttattcttgacgatccttttcagtctttagtttattagccagaggattagcgtacatagccaggaaatattccctggaaacaggatctgacggatcaatacgcatttcaagtctgcggacaaataattgtttttcctgttccgtatattcggaagcgtaggtattggtattgtgcaggaggtcgtaagcgatgtacttggtaggccaaagcttataattactgatgatggaacggtcaatcacctgggcaattgcctgtagctgcttgtttttgttatcgatagtggctgcaatttcatccagttccgtatcaagcacatcaccggcatgaaggtgaatgcgtttcttctgtcccagaattccgctcaggatattggtgaaatcttcatttttccccttgatatattcttcatccctgtgttgtgccagcagttggggcatctttagggaatctgtaggatcatattcataggagatggataccggaacaatctttaaggacttaaaataatccgtcaaggactggtcaccggctgccatagccagcattttcaaaacaccctgctgggtagaatcgttaccgtcttttgtacggccttcacgttgggcaatccatacggaacggttttcattatatagctgttccctgatatattcagacattgtctgtgaactggtgagctgttcacgaagaggaaggcctctttgcaccaggaagttgcggttcagcttggcaagtacatttaaaaactttttgcggacaagattatccccgatcgccgaagcggtcataatataaccaccttccagcaagaccagattaagcagtgaagtatccagaacaatatccctgtggttggagatgaaaaggtaaggggtgtttttatccagcttatcgaaacccgaagtcgttaagccgtcggagcttttcgcaaggatctgccgaacagcaaacgcgacaaactgatgctggaaatcactaatggaatgaacatttttgaactgctccagccatacctgctcatccgtatcaggaaaagtaaaattcatcagtgctttcatcatgggatcacgggctatgctctgtaatctctcattcacttcctgatcatagaaataccggatttcatcaaacttagacatgcggttgggtaaaaattaaaactttttgcaaaagaacgaaaatttattgggggattaggtataatgggtgttaaagtattatgaggggcgtaggagttgggtgaaatagttgtgcaatagatcggcttgcacaggcattcaatttgttattccgtgagctaagtttttgtgtcttatttgcgcccaccttatcattcagcatgaatctaaactattattttatcattatttattattaaatgctttctgtgtccggattcctacggaatgacaagcgttgtggataggctaggagaatggttaatattatgtctggagaaagtaagcggctatgcacccacatacacgcgcccaccttgtcattccgcaggaatctaaactattattatcatgcactatgaaaaaagtttctttgcctggattcctacggaatgacaagcgttgtggatagattaggggaatggttgataatatgtctggagaaagtagtcagctatgcaccaatacttacgcgcccaccttgtcattccatagaatctgaactgttattatcatcatttataccaattaaaagtatagaatgcaaaaaaatattcatatcaaagccaattctcaaacaagtaattcaaaaattctaaattaggatttgtgctccttatcaattcaagtttcttaattcttgaccagtttttaatttccttttctctttcaatggcatgatgaatccaattatatttttcataataaattagaaattcaagattgtatcttgcggtgaagctaccgggatttaacttggttttgtgttgatacaatctcctgtggaggttcccggtaacaccggtataaagtacttttctgcttttattggtaagaatatagatatagtaggtatggcttccttttgaaaacttaatcatttgtgtttgttttataaaagttacaaaaatatcctgctcgtgttgcaataatctaaacacttattttacctttacttatgtctggagcaagtaagcgactatacaccaatagttacgcgcccaccttgtcattccgtaggaatctgaactgttattatcatcacgcattaagaaaaactttctgtgtatggattcctacggaatgataaacgttgtggataggctagtagaatagttgatattatttctggagtaagtaagcggctatgcaccaacaattatgcgtcccctcgtcattccgtagaaatctaaactgttattttatcattatttattattaaatgctttctgtgtatggattcctacggaatgacaagcgttgtggatagattaggggaatggttgatattatgtctggagaaagtagtaagctatacacccacatatacgcgcccaccttgtcattccgcaggaatctcgatcattttatttaagtcatttaattgaaaattcagaattcctaccaaattggttctcacctttgccctgtattaattctaatatcactgtgaaacaagtaacaattttagtagcgatgctgtgttcagcgttaatgatcaatgcacaacagggagccggtcagggaaaaataagtgggagagttgtggattccagtacaggaaaaacaatagatcatgccagtatcgggctcctaaatcaggataataaagaaatcaacgggacgacttcgaatgaaaaaggagagttttctatggatcatattgcatcgggaacctataaagtggctgttttttatgcaggatataaaaataaaacaacagcagatattcagctcggggacaataatgcggtagttgccctgggcgatattccattagcaaacggagaaacggcaatagaaggagtgacgatcgttggtaaaaaagcggtgattgaaaataaggttgataaaattgtttttaatgccgctaatgatgtgacttctcagaatggagctgcgattgatgtcctgcgaaaggttcctcaggtgacagtggatgcggatggaaatgtggaacttcagggaaatgccaatatcaggtttttgattaacggaaagccgtccagtatatttggaaatagtctggcagatgcactcgcttccattccggcaagtcagattaaaagtattgaagtagtttccagtccgggagcaaaatatgatgcgcaggggacgggaggaatcattaatattgttctgaaggataataaagtaaggggaatcaatggaagtgtgaatgccacgggcggaactttatttgaaacaggatctctgaatctgaattataagaataataatttcagcatgaatgctttctttagcggaaatgctcagctaaaagcgaagactcctttttctcaggacagaacttcaagagatacagcttctattaccagcacccatttattacaggatggatataccgattttgaaagacatggttaccgtacaggtttaggtttcgactggaatctgaataaatccagttcattaagcggatccctttctttcaatagcttttcgaataaaagtacaggattaatcaatcaacagcaatacattacggatcatactacttctgatgtaacctctattatcggatccagaacttctgataaccaatcttccgttcgttctgtagatggaagtctgagttttagaaagagctttgcgaaagaagggcaagagcttacggcagattacgtcttcagttatagttctccgaaaagcagctattttcatacccaaagcttattgggagcagcaggtccttacaatggaatttcagggagcaatcccggaacggataacagccataatatttcagtagattacgttcaccctttgaatgataacgttacttttgaaatggggcttaaaacagtacagcagcatattaccaatgctaccgatgttcatgttttgaatacttcatcaggacagtatgaaacagatcctttgcaatcctatcatttaaattatgatatgggaatctatgctgcttatttttcttccagattgaaactattgaactggctggatgtaagagcaggtctccgatatgagtacactactctgaaaatcgatttcccgaatacgaatattccgtcatatggcttactggttccttcgttgatcttgtctcacagatttgatagtgatgaaacggtgaaactatcttatacaagaaggctggagcgtccggaatatacagaactgaatcctttccttaatgtcagtgatccgcataatattaccaccggaaatccagccttgaaacctgaaattggagataatatggaattaggctacacaaaaaacctggccaatggagggaatatctccttgtcccttgtagagcgcatcaacagtcaggatttaaaacagattaccaccttttatccaatatttacagccaatggaacagagtataccaatgtatcggttacggcaagagataatatcgggaaagagtacaattccggtggaattgtctctctatcacttccttttttccagaacaaactgaatctgagaagtaatatcatggtatttcaccgttatattgtaagccatatttatgtaggaaatttggatatgggaatgcggtaccgtgcgaatctgaaccttaattatcagtttccaaagaactttgttctggaagtgttcggaaattataactctgcagccaaaaatatccaggggaaaaatccacaatcaatcacctatacctttgccggaagaaaagagttctggaacaaaaaagcaagcttaggatttaccatcaccaatccgttcaataagtacatcaaacaggtaaccactgtgagtaccggagattatgattcttattctgtaagagaattaccgtaccgatcttttgggatcagcttcagctataagtttgggaaaatggattttaaaaaggagaaggatattagtaatgagtatttgaatgggccgggatcgggaggttagaattaagtaatggaatggaaatagtttctaaatatttttttatatttaactctttataatagatgatgaatatggaacacaaaatacatcagggacgcaatgtaaaacgattcagggaaatgctgggcatcaagcaggaagcattggctcttgaccttggggacgactggaaccagaagaaagtttctctgctggaacagaaagaaattattgaagaccctttactgaaaagaatttctgaagtattgaaaattccggtggaagcgtttcagaattttgatgaggagcaggcggttaatattatttctaatacatttggtgagaatgcatttagtaactcatttaattatggtacaattaattttcatcctattgaaaaaataattgagttacatgatcaaaaaattgagctttatgaaaggatgctgaaggagaaggatgagatgatggggagactggagaggttgattgagaagagatgatttaagatatagaaaaaggttcagcagatgctggacctttttagttatagtgttgaatgtttattttatagatgtaattagtctaaattcataaatatttggagcaaaaaacaaagtttaatgtttttaatttactatctttaagtgtgaaaatagaataatatttaaaataaagattgaaataaagaaatataaagacaaatggataatctaaccaaagagcagagaagaaagaatatgcaggcaataaaatctgttggttcaaaggcagaagtaattttagctaagtctttatttgcaaaaggttatagatatcgtaaaaataataattctgttcttggaaaacctgatctgactttcaaaaaaataaaactagccatatttgttgatggagagttttggcacgggaaagattgggagataagaaaaaaaaatcttaaaacgaatcaggaatattggattcctaaaatcgaaagaaatatgcaaagagataccgaagtcaattcaaagttatctcagctaggttggagaattttaaggttttggtctagagaagtagaaaagaatttagatacttgtatttcacagatcgaatatgaaatcaataaattaaaaaacaaataaccagatatgccaaatacaggagataattttactacaacattaaaacaagctcatctagaatggggagctcaccgccatactagtagtagagaaattagatatggagaaggatatttacaaatcccatctacatatgcttataattttgagataacaaatgataaagaactaacaagaagccaaatatacacttttagtactgctgatggttttattcaaaatggatttttaaaagcttcaggaaatcaagctagagaaaattatgcaaagcaatttcatggcaatggagctcttaaattgttgggtgattggttttaccatattgatgctcaagaaggagatcaaattaaaattgagtttacaagcccaacaaatattcttcttactaaagtttaaaattttagccctcttttttgtaaattgcgctttgatttagaaagaaatgaagctagcaaaaaatatcagtgttgaagaactaaatactaaagcctgtcagacagaagttctcaaaaatattgaggatggggaagctgtattaactcattatcttcataatatacataatggattgtcctcgcattataaagaagatgccatgcaggtaataaaaaactatttagaatacaaacaggataataatgtatcgatagttgaggaagaagctattcagcagtttttatttgaagtagaaaacgttccttttcctacccctgaaaactattcatttaaattcattgatttatttgctggtataggtggttttagaattgctatgcaaaattctggcggaaaatgtatttacacgagtgaatggaataaagatgcaaaaattacttatagagaaaactttggagaaacaccttttggggatataacaaaagatgaagttaaaaggagaattccaaatgaaagaatagatgttctttgtgcaggttttccttgtcaggccttttcaatagcaggttatcaaaaaggattttctgatactagaggaaccttattttttgatattgagcagatcgttgaaaaacatagaccgaaagttgtgtttttagaaaatgtaaaaaatctagtatcccatgataaaggaaatacatttaaagtaattattgaaattttagaagaaaagcttggatataaggctttccataaagttctaaattcaatgacgcatggcaatgttccacagaatcgtgaaagaatttttattgttgcatttgatccggatcaggttcctaactatgaaaattttgaatttcccaaaaaaattaagcttactaaaacaattcatgattttttagagaaaggaaaacaagatgaaaagttttactatcctaaaacacatcagtactatccagagcttgaaaagacaatgacaagtagggatactgtctatcaatggaggcgtgtctatgttagagagaataaaaataatgtttgccctacattaacagctaatatgggagctggagggcataatgtcccattaataaaagatgattttggtattaggaagctgactccaaaagaatgttttgctttccagggatatcctatggataaatttatactacctaatattgcaaatagcaaattgtatatgcaggcaggaaattcagtaaccacaagcttggtagaaagaattagtaaacaaattataaaagttttgtaatgagtgtttgggataggtattcagaggaacagcgtagtgaatatatccaattcttacaggtatatggtgctctttcaaatttgtttagacagaaaaaaggggaagatataccacatcttgattcaaagtttcaggaaaccatttttgctaaaatattcaactgtcaaaatgtagatattggaaatacaccccatgatgtattatctgtttttgatgataaaagaattggtataggtttaaaaacctggatggcgagtaagccgtcttttcaaaaagtaatgcagctaaagcgttatcaaaaggaaataaataagtttcaagataataatgaagctcttgcttataaagtttctgaaataaaaaatgaaagaatgacgagtgattatgagcgtctgggtttgtcagaaactgataatatatatcattacgtgactcgtgataaaggactttttaatattcatgaatgtgcatatccgctcattgatctatctaatttacaaataatagattctacaagttctgcattaacttggagtgatggccgaaaggattataaatatacttatggagattctcaaatttggcaaaaatttgatccaagtaaaaaagatacactactattaaatcgttttgatattaaaatcatagaggatccttttacttttttattacaatcttatttaaatcttactgattcgattcatcaatctgaagatgatttcgtcgaagtgtatttacctctctattcatatagaagtaaggaagtagaagaaaaatccggattgaatgcgtggaatgctgctccaaaaaataaaggaagtgatacgttaagaccattaaatgaagtgtatatccctattccacgagaatttcataaaaaattccctgatttttttattgaagatattttcgaatttgaaaattaccgcaacgcctaccaaggtgaaaaaaaagataagccagaagttcgtttccgcctcctgttaccgaatggaaaagaaattccggcattagttactcaaagtaatatgaaagcgttgcaatctggaagtaacacagaatatgatgaaaatggaaagagatttgggcagtctgcgttaggacaatggctgttagttgatgttttaggcctaaagcaacgaaaggtggtaacacgagaatggttacaaatgaaagaaacagattcagtccgattatggcgaaaaaagaatgactattccttaatcaatatagactttgctcctatcggtgcatttgaagcttttatgaatggtgaacctattccacagaatgaagcataatcccttgctatgcttctactaaaccttcaagttcgttaagattattaaaagctataagatgattaaagccatgaaaattacctttaatagtttcttttgatccaaaaccatattttttgatattaagcagattatctttaataatttgtgaagatgcataaccgcaaagctgtaatgtggaattttctgttgaatggatgaaaatacaaggataggcgttgtcaatatctatcaatggtaaatttgaaccaaacatgaccacattgactactttatcagatataataatttctggcaaaaacttatctacactaatattttcaaagtctataaaagtgtttttcaaatgtttttgtaaacccattataggtattgatttgtaaagaaaattatctagaaatgcctgaccctcaaatttatctctaagctcatttatatcacgtactttaagatgattgataactaatttttctaaataaacaacctctcttctcgttagattaattgtttgaaatgacttcttataaggtagtaggtatttaatataatctttcataattgttacaaagtaatgaaaaagaaatttacccatcagaattagttaaatgattataaacatattaatgagctattataagtaaattgactgagttgttacagagttttatttaaatggctcttcgagaaggtttttaagaatcattttttatattcaaagttacggtctgcgccctcctacacatccacctcctcaacctccacactggcagatacacaaacaccacagacagtacaccagccagtacacccaccagcacagccattgccgtagcatccagcttataatcttttgagaaattatactgtcctataaagagcagggataaaaccagtgctcctgtaatcagaccgtgtaagatgcttagtttggtcatgagcttttttatattcagctgttcgtctacggtaaactcaatggcttcctggctggcggcatcggttacccttttgatgatatcaatggtaaggactaccggcaggaaaatagccatcggcagggtaaggcgggccaggttttgggttcctgagaaaaaatgggtgtagcctagctctttgaagctggcataggcaatgatgaaattaaaaaatacatttgggaggacatagtaaattgtacgcttcatgagaaagcgtctgagggtagttttttttataggttttggctttggaggctttattttaaatttcatagagaggcggtcaatagctcaatggctttatcttttatcttgtgggcttcttctttcggaagaaaattctcattggacatgaaggtgaagtccatctgctggttgtacgtactggcgactaaagtgtttgagttcagccatgggaaagccacggtaggactaaaaaccgtttccagactgaagttttgataatcattcgggatattcaccttccccatattggatagggtcacatcatggccgccttcgctggatttcaacatactgatcatacggtctacaatgggatgcatatgttctcccatccacaggagctcacgggcttccagtttattgattttctctgtcaggtcctttttgatctgtttggcattgcccagcacatccttactgtcttttttgatggaaagctctaccgttggggcgaaagcaaataaatgatcttccttgatttccggaataaaatgacgcacatctaccggactgatcaccttacctttggcacggtctccctgaacatcacggaaggcctgcatcaccgaagaacacagcaaagcatgtacagaaattccgttggctttacatttttcagtgatcagtttggtatcctcaggggtcattttccagtgaatggcgtagtttttcccaaggtttctctttttgctttttcgttggatagaaaagaatattctggcaaaaagcagataaaggccggctttatattttttaagacctgtattaaaatccgaaggcagaaaatcatctaccgattcaaaagcaacataaggaatcaacggaagataaggattgtccagcaggctcagaagctcccgtagtaaagtcactccggtggttccgtctgagatgcagtgaggcatgatccagatgatttccgaagtatcttttcctttcacccataccacttcagccagtggttttttgggttcttcaaagaatctgaaccatcctttttcggattctttaaaccagtcgtcgtctgtttttctttctacaatccggagcggaatgggttcaatatcttgttgtcctataaaaaaaggatagcgtcctttgctgtgatcaatattagctctcagcataggatgcttctgctggattttgagcaaagccgttttaaacgtgtcctcagcaatctgtccgttgatctttgcggtgtaaacacagtttaaaggcgtttcaggatctacatacatgatcctttccaccatcattaaaggtcttttgatcatgatactgccatttgttttagttgtgaatgaatcgtttgcatcacttcgtcacgtactgccatggcatcggtatacggtaaataaccttcgcttcccatgaaagaaaaatccattttaccacggtaggtagagaccaccagggtagtggtattccccaaaggaccaatgacagacggactgaggatggtttccaccgtaaatgctttgtactcatgaggaatctgaatacgtcccagattcgaaaacatacagtcgttggaggatttcccgttctttaaaagcctggtgaaattttgaagcgcgtcatgtccggattccatcaccatcatggtgaggtaaggattcagctttgaggtcttctgttccacagatttctgcatggcacggagattatccgtaaagcttagcttttcatcagcagacaccacaatcatcagcccgaaagcgaagatatggtcttctttgatctgttgggcaaaacgcctgatgtctaccggacaggaaactttattgaaggatttttctccccttacttttttaaatgcctgtaatactgctgcactcaaaaatgtattcactgtcaccctctgggatttacagtaagcgattaattctttgcttaccgtttcatccagcttccagttgatcaggtaatcactctgtctttccacagcttttttgcctaccgggatccatttgatggcggtagcagccagtcttccgataaatctggccttcagtctctgtctgcggttgttcagaatatgggcaggaaccacatcttcaatgcctaagatcgggttttctgtcccgatgtcggccgccggattgtccagagcgattaaaaactcttttaaaaaagccattgcagaaccaccatcgcaaagacaatggtggaacgcaaataacatgtcagaaacgtcttcccctttgatccagacaaaacggatcaggggtaatttttcataattaaagagggtgttccattctttcctggattcttcctgccactgatcttcactttgtctggggacgatccttacaggaatagaaatcgttttttcaggaacgttaaaccatggaatatttttttcatcatagctgatcaatgctctcagccatggatgtttgttttgaatttgggttaatgcctgctggatctcttttaaggtaaaagtccctctcagtctgaacggaataactgcgttaaaaggttctgttccgtcccctaataacatacgttccccgaatagcaatcttctttttacaggtggattcataggctacacagaagctaatgttgaatgttcgtgtacaaaattttctaacagttctaccgctttgtcatttcctccggcaagggtgaatgtgttctgaacttccctggcagcttcccggtatttcggattttccagcaattcaaaaacggtttcacgaagtgcatctacacgcagtctcttgtagcggatgctgattccgcagcctgcctgctcgatcagtttggcaatatggaaatgatcgtaagcaataggggtgatcagcatcggtaatccgttacggaaagtatcgtttaccgtattgaagccaccgtggcagatcaccatgtccatttgctgcatcactgcagattggggaacaaagctgtttacgataaaattatccggccattcttcaaagatttcgggtggagtagcggcaattactgtaaccggctggtctttaaatgcagcaatgatcttttcaaaaaatgcttttctgatgtctaccagcaatgttcccaacgatacgaatattttcggagtcgtggaagcattcagtttatcccagtcaaatggggcatcgttcgggcggccttttaccggccctacaaatttcatatgaggcggaacggtttcaaatccggcaaaagcctgtgaagtaaacaccatattcagtttgtgagaatggatataaatgccttcttcatgaatgcctacttctttttgcaggtctttgatcagtttttgctgccattcccagatttttggggcacttttttccgtatctcccatcacatccggtggaaccggagtagtggttacacaaggaatattgtttttgtgggcgaaaagcgcacctccgaaagtgatacaatcattcacgatcacatcgggcatccagctttctgtgagtctcgttaatcccggcatcatcattttagcgaaaggaacataggtttcttccagtgccagcttcatcacttcaggtcctgaacatgccggaccatcatcctgcctttttaaaatatgggcaatttcctcctgatacgggataaggtcttcttccggatagaaataagaacctccttcaggaatatgcttactgtctaaaggcgtaattccgaaccattttacttcatggccacgggcaatcagactcgctcccacacttaaagtaggactcacatgtccgaaaaacggaggaacaacgaataagaacttagaaggtttttcaggttttgaagcctttactatagcttgctccaataagtctgccgctgtggctgcacctcctgcttctgcaaaagactgacctactttctgagcggcttcacggtagttcgggttatttaaaatctgctgtacggcttctctcaggtgattggctttgaaccggttgaagttcagacgttcacctgcttctgtacgcaccacacggcctgcaacgtgagactggtcataggcaatcggaattactaccaaaggaatcccgttggataaagtttcagaaaccgtattgtggccgccgtggcacaccacaccatcaagatgaggtagcaggtccagctgaggaatctgctgatataccataaagttttccggccactgctcaaaaagctgtggatcagaaaccactacaacggttaaatcttcatctttaaaggcatcaattaccttctggaaaaacgcttttttatgatcatgatcgaaagtagttccgatgcttaccagaatctttttgttggcagcatttttcaatctgtcccaatcgaattcacaagagatacgacgctcggtaagaaccggtcccgtgaatttatattgaggtgccagatcatccatttccccaaagaaataattggaggtcagtaccagtgtcagcaggtctgaagtggccagggaacgttcttcatagaagcctaattctttctgtaaactgataatttgatgtacttcccattcgtgaacttttggaagctcattcataattttaatggctgccggagcggtaacggaagtggcataaggaattccaagaatttttgcagcaacagggactgcaaataactgatggtccccgataattaaatcaggctggtatgtttttaataaagcgataactcctttatagcaatgtctgttcagtggggtaagaacttcttcgtaaaggaacttcacactgtcgattccgtacactacttttttggaaataatatcaagatattgttcactttcttttttttcttcgtcggtctgatcgtattggatcagtaataattttcctccctcgggaagtttagcctctaacgttgggtcaaggctgatccaggctacctcatgtcctctttccagtaacgtagcaccgatgcttaaggtaggattgacatgtcctgtgagtggtggaactataaatgcaaatttagccatggttttgtgttaggattttagataaaaattgagcaatcgtttcagcgataagctgaggttcctggataggaatattgtgatcacccgggattaattcaagttcagactggctgatttgagactgaagccactcaccggtaggcctgcagttggaatcagcgccataaagcaataaggtaggagccgttaatgcattgaaacgggcttcaccaaggaaatgtttttccttgatcatatctgctttgatgctggtctggttaaacagaaattcatacatacggtggttcttttccatttgtcttttgcccatctgcactttggtggtatcggtaaagttggcaacataatgctcaaggaattctttgctgtattcatcaatgatgttacgggctttttcgtcctgaggatccggagcttctatcactaccagttgattgatgcgttcaggatattccagagctgtttttaacgcaataagacctccgaaactgtatccgacaagatgtactttttccagttgaaggtgatctgttaaacctattaaatcggatgacatgttgtcaagatcgtacccatccggaaagcgttcactcataccgtggcttttcagatcgtacatcaccacatggaaatgttttgccagaatgggggcaatattaaaataataaatggacaggttactgaacataccgtggattaagaccacggtttgttcggctcctttattaagttcctgtatatgaacttgtctgttattgacagtgattattggcattcgtagatataattgatgatcatactaaggtcaagattgatcagctggtccagatccatggaagacagccagcctgtaaaatcgatctgatcgccaaaatgcgccttgattttttcagagaaagagacaatctctatgctgtccatttcaagatctttggtgaatgaactttcaggagtaatatccatctcctctacaaattcagcacctatcacttcagtaataaaaccttttaataaagtaaaaagttcttcgtggttcatttttaatgttgcgtttacagtgtccatccgataatataatttttatgtttaatagttttgatttcaatattgttgatccacaggtgatcgtcttttatttcttcgacttcgaaggcttttggatttcctttcagtccggttcctgagaactttccgtaggcttctttagctacccagaaacgggtggtccattctgcctgatcttttccttttaataaggctaattcatggtccgtaaataccagatcatagaatccttcgctgcgttcttccatcagttccatatcaattcctacagattttccatatctcgcaattcccacggcatcttttcctttgtgagccagtgaaatatggatattttctgtaaaatcactgaggaggtaaggtttccccacttcatcggaacggatttcaaatgtgatcgggaagcaggcatgatttttttctttacggagaagatttcttacggcatctttcacggccacacggcttaccatccagtttttctttttgttaggcaatagctgctggtgatgctgtttttccgtctggttgaaatatcttttcaggataaaatcccatgaagcgactcttgtataggcctggtggaagaaaaatacttcaggagcaatctcttccgaaagacggttatgcagcggcgacatggaaacattccataaagcagcgtcaatttccagtcttctgttttgccagcccgtaatggcgcaccatacttttccgtcccttttcaggatgatatctgcgatggcaaattcatcattaagctcggtcagcatacaggtgcactcaaaaataccttcctgatcatgcatatttccgaaaaactcaatatctctgatttttacagggaatgcaatgcggtctttcaccaaagtaagctgcagccaaagcccgaacagctgtcctgcattatcaagcaaagagcctttaccaccgtttccttttatcttcccgataattcctttgtctccaacagctgaaacttctgtaattccctggtatttttctccatggaacatgtgcatgtcatagatttcttcgggtgttctttcgataggtaaaagatttccgatggaaagattgaatgctggtgtcggaacagaacccaattttaaaatgacttctgcgttggcaaagttttcaatatcgagataagcatgattcggtgaacgccattctccttttacggttttttcgaaaggtttggcaacattcatccattggaagacacttacgttcatgattttatggaccagtgttcccggaatttcggcttctgcaatttctgccagctgttcaaagatcatcgtcatcgggattaccggttccatatcggctacatgagcccatccttttggctgtctcaataagctgtggtcgatcaggtacggatgactttccagcgttacgtacaaatcttttgtgaaatttgtacttcttgctggttttggagcggcctgttgtgctacaggagcagcctgagcaggacgtggaattgtaatctccggacggttctggaataaagtcaatacttcttcctgcatacggatcatatcggcaacgttatcctgaaatgcctgtaccagcggatgaccacttttggcagtcatggctgaagctgaggctgtgtattgttttggtgtttcaaaggcttgagctaaggcttttacttctttaaaattacggacaataggagagcccaattccagcttaataccttttcctgctggtttttttgattgctgctgaacttctaagaagtcaatagcaatggttttcccttctacaaataacgaagccactacacgttgtaactgcgctaatgcagaacgggtaggaacgctggaaggaatggtgctgaatgcttttcctttcaaggtatcatcaataaatccgatcagaccgccagttcccacctgaatgaagactcttgcgccttcttcgtataatttatcggtcagttcacggaaacggacaggttctaccaaatgctctgcactcagttttctgatggctgcctgatctgcaggataaggttctaatgtggtagctgaccacaaaggaatttttgtctgctgaaactgtgctttttccattccggcaaggattacatccagtttatctgcgataaaaggagagtggaatcctgactggaaaggcagaatctgatggaaaatctgctttgcttttaacaatggaaccagttcatccaaagcagcattgcttccgcagagaatcacctgattggggcagttgtcattggaaacatacagatttgaaatttcattaataaaaggttttatggcttcaatccctgctcctatggcaataaattttgaatcttttaattcaaaagtttcaggattcagtacatcaattaaagcttttacagaattggcttctgccagctcggacgaatatcctgccagccattctcctaaactgtgccctgcattcatatccggaatgattcccagttttttcaatgaattatcaaggatactgcagttgttgaaaatgtttaaggcatcagttaaaagaccttcaccttctgtttcaataggcgctgttaatccaaaataacggcttaccgtttctacttcacctttcgccagaccgtctaagcctggaaatacaaaggctaccttaccgccatcctttaataatggggtagaagtataccaaatgtcctgtttatttttccagatgatatttttggaaacaattttaatcgccttttctattcttgcaggcgttggatcaaaaattgccaccctaaaatctccttcaccaatagctgtttcattattttgtaatgcggaaagcagttcttcatgcgtgggtcttgccagtatcagtacctgatcttttttaggcatatcataaccttccagaacaacgtgggcattgattcctccaaatccaaaggcatttacagcggcaacttttggtaatccggtttttgaccagtttttagcttcctgtaccggttcaaaccttgtattctgcatctccgaagttggattctcacaatataaggttggcggtaaagtgtcatgatgtaaggcaagacaagttttaattaatcctgcaattccggctgccggcatcgcatgcccgatattggacttcacagatccgatacctgccgccggagcagcttcttcttttccgaagaactgagccaaggtctgaagctctgttttatcgccaagtggtgttcctgtgccatgagcttcaaggtaaccgactttatttttatctaaatcagcattgatccatgcctgttccaacgccttcagctgcccttttacagatgggctcattacgctggttccggtaccgtcactgctgactcccacacctttaatgacagcgtagattttatcctgatcgcgaacagcgtcttccaatcgttttaaaacaacgaaaccacaaccttctccaatcaatagaccatcagcatcactgctgaaaggcttaatctgctgctggcgtgacatggctccaagttgggcaaaaatactccagaaagcagcattctgtcctgtgtggactcctcctgcaatcatgatatcggaacggcctctctgaagttcctgcaccgcatggtctacagcgattaaagcggatgcacaagcggcatctaccgtaaatgctgcacctcccagattgaatcggttggcaacaagagaggcaacaagattgggaattaatcccatcgcagtatctgctgcaaaacggcctttacgttcctgaaacgcatgctttaccttttcaatatcggaagaagaaacgtgaggcagcaattcctgcagtaatgaagaaatctgttcaccggttcttacaatttcgatagcgcgggtagctcccggaccggtatagtttcctttcccgatgataattcctgttttttcaagagaagtattcttttgaaatatgccagcatcttccagtgctttctgtaccagatcaagggtaagcaaatggtcgggttctgttccttcaacggctaatggcaaaataccgaatgctgtgggatcaaacgtataatcagagataaatcctccacgctgacagtaaaaacggtcaacgggactggtggcatcactgaaatgaaccggatctatccggtcagccggagccaactcggtagaatcgactttattgacaatattctgccagaaagtgttggcatcctgtgccccgggaaagacacaggataggccaattacagcaatatctgtttttttcatactttgtttatgcagagttttaccaattatttcctgacatgatcagcacctggctttcagttccgtatttgatctcatttaagaagatttctttcccttcatccaatggaatcatggaaattcctctgcgttcgtattctgattcaagggtggaagagaccattccggcgcctttccatggcccccagttgatggagattacttttccttttaatcttttgtttaaggcattggcataatcatccagtacactgttggcagcagcataatctgtctggcctttgttaccgtatacggaagcaatgcttgagaacaataccacgaactggcagtcttcacgaagctgttctgccagtacacgaagcggttttactttggtatcaaatacacgtccgaaagaacttgtggtcttttgtttgaacagtttatcttctaaaaggccagctccatggatgactccgtccagacggtcgtatttttcatagatattgctgattaatctgcttaaaccttcttcgtcacaaagatccagtgattggtaaatgatggtatttccaagttcttccatatcacggatggtgcggagaatctgattgtttttgaaaattttcgttgtttctttttcaatctctgccggagaagtgaattgtccggatctgatcagaaagcctctgatttcctctttggttttcattccttcaaaatctttcgcagaaatttcatttctcgggtctgcagatcttcctaccagaatgtaagtacacggataagcctgagacatatgttttaccaactcggcggtaattccctgtgctcctccaagtaccaaaaccacagatttctgatctagctgaatgtgggcttcacttaaacttgttgacaatggtgaagggatgatgtctactttgtgtctctggtcatttttataaatgatttcagcaggtttatcattggtaagaatttcctttaaggtaatctcagcaatctgatttacttcctgaggagtgctcaaactgatcagtctgcaggctgtattgtcaaattctcttgccaggctcttgaaaagtcccggataaccctgatgatgacgcaatacgcttacatcagtgatttcctgaagatgagccggaatatctgagatcagataaacccattttgctttatcaaaatccagttttttgatcagatctacatgatcgatgatgcttggtttatctgctgctgagaaaaggtccagcataattaatccctcaatatctgaaaggtctttttcagtatctgccaattctacgatagctccatgtttttccaaagcttctctgattgctgaagaatgcttgctgttatcctgagtgatggcaaaacgttttccctgcaatacttctgtattttgtaccagggaagcatcagtaggtgtaatatcaaaacggagacgtgaaagtacattttgggttggttccacggtatttgtttcttttgcttcctgagtagtttcgttcgattcaccattcatttcgctgatccagcttgccagaccgcgaagtgttttaatagcagccagtttttccatcacatcatccgcctgttcaaggttttgaccaaaaccgattttggttttaagatcaccgatgatttccatacgtttgatggagtcgatactcaaatctgcttccagatcaaggtcaagacctaacatttctttcggatatcctgttttttcacttacgatatttaaaatagcattttgaaggtcttccagagaaaatgccggttgagcttgtggttttgaagctgttgattcagctgcagatctgtttttttcaggagcagcagttgtttcagcccctgagaattcagtaagccatgaaacaagaccgcttaacgtttttatgcctgctaactgctccataacggagtcttcactggtgtttccgttacccagagttcccagttcgttacgaagtgttccgatgatttctactcttttaatagaatctatacttaaatccgcttcaagatccatttccatacccagcatttcctgaggatatcctgttttgtcacttaccacctgcagcagtaaggatttgatatcttttgaaggagcctgtttcacagcaacagctacttcctgttgaatatgctgaaccggaatagcagagactggctgttgagccggagcctgcaccggtgaatgatatacaggagctgggaatgcctgcggattctgtcccataaaggaaagcatcacgtcacgctgtgcctgtatcattaatttcatactgtttaaatattcctgcagcatacgttcggcggtagattgtgcttcagctgccggtgcctgttgatttgtagtaaaattgttcatgggaatagggtttatgagtggtaatgcaccattggaaggcaaattaccatgagttgggtaggcggtttgcccgtttacacgccagatggcagggcttttcttgtaaagcccgggttggttaagatcaataacctttacattgcgtccatcgaaaagtttactgatattgaagcttcggcctgttcctaaatattgcgccagcatgcaaagaagatgactgaatttattatggctgttgtcttcaacatatagggtaagctgatctttttccaggcaggatttggtcagtccggtaagaacttttcccggacctacttcgatgaatattctcgctccatcgttatacattgcctgcagctgttctacaaatcttacaggctgtaccagatgatcggtaagtctttcttttatttcagatggatttgaaggatatacttctgcagtcgtattggaccataccggaatctgcatttcgccgaaaggaacatctttaagtacttcagcatataaatccttggattttgctaataacggactgtggaatgcacaggcaacttcaagttttttagcggaaataccttcctgtttaagaacttccagcaatttattgatcgcatctgtattgccagcaatgacacattgtgtaggggcattaaagttgacaggataacatccttctactttagcaatgatcggttgtaaacgttctgctgtagcacttgccgccagcattgaacctggatctccgccttctacagaatctaagatagactgcgctctcttaacacttaagtccaccagtttatcttctccgaaaactcctgcaaagcataatgccggaatttcaccgtagctgtgacctgccagcatatccgggataatacctaatgattccaggaatttagccaatgcaagatcaacaattcctaaaagcggttgtgctaagcgggtatctttaatggtttctttttgtctttttacatcggcttcattgaatgttttggacgggaaaaccactttttcaagttcaggatattcatcaataatcttacgcatagccgggaagactacgaatagatcacgggccatattgattctctggctgccctgtccaggaaatgtgaaagctactttaccttcttttttatttacagtaaaagtgtctttggtttcaatgcccagcagtaccagttccagcttcatcatcagatcttccacagtgtctgccacgatgctgaactggataggtttttctgaactgatgcttaagctgtaggcaatatcctgtaacggaataccatcattaatttccaataaagcttttacctggccggattgtccttttgcttcttcataggtatctccacggaaaacaaacaattctgaaggccatgactgcattacgattgaatcatcttgtttaggatggttggcaatgaccgtgtggaagtttgttcctccaaatccgaaagcactgattcctgcataacggtttttctctgaccataacccgctttctgcatggaatgcaaacggacttgtttcagcattataataagcgttagggtgctgaagatgtaaggtaggtggctttaccccgtgatatacagcaagggaagctttgattaatcctgctaatcctgcagcacacttggtatgtccgatctgtgtttttaccgaacctaaatgagtctgacccggtaaagcccctgaacggctgaacaagttcgttaatgcactcagttctgttttgtcacctactaccgttcccgtaccgtgtgcttctacaaggcctacggaagccggacttatccctgcctgggaataggcgcgttccaaagctcttacctggcctatttttcttggagcagtaagcccaagtgctttaccatcactggatccgccaacacctttgatcacggaatagatacggtcaccgtcacgtacagcatctacatatctttttaaaacaaggatagcaataccttccccaagggcaataccgtctgcgtcaccgtcaaatgtagcacatcttccttttcgggataaagcatgtgtactggagaacatcagataatcattgattccgttatgtaaatctgctcctcctgcaagaaccatatcagattttcccaatacaagttcctggcaagccagatcaatagctgctaatgacgaagcacaggctgcatctacggtaaagtttctgccgccgagatccagccggtttgtaattctaccggcaattacattggcaagaatacccgggaatgagtcttctgtagtatgcgggaaggcttcttttacttcttcgtgaagttctccgaaaacctgtttataatatcctctgaaactatagctgttggcaaggtcattaccgccttcagcacctatgataacagaaatattttctctgttgatttgtttttcaccatatcctgcgtcttccattgcacgttttgcaaccaataacgtcagcagttgtgttggttcgatggcagccagagattgtggcggaattccgaatgccagcggatcaaaatcaattttaggaataaagcctccccatttggagtgggatacatccggaccatcagaatccgggtggtaatacagttctttattccatctttcatccggcacttcggtaacactgtcttttcctaaaataatatttctccagtattcatccagatttttagcacccgggaagatacattccattcctacgatggcgatgtccaaaggtttctctgtagaaacaggttcttcaggcaatgctgcattctgaacatatttatgattgtctacgatactttggtgaaggtctgccaacgagattacacggttgtgcatcgtagctacctggccaatcatgtacattcctaagtctagttggtcatctttaggaatgctgacaagttgatcgccctggcgttctatacctttagctgcaatacgtaagcggcctacatttaatttttcaagctgttcccatacctcttttttatccattccggctgccagaagtttcgctttttcctggttgaaataatgggcaaatgctgtatttaagcaacgggtttcatgtccgggagctgtttccagtaagactgtatctttcgcctgcatggcctgcaactggaattcttcctggatggctccggtttgtacagcttcatgagtatacagataggctgttcccatcaataccccgatttttactcctcttgccgctaatggcgcggtcatgatggatacaaacgctgttgaaaatgcgttatgaattcctccggcaaaaaagacactgatgtcttccggatgatcctcttttaaaatacgttcaatctgtttttcccaaagaaccgtactggccagtggtcctacgtggcctccgcactcgcgtccttcaaaaatgaaatttttagcaccttctttcaggaaaatatccagaagggcaggagagggaacatgtaaaaatgattttatacctgctttttcaaatattttggcctgggcaggtcttccgcctgcaattaaaaccacaggaggttttgcttctaatatataggaagtctgttcatctctcaattcctgtggggcaaatcctaagattcctacaccccatgttttttcaccagccagttttttggtgtccatgaccagagattttgctgattctccttttagtaaggataaggccacgaaaggtaaggctccggcatcggcaaccgcattagcgaataaaggaacatcacttacacgggtcataggaccttgagcaataggatattgcaaaccaagatcccgggctaaagcgttttctttatcaacgaccttaagcgcctttgcctgcttcaggtgtccgtacatggcttctttaaatccgaaaaccagttttttcagtgttttaaagtcttcatacaggtctgtggccagtgaaatgtcttgtcccatagggatataacatgtattaaggtcgagaccgtaaaagaattttttcagctcttcagcagtagtattttcaggtaaagcgggtgagtggggtcttaccagtacgcgatggttagcaatcaccttagtttctgtaccattcagttttgagcaaacttctttcagatcttttggaactgaactttcaggaaacagggccagctggctgtccagtacaactcctgttgctcccaatgcttttgatgccgctgcggtatggggacctattcctccctgtacccacaccggaatattccggatttcattgatcacacgctggaacaatacaaacgtggattcatatcctaccagtccgcctgcttcatttcctttaataatgattccttctgctcccgattgttcggcctgtatggcttcttccaaactggttacctgataaataagaggcaggttggaaggtgcagacattccgaacggaagaatggcaaatcttactttttcagaaatctgaagggcggaggaaatgtcgttagaaaaataaataccatatgatggtacgtctatctgatcaagttgatgtaacgcttcctgggcagttgtaagctcatctcctaaactcagaacgggaaatgcacccgcctgatgcagtttaagcataaggttaacgtccggtttttcgaaaggcgttagtccaataatggttaattttttcatggcgtgataattattgaatgatagcaagagtttataataaaagtgtcaagccttttggtgataagacctgagctttttattatgatataataaaattgggttttgtcaaatagttaacaatatgtattgtttggtgttgattatttaataatcttccaattgtggacgggttgtaaagtgtgttgttggcgtccggcttttcaacgggcattagcctgattttggtcaagtttttcatagcatcacggtatagaaatagttaatgatatctcatatcgaaaaacggataccatttgtgtttatggtgtttttctattatgagtgaataaaaataataaaactatatatattttttaaacataaatgaaatttgataatgatttcttaataggaaaatatcaattgttcatgtgttattaaaatataattattgtttatttattcttagaaacatgccggtacaatcttctttactttaactataaatatttatagttaaagaaatgttaagcaaatataggaataaaaaataaaatatttcaaaaacaagagatttgtttttggttatattacaaaaagataatatagggtaaatccggtttcggaatgtaaaaattgcctttatcaatctgataaaacggcaaagcgaatttaaataaaattaatcaatatattgtgatttaatttaaattatttatgaatttttcatatctttttgataaataaacagataggtaattttaagaataattaatatatgcttccgaaattcataaaaaaaagtaaatagatagaatcggtatttttatttttaaggttaaagagattgtttattagtgtgttatatatctacggataatatttctgcgatttaaaaaaaaatagttttcattataatttatgatcacggagtattttataaaacttttgtatttttgcactcttaagaactcaatcataatttgatttgatgaattatgatttacatatgcctgtgtttataatagtaagctcgtgttctcttgtttttgcaattatgacaatttaacgagtttctattcctgtccattactcaattcgtattgacttccttttctgaatcggccaatttccggtcgatcttgaataactgcagtcagatttcagagatctgtctttttgggtgcatcatacagaaattgtttttggattaaaaaaatacaacaaaagaaaacaggtatatatgaaacagacaacaattttcagatcagatgctcacaaagaaagagtgctggagcaatatgacactgcgttagcaaattttaaaggaaatatccgccagcaagtggtcccaacaaactttggagaaacccacgttctgagctatggaaatgaagatcatcctaagcttgtattacttcatggagctaattctaacgctgcatcctggatgaaggatcttgctttgtacagcaaagaatataaagtgtacgctattgatattatcggggaaccaggtaaaagtgagcaaaacagacttccttatcaaggtaatgattacagtgattggctgaatgaggttttccaacaactgaaaataacaaaagcttctttggtgggattgtctcaaggcggatggcttgcgataaagtttgcagccagatatccggaaaaaatcagtcagcttgtccttctttctccggcaggagttgtaaaaacaaaacgcagctttgttttaaaagcgatattcttttctctacttgggaatgccgggaagagaaaaatcaataaactgataaccggttcacagaaaatagaccagcctgttcttgactttatggatctcatgcagtcttctgtggaggcaaggatggataaggaatatattttttctgatgaagaattgagaaatattgccatgcctgtcttttttataggtggagcaggtgatgtgatcagggattctacagaaataaaagaaagacttgaaaggttgcttcctgattttgaatcctatattgatcctgacaaagggcatgtgctgattggtttagcagataaaataaatgcgtttttactaaagagaagaaatgattaatccttcatgcaagagctccaaaacattttgttttggagctcttatcttattttatgtacttgaatctttaaaatacgcttaatccgtactgttttgccagatctaaaatcatatggtaacccgccagcgaatttccatgctgatctaaggcaggactgaagactccgattcctatttttccgggaacactcacggtaattccgcctcctacaccggatttacttggcaggcctacagttctggaatattcgccgctgaattcatacatgccagccgtcagcatctgtgattccaccaattttgccatgtcggcatttttataggtggagtctccatcaaatcttacacattggttggcaaagaagtacccgattttcgcaaggtcttctgcagtaagttcaatagaacactgcttgaaatagttatccagctgatcttcgttcccggtaatcagtccgctgtttttcataatataaaacatcccgcggttacggtgtcctgttgatttttcggattcgtaaacagatttgttgtagtctattgaagggtttttggtgatatatcttaccatatcaagtattttcaggaatggtttttcgccttctcctgaaatgagggaagtggtgagaattgctcccgcattcatcataggattaagcggtttgcctgtagtttccaggtttgaaaaatgattgaaaggtttgtcagaaccaaaataccccattttatcaaagatattggtttctcctttttcattgacagctaccattaatgatatgattttggaaatgctttgcatggtaaatttcttatggacgtcaccggtattgaatacttttccatttttgtctaccactgaaaaggctattgctttagcatccatttttcccagttcaggaatataatctgccacttttccctgggtgtaataagctctgtttttctccagaatgttgtttaaggttttttctgaaatggttgagatatctgctgttttctgtgcataaacaattgtgcttaaggaaataaaagctgccgtacagattcctttcgcagaaaataaaaagcggttgtttttcatataggaagatcttcaaataaatggtttatgataagccttaaaaaacaaagataaagtattttaatcttgtcagcaattctcatttgccgtacttacctctaaccggattgaataaggaatcatcacagaaaattcaggtatttctgaagtcattgagaatgtatagtgagggtatggaaagaattaaaaggagatatttttttttatggattttattgtgattagttttaatataaatttaatttttatagtataaaataaacaagtatgaatttttattgttgattttattgtttttagttattggaaattagaattttatttggttttaatgaggggatttaataaaaaatgcatttttttctgcataactaatatcactgtgaaatagcatatagacaggaattattctatatgattgagattcagatgtaaaatattgttattttttcacgattaaatgatttttgtattaaattttttattaatttgataaaaaattaataacactttttttaataactatgaaaaacaacacctattttggtaggcagcacatcttcagatggctcctgctatgttggcttttggtaccctgggtactgcaagcgcaagctcgaattacatggaccgctcaggtcggatgccaggagttccgtggcgaaaaagaaggcccgatccctgataacggtattgcttattcctacatcaattcatcgcaatgtctccgtgtctgtgaggtatccaatgtggtatatgaggttcagggaccaaatgtttccgccgttcaatggacggttgcaggaggaacagtcaccacttcaggacctggtaacactataggcaatgtagcctggggaacggcaggtaacggatctttgcaggctgtcattacgtacagtgacggaactgtagaaactcagacaatctgtattgaaaaaatcaacaggccgattgccaagtttgaaatgttaaatctggatgaagtggtatgcagaaatacaacgatctattttgataacctttctgaccagaacggagggtcggatattgtcaattatttctgggactttggcgatggtacaacttccacagcttttgaaccctcccacttatatgctaaccccggaaattataccattcagcttaccgtaaccaataaatgcggttgccagagtaaatataaaaagcagatcaaggtattgaaagctgatcctgtacagatcaactgtgcttcagtggtttgtgaaggcagtaaagaaacctacagtgctcaggatggatgtagcaaaggacaatggaaagtaatcggaggcacaattgtgggcactaacggtaacgagattgaagtagtctgggatcaggtagacccgcttgaaggattcggatatgtaatgtatatgtcagagtgtgcctgccctgaatggactaccatcaaaattcctgtcgttttaaagaatgcaaaaattaaaggacaggcggtaatatgttccggcaggcagtatacctattcaattcctcagtggcctacaaccaaggttctatggaatgtaacggggcctgcgggaggtcagctgaccaatacccagcaaagaaatgaaattgttttctctgccaatcagccgggtacatatcatcttaccgctaattatttcaatacattgttgtcctgcgaaggacaggcttctattgatattgttgtagaagcaccggtactggtaagcggtggtgtagatgaaatctgtgcaggaacaagccagggattcacggcttcacctaacgtacctgttatctggaaagtaacaaccggtagctctacgtatacttctccggcaatgacaggaatattcaactacaactttgcaacagcaggaacttatacggttacagctaccaaacagggtggaggttgtgaaagcaatgcaagaattatcaaggttctgcctattccccagccacctttaggaacaatatccggagaaacaaaagtatgtccgggaagaccttatgtttataccataagttctgttgactcaggaatggtaccggtttggagtgtaaccaacggaactattcagggaagtaatgccggatcttctgtaacggttatatttaatgcaggagccacgtcatatacggtgtctgctcagaacaaatctatcagtaatgcaggatgtctttcggctccgaaatcatttaatgtgacgaaactggatctcagcacgattgtaattaatcctaactcagggcctttctgtccgagcagcactcagactttcagtgctaatctgaacggaattgttccggattctatggaatggtcatttgcgagttctaacttcggaagtgttgttggcggacagggtacagctaatattactgtaaacttcaacgaaatttcctcaacgagtacgaccgatctgattctgaaagttgtaaaatgcggagtaacgcagacgattactatgccggtatcattaataacacttccggtagtaagttttacaaatgttggcggaatctgtttaggctcaaatcttactttcaccgtaaaccagggaaccattacttcagcaacgaatgtgattttcacttttgctaacggaaatacgtatactacagccttcaacccggccggagtttatagcttcccgaataccggatatatccagaacaattcaggaaacaatgtttcccaaacggttaccgtaacgtatgaaggaaccaacggctgtaactataggcctacagcaagtgctaattttattatctatcctgaaaccattattacaatttctccggtatataatattgcagtttgtgatcctacaacgatggcaccgtatacgcttacggctaacagttctacagggcttacaaatattgtttcctggcaatggtataaagacaatacaattatatcaggtgctacgactaattcatatgttatctttggtgctggtgcttttggaacctacaaggtacgggcagtagatatcaatggttgtgtggtttattcccaaaatgttaatgtaacacagtcttgcccgagcagcggaagctgtacaacggatccacagattaattttgttccggcatggtcagcctgtaataatattaccgtttcaggtttaacttacaatggaatcccggatcagatccaatggttatctgacagtgtacttactttagtttccggtcagggaacagcttctccggtctatcagactaatcttgcaggagcgcatattgtttttgtacgtttaagatacggatcatgctggtacagcaaaggagtagaagtgagaaagcattacgagccgaaattcaatatcagtacagtttgtaacggaagcggatatacggtaacgcttttcaatacctctactatttttgatattaatccggcgtctgttacctataccttcacttcatccggacagcctactcagacaggacaatctgctacatataatctgatgccaggtacctatacctttacaatgacggtatcttcaccgggaaaaccaacgtgtacaactacacagactattacattggctcctgtgcctgatacgacattcctggttcctgcatggttatgtgcgcgctcaccaattacgttcagtccgataacatatgttccaggaaatacctacacatggatttttgatggtacatcctatattacgacaggtccggatgccacaataacttacaatacggcaggaacaaaaacaattcagctgaaaataagaacccctatgggatgtgaatatacttctgctgtaattagtgttaatgtgaaagaggcatcccttgacggtactataacacctccttctcttgtagcctgtatgggaagtgctcctaatatcgtatttaccagtacagttggaactccaagccagtatatctggatgaatggctctcaacctgtaccgggagcgccaaactctccggtgttcacacctgtacagtccggaagctactggccggtgctggtatcatcagacggatgcagaagcaatgttatgagtgctgcagcagtaccggtaacacttaaaaatccaccatatgtcaatatatcaggaacagccaatatctgtgacggatcttcaacagtacttacaggtattgtaacagacaataccctggaatatcaatggaaaaaaggaaactcgatagtaacaccatgggcttcggctccttatcctattgctttaagtacaggaccgttgtcagcaggaacctatgtttatacgctggaagtaagaactccgggtacatcaggatgtacaagcagtaaaagctttactgttactgtaagcagcccgccggcacctatttcggtaagctataatctggttaactgtcagccttatgagattatgctgactgcctcagggccatctgccggagtttataactggagtaacggaatgacaggtcagtcgattaccgtaaatgaaggtggtgcttatcaggtgatctacactgcgccgagcggctgtaaagtggtgggtaatacacaagtgccgctaagccttgaaagtctgatgtgggtattccctacaggatgctataatgaatgtcttagagaggggcgctatatcttaggaccaaaaggcgtttttgatcatcatgaatggcagttgttcggaaacaatatccggagcggaaacaatgattatatctacccgctgtatatcaattatgcaggtacctatcagcttcagattgatcatttaggatgtcagtttacgtcaggaaccatgaactactatccaggtaaagaatgcggattcgaaacagattgtaaactggaagcggatatcaaaggtatgaagtggtttggagatcattataaagtgtatggggtcatctacaataccggaagccagccgataagccttacggtttcaagtcttaatggatttggagtgtatattccatctattattacgattccggcaggaggaatgtatgacatgaatgctaatccattagcattctatccgaactctggtttccagggagctgatgagatcttattctcaaatgatacctgtaagtttactaccaaagcggtagatccggactggatgggtatgagaagtgcaggaagaaatgtagttgcggcttcagtttcttctctgaaaatgatcccgaatcctgcgaaggaaaaagtgaaaatctcgtataatacgggcgatgaaaaattactcgcaaaacaggttacagtttttgatgctatgggcaatatcaaattccgtaaggaactgaaagcggcttccggagaggtagacgtggaagttaccagctggctgcaaggtgtttatatcgttattgtacaaacgggagatacatcattacaaggaaaactaattaaaaattagtagcttataaagcagtgttctcttcggagagcactgttttttatagtatttgataattaaatgaatttttatgatacaattaaaaaacaaattgtggggattacttctgattttgccatcattatcttttagccagacttaccaatggcaatggggaaagcaggcaggaggggtgacaggctctgcagatccgggatttcattatatctttgatgaatccataagggatattgtagtagacaacaacaataatacctattatcttgcaacaatgcgtgaacaggggcaaaacctgaatggaacaccggtaaccaattatggcctcagcgatctttttctgttctccacagactgtacgggaaatataagatggtccagacctataggaggtacgggaaacggagaaaatgcatggcatattaaattggataacaacggaggtttgtacatggcagctacgatttataacaattcatatgcaggagatcccaatgctactccggtacattttgatgatactcatacactgcctctgtatacctattatgatcagacgatagatcctgcccacaaagcagcttttcttttaaaatataatacttcagacggaacattggcatggagtaagcctttacagggagatgtcagttttttctcccgcatgtgcgatgttcagacgatgtatatggattcatccaaaaatatccatgctgtaatgggtttcagagcgggaacgcatttaaacgggttaattacagtaccttctacctttacatccacctaccagtattatgcagttaagttcaattatgacggtggcaacatgacacctgctgctcctgtgcttctccccattaccggagatgccatcaatgctgtgggaagagaagggaaggttaatctcgtgtatgatgaaactctgaaccgttattatcttgccggtaaaagaatggatcccggattcagtaatctggttgatctttcgtataataatgttccgtttacgaaagcggcttatgtgcttgcttttgacggtactaccggagcagaagtatggagaagggaaattaataatggtacaacgagtacggatgatgaaattcattccattataaaagatccggttacatcagatatttatatttcaggacgttattttaacggaataacagtacctgccactttcggaacttatacttttccactgagaagctatgtggaagcggttccttttgttatgaagatcaatgcttcgggtaccgtgcagtgggcaagaactccggatgggatgtccggcctccagttcggttatcgttttactaaaggaacccttgcccttaatggaaatgaaatagcatttgccaaaggaagctggtctgatatatggggcagctatgcaatggtacgtcccgatggagaccgctcagatccattattggtaaggcttaacaaagataccggggatgtcttgggaacgggagagatccgcagtaacttttatgttatcgatgagtttacagcagtagctgcagatcaggatggaaactatgtagcaggtggtttttttcatgatcaattatttacagattccaatgataatgtcaatacaatgactgttaatgtagcaggcgggaaatctcagtctttttttacaaaatttgccaaatcagtgtgcagccagatgtcagtagaagaaactgcggctcaggcaggaatacagttataccctaatcctgttcaggacgtattgacgatcagaagcaaagaaccattggtttcttatgagatctttggtgctgcaggacagctggtgaaacagggagctttgaatatggcgcaggaacagatagtattatcttctcttcagacaggagtatattacataaaacttaaaaccaaatcttctacagtaacggagaaaatactgaagaagtaaaaaaacaaaactgaaaattaataaccttatatattgaacagtgtcttctaaaggacactgtttttttatggatatttttttgattaaaaaaagattgggatgttcgcaattttacaattttttgccttcgggaatgttttgttttgtataaaatttttaaaatgaaaaaattacttaccctgagcggattattactatttactttctggtgtaatgctcaagacaccgatcttatgaaaaccgtaagaaagaccatagaagccagtaacgaaatctatgctgatctggcgaatagaaacgacggatctatccttacgcgctataccagcgatgcatgtctgcttccacccaatgctgtcccgctatgcggaaaagatgcaatacttggtttctttaagaacgggcctaaggttcatgttaagtttacaattcaaaatctttacggagatggcaaaacctcggttaccgaagaaagctattatgaaatgaccgatttggacggtaaaaagctggatgacggaaaagtgattgtgatctggaaaaatacaaaagacggctggaagatgcatcgtgatatgttcagcagcaatcatcctgcaaaataaatcaaaagccgatattaacagcctgctgaagatctgtatcatttttaatcaatgagtgtctggatgcagaaggagtaatacctgtaaattttttaaactctttggtaaaatgagcctgatcgtaatatccgcaatcataagcgatggctgtaagcgattcctgggtgttaagaaccatgtgcagacttctgttaaatctgatcacagccgcaaaagaggaaggactaatcccgatatgagcaaggcaaagcttctgaatatatctttctgacagccctgaactttttgctatagcaggtaaatccaacggttgattacccatgaaaaactgctggctgagtgcctgaactactacagttttctttatccgggattcattttttttcagttgatgaagaaaatacatttccagaacatggatttttgaatagaggtcaccggcctgcatcatacggtcatacaaatctctgctgtcattttttgttatatcgtacatatcagtggcatagttcgtgaattctaccaaaggatcagaaaaaaataattgtccggcatgcggatagatccgtgctataagaactgaagttccctttgctgcactgaggcgggtgggaagggtgagatgtcccagaaattctatatccggagtgtctttttgcctaccatcgatcttggtagcggcaaaaccaccggaaatattgatgatcaggtctgtatatccgctgggataaaacacttcatccctgagatcttcatcaatggtaacaacggtataattctttatgtaaggtgccaggctggatgatggtaaaatttgcatagctgctgtgggtgttaattcattgatgcatagtttattcgaagttaggaataaaaatcatatgaattaaaaatcttggaattaaaataaaaaatccaatatcaaaagatattgggttttttatggtgaaggttttgaaaaacctattccgtatttttgcagagaattaaactgctaaaggttttatttaaaaatatgagcgatacattttccggcaatcctcaaatagaggtggtttcttccttttccgaacttgtgaatacgcgttttcagggagtcagaaatgcaatttgctggcagagaaacctggtcgggaattttaaagaaattgtttctaaacttcagttaaaagagaatattaccgaaatttcttccgatgatcttctgtcactggatctttcagaagaagggaataaggcaagagaaatgattttaaatgacttacgcttattgacagattttggagcttctccggttcttaatttgcttaaaaattatgaaagggatgaggaactcggctttatttcaacagatgtctactcttaccatgtcgatcgttcacctgtcggaaccgatacttttctgtgtacttattacggagctgcaagtgatattatccctaatgatcaggtggtacagaaaattgtaatttctgaaatccgggaacagctcagaaaattacatgatggtccggaagaagaatttgaagacttcctgaaagactatttttttgaccttcattatcagcctgagcccaatgcagaacctgtcaatctgggaaaaggacatctttggagaattgccgtagatcatccggaccagcaggcactgccatgcgttcatagggcgcccgtggaaaatgacggagaatatcggttgctgctgatctgctaatgttgatttgttaagtcagttttgaattagaatttcaagttttgcaaaaaaatccagcatcgaaaaatgccggactttttttataatttataaattgattgtctttaccatttaatttttattttaggaacaacttttctgatctcctttgccacattatttcctgcttttcccagctcattgcttatatttctgaccagttttaccgcttcgtgatttttcccgggaccgtattgtaaatcgtgaactgtggaattccatgttctgacaatatcgtttgtgggtccaaactgatcttttaacgcttctccgatttggttcagccctttaacaattgtattgttttttccaaaacatccatgatcgccgccgactccgctggtcaggcatttacttaattcccggtaggtcaattgtccgccggcgcaaccagcaaatgcataaggctggcctcctgtgcttacagcgcactctactgctatctgtgcttctgtattcagattaagcttgcctgcaccatagcacacagcagttcccataaaagaaacttctccgctattggcctgatctttaaaacaggataccaattgttttaattcagggtcatttactttatcagtaaaacatagcggatacatttcataatgatcaccgtattctttatagcacttcatcatatcctgagtaatctgcttctctttggaaccacctaatatacttagcatacaaaggctttgttcctccggagtgggcgaatttttggcgcatttgtagatttcaagttctttcctgccagccatattcgtcaccatacagtcaccgaattccagctgatttaatgtgccgtcaaagttcagggagttcttgtagcagtctacggcagcttgttcgctcgtcatcataacatctccaaaaggcttttgctcatcaacaatctgtgtggggatcggtcttacgccgtcagcagtttcaatccctgtctgattatcataaattggtttcggcaggtgcataacaggtgggggaggaacaggaatattggaataacccacgacccgatatccatatctgtaatccagttcaattatattcttattaaaatccagaaaaaatgctttttgataaggaacggctgacggcagacataaatagttaattcccgtctggtcatatactgcctgacctgcatttcccggattgccatcctgaacaatcatccctgtgttatacatggtaaaggactgaccatacgttgtcaaaaaaaactggccgataggatatacctgcgcaaacaggaaggaacagaaactcataagtgaaaccagtccgcttataatcaataattttttgatgatagtattcatggtactttcttttttgataaagttaccgctgaagaccaatagctggaaattacccgttttcgctattttttaaataatgatgctgtgtggaaattttgcgaatttatattcttgacattgctttgaattctgtgggcctcatattggtcagctggtggaaattattactgaaagctgcaatattggaatatccgacttcataggtgatttcagtcatattcaggtctgtgtctttgatcagttccatagcccggatgattctcagcatttttatatactgaataaaagtgatgtgaagtttggtctgaaataatcttgtcaggcttctcacactcatccctgattcttttgcccgtattctctaaagtaagcttttcatgtaactgatttctaagacggactgtaacaacattaagccgctgatcatccgttgtgggaagctgaatagaaaactttttaagattttccctcgataagagctccttcaatgtggtcagaaattgaaattcccaggaacctttataataatttccctgccatttttcgctgaaggcaagcatttcagataacagcttactcaccggatagatgcccagttcattataaaaaccgtcagaactttcttcaggaaaataaatgttgatcatatacagatcctgagtattaaacatcaggttatggggatattttagtgataagattaaaaacccgtcagccaatctggaaattttgacagtgatccggaaaaaatatcatactgttttaactggtattttttttgttataccctgaaagccagctttatcagtgagtgtactttactgggcagtgccgttttacagacggtttttcagcttaattgtaagattggtaatacgtaaatataaacagttacagagatatgctttggacagtatgtgttttgtgtatgacaattttaggactgatgtttttactgaaaagacttcatcagccttatcttattgcttatatcatagcagggatactattgggaccttacggagtaaagctctttgaccagcctgaagaaatagaggccgttggtgaggcagggattttattactgatgttttttatcgggatggaaatcaatgttcccaataaaaagagccttattattaagccggtattggctcagggtatcaaaatattgctgagctttatgttcgcttttttacttggatggatccttacacttgattttaagagtattttgctcatcgcaattctctttacctttaacagtacagcagtggttgtggaatttttgaagaaacacgggacactgcatacagcttttggtattgttattctcaatatcctgttgctgcaggatcttctcctggccccggtgctgaccttgcttaagttttggaatggtgaaaagttcaatatgctgaactttgtcattcccctggctatctgtatcggaatttttttaatattcagaaaaataaggcatctgagggaaatcagattttcaagtacgtttcttgaaaatgaccatgatctgcaggtgttttccggtctttttatctgccttgggtttgggcttgttgcagaggttgtaggtttgagtgctgcattgggaagttttattgccggagttgtagtaggaaagatcagggcatttcactggcttgaacattccctgttgcccttcaaggttttcttcgtggcacttttctttgtatccattggtttgaggctggatctcaattatctgttttccaattatacgctcattaccataggtactttagttgtactgatcagcaacagtgtcatgtcatctatatttttcagaatattgaacttcagatggaaagacagtttttatggaggtgcattgctgtcccaaacgggagaatttggaatccttgccctttccattgcttataaaacaggaatggtgggatatgatatttataaggccggactgggaattacctgtttatcacttctgttgtctactatttggatcagttgttctgttaagttccgtagaaataaggctgtctgaaagtaaaggaatgaaatacatgtgagattgtacagatagctctatgccaaaaaactgaaattttgacaggaatgcggaaaaaatatcacactttgccaactggtattttttttgataaatttttcatatacagctggccggctgacgtgtaattaaatgattgttaaacttatttaaaaagaaattgctatgaataatctagtaagaagaaacggaaacagcaacctggctttttcaaacatctttgatgatttttttggtcgtgaactttttaactggggaaataacaattactcttctaccagtacaacagtaccatcagtaaatataaaggaaaacggagaagcatatgaagttcaggttgctgctccgggaatggataagaatgattttcagatcaaactggatggtaacctgctgacgatttcatccatgaaacaggacagcagcgaaacaaaagaagagaattttacaagaagagaattcagttatcagtccttccagagaagttttgaacttccaaaggatgttgtagaccaggataacattaatgcaaaatatgaaaacgggttgcttatgctgaccattcctaaaaaagaggatgcaaagcagaaaccacctagaatgatcgaaatatcgtaaactgaaaatggctgctaaaaggcagtcattttttatttttatacttttttaaatatgtcggtggtatcttgtttaacttgttggttttgattgttttaaatagttgtgctggtccgaaatttgcatttaaagataatacctttttactaagatattgttttgaaatcataacaaataactgagtaatatgatcatcgatgaaaatcttttacttgaaaatggagcagtttatgaggattatcaggcaaaggaaattatttatgagctgggagatattccccattattatttccagattgttaagggaacagttgaattgaataattaccatgaagatgggaaagaattcacactgaatatcatttcagaggggcagagctttggagagtctttactttttgggaacaagaaatacccgatgaatgccattgcaaaaaccgattgcaaaatccttaaactgccaaagtccaattttttgagtatgctgagtgaaaatatggaactgatttttaccatgttccgctacctttcggaccggcttttctataaatatgtaatgctgtttaataattcagccatagacccggtgctgaagataaaatctttaatggattattacaaggaaagcgcactaaaccaaaacccttattcttaccaggtcccgctgaccagacaacaaattgccaatttaacggggttacgtgtcgaaacggtcatacgtaccattaaaaagatggcagaggatgggcttcttaaactggatggacgacagattttttactgaaatcagatgtcagggtgctatgcgaaaataatcacagaacaatcggtttaaaaacagaatgtaacagttcgtaaataacaattgtcttcattataagatgaaagtcctgcagttactcattgtgctgtattattatttctttaaaaaataacctcatgaaagcgtacacagttattctgattctattgaattttttactgataccaccaatacaggcccagcaaacattgtggggccgccagcaggaaaaggagagtatatacagcattcaggatagcgtaatgatccgcacaagggacggagcagaaatttctgcaatggtagtacgcaaaaaaaatgatattattcctctgcctgtaatactgcagtttacaatttatgtgcgggatcaggggcgggatatacaatcgcttaaagaagctgcagacagaggatatataggtgttatggcttatacgagaggaaaacgtttcagtcaatctgagatttttccgtatgaaaccgacggaaaagatgcctatgatgtgatagactggatcagcaggcagccatggtgtaatggtaaaataggaatgtacggaggaagttacaacggctttacgcaatgggccgcagctaaaaaactgcatcccgcattgaaaacgattgttccttatgtagccaatcgcccgggaatgggacttcctatggaaaataatatctttatcaatcctaattatgaatggtccttttatgtaggcaataataaatatctggataataagacaggtgatgaccggaaaagattccggaatatgatgttcagatggtgggaaacaggagccgcttatcgtaaaatggatagcattgatggcacacccaatcgtctttttcagcgttggataagccatcccgcttttgattcctattggcagaatatggctccgtataagaaagaatttgcaggaattaatattcccgtactggcctttgacggatattataatgattctcagaattcaggaatatactatttgcgtgaactcaataaatacagtcctcaaacgccggcttatctgttgattggtccttatggtcatttcggaacacagatgggagggcaggaggtcatcaacggatatacagtgagtaaaaatgctttatttcccatcagcgaatacacctatcaatggtttgattatattctgaaaggagctgaaaagccttcttttctgaaagataaaataaactatcaggtaatgggaacagatgaatggcgaagcgcaccttcaatcgatgccatgcacaacagatatatgaaattgtatttcagctctgaaaaagcgaacgatgatgagtatttgttaagctttaataagcccgaacctcaaaaatatttagttcagaaagtagattttgcagaccgtataaccagtaataatgattattaccctgatcccattattcgggaaagtatatccggtaacggttatgttttcgtaagtgagcctttggatgctatgctggtaaacggatctttccttgggaacatcaaaatgagcattaataaaaaagatgcagatattggagtcactctctatgaacttactcctgaaggtaaatattttcatctttcttactatatcggcagggcaagttatgccagagataatactaaaagacaattactgacccctggtaaaaaagaaaccatcacctttgaaaatactcatctggtcagcaaacagctgcagaaaggtagccgtctggtcgttgtgctgaatatcaataaaaatccgttttcagaactcaattatggtagtggaaaaactgtagcttccgaaaccattgccgatgccaaagaaccattgattattcattggtataatgatagttttgttgagattcctgttttacaatagctgatttaatttcaatcccatttagacatcaacagttatcctgaaattgatatgtttgattagtactacctgaaggaaagtcatgaattcacttattcgaaaaataaatactcttgattgcttttaaattcatatgatcagcatcataatacaaatattattattatgctatatttgtaataataagatcaggagaaataagaaaataagaacaacaaaacctaaactaaattattatccgttctaagaaacttatttttcaataaatggcagaaaaggagcatgttattacctatagaagatgtaccaatgatcaaaaaatagcagttattggtatcattaaaaattattatcacagttctaaagctaataatattgtggtattgccagttaatgcaaactgcattatctaccaatgattatgtcgaatattcccccgcagcgttacgaagatttaaaggagatactgtgttcccaatgtgactatactataacgcctacacgagagtaactatattttctatacctcaaactttaccttattaataccaacctgactttttaaaagtcaggaaaaataaatttggcagctattcagaattgaatatttacgaaataatgttcagcaaccatgacttttatcctttgagaggaaaaactctgagttgcttaaaatttgcacttataattactgccgattttactgagatattcattcgtaagcataacaaaaaaaattaaatagtatgattatcaatgaagatcttttgctcaaaaatggagcagtttatgaagactatcccgcaaaggaaaatatttacgaaataggaggtattccgcattattattttcaggttgttacgggaacagtagaattgaataattaccatgaagatgggaaggagttcacgctgaatattatttcagagggacatagcttcggggaatctttacttttcggggataagaattatccgatgaatgccattgcaaaaaccgattgcagaattcttaaattaccaaaatccaattttttgaatatgctgagtgaaaatatagaactggtttttaccatgttccgttatctttcagaccggcttttctataaatatgtaatgctgtttagtaactccgccatagatcctgtgttgaagataaaatctttattggattattacaaagaaaatgcagcaatgcaatcgccttattcttacggagtcccgcttaccagacaacaaattgccaatttaacaggattacgtgtggaaacggttatacgtaccattaaaaaaatggcagaggagggtattcttaagcttgatggacgaaagatcttgtactgataatttagaaataatgatctttctatacagagatgtagacaccggtattcatattgtttaaaaacataattttgaatagtacaaatgtgctgttttaaaataataaccattaaacttaagccaaatgaatataccgttatttaccactgatcttccaattgcggtgcatcctgaactgaatgtccttacagaccatatgaaagacttttttaaaacagaagtcttcaatataatgaatgagaacacacagcgatatggagattatatagctgtcggtgctcaatacacagcgtatatttttccttttggaaatatagaaaaacttaaatccatctgcaggtattacagcgtgtgggctctgatggacgatcagttttttgacaattctgtcgatctggacaatattcttgcagtgattgaaggttttaaagcagcagtgaatgaacagccggagattgatacattattttacccgattgcccttttttgttcagacacaaactggactaaagaggcgaaaaacatcttcagacttgaaacggttaaatatctgaataatgtattggtgcagcgtaccatagaagtgcagaaaaaagaggcttctcttgaagaatatcttgaatgcagggcatatgatgttgcaatgccggtcatgttttctctattatggtatcttcatgatgatttgccggcatcttcttattacagcggtgtatttgaaaaagcttttaaaatttcaggttttacgataggacttcttcttgatttgtattcctataaggctaaaaagaaggaaattaaagaatatgcacatgctgtaaaaattatccagagacttgaaaactgtgatgaacagaccgcgattgataaggtggtttctttattctatcaatactcatctgaactggaaaaagagtttgatcagctggaagaccaatatcccaatgaagttcgttatttcaggtatatacaatccggctcaatccggtattgtaatgaaaacaggaaaatccgttatctaaaagagcatgaatcagatgaaaatatatctaaagaacgaacgataatgtgatctcttacctctaaacgtaagacaaatgaaaccccctttaaatattgcatttaaagggggttgtgttattgtgattgtaatctgcatgcaatttaaaatgctgcctgctttctgatacagaaagtgtactacttcctgtttatgcggatttacagaaaagtagtatcgcaattcgtaaacagtattggcgagttctcctatcgattctacgtaattttgttaaacgatttttttaagagaattatacaatgttttttctactggaaaatccttacttttgatttttaaagtgggaaacatctgtttttgaatgttttactttatgtttcttttaaagtacatgatattatagagaatggttcttttcgatgaaaaactgtcttttgataccgtgagattagctgtgctccgaatatgaataaaaaagtttggaaatcatatgccattatgaatggacgatacatgattctttctgtactacacagagttggtttcctgttctagaatctatggtacaagagctgtttttaagctattctcagggtgttttaccgagttttaagtctgagttatggtgtgatagtgatgagtgccttaaagtggcttagaatcaaaatgattggctttacctatctgtggtagaaccaatcatttcttatttaagatatttaagttgtaagttattgttttgtcaacacaatatctttaggaaaattcatcggaaagtcattattctgttctacatagacattgtgctggcaaacgtcattataaaagcttggtaaatattcaaaatgcaaagtcatttgggttggagtaaaatcagtaatgattaatgttgctgttttcctacacatatttttaggagagaatgtaagagttttttgtaagccattttttaggtttatccctattcctctaaactctggtgtttgatcatcaaagttagagattctgtctatctccacaaccccactagagttgattatttttcgttctcctaaaatttcatcacgataatatggatgagtatctccaggaatagaagaataagatttaatttttttcaattctaaaaaaagtgttttaccattccaagtacccttccataatccaacatatttatctagttcgttattaatatcttttagataggcattatcaggaatgtcgcttgggcttgtattaagagggtaaatttgtgctttacaggaaattgtaataattgttgaaaataatattaataataattgtttcataattttatatttttggacattgtcttgtttttctacttccgttttcaaggtaaatttctatattggttccatcgctatcaattttaaagagtttaaatccaaccatattcattttatctttcataaattttaaaaactctttctctaatttatccatatcatatataacctcttgacttacatttgttaccttcacagcactactaagataatcaatatattttgtgtttaactcttcaaactgttctgctgtataattaggaagagagacaacatctgtaccatcaaaagccattaaataattaccattactagtcactactgtatatgtaagttcatttaaaggaatttgagacgtacttgttggtgtattattcaaaccattcgcccaaactatccatttattaaattgcaaaatatctcctggagaaaatattggatataaaccatcataatgagtatgttgtattgcaaatgtattagggaaaaacctaacgtcgacttgttttgttccaggcatattttgtaagagttggttttctgttcctgtttgagatgttcccaatctataaccattttcatagctgaaacctgttttcttctgtaattcggttatgttagctttaaatttttcattattagtagatttttttattcttccacaaggtgtattttttgggagtgtgagagtcggggttgtaggagttccatcatttgttccgcttcctaagcctgtagtgggtcctaattcaccaccacctccagtaccgtcatctcctaaagctgtgctagctgtacagactaatgctactacggttaggtgttgggcaggataacctccctgactttgccagttgcaactgccccaagtactttcattagtctggttatggtctcctgtatagcaagagaaatacatatctactgtttgataagaacaagattctacagtccccatactattagaaactactcctccgt

SEQ ID NO: 15 - DNA, 55748 bp, Chryseobacterium sp.
gttttgatttctgttagattgttttgtgctttttgtaattcagttttaagagctaatttgtgtttactttggtctaaacggattgttttggatgttggcctgaattggctgctgttgttgtaggtttattgttctgttgtgagttcattcctgcaggaatagaacaagaccataatggttactaatgtgagtaacctcgcaataaatttgtttttcattatttgtataatatttaaaaaggtttttagttttcttgtcgataaagatataaaaatcatttattggttaataattcaaatatatactttgaaagtgtcaaaacttgacgtgttatattttaaaaaaatatttattgacggacatatataagaatgagacaaataaaaccccttcaaacattatatttaaaggggtttttgtgttattgtgattgtaatctgcatgcattttaaaataccgcctactttccgatacagaaagtcaattgcctttataatgaggcgcttgtgtagtgtcgggggaaagcaagagcaattaactcctcaactctaaataatgtaaacaaaaatacaaattaaactttaacatcaatatagtattgaaaacaacggtgttgtatctcaaaatagtatttgatatattaattaatcctatttaaactaaaactggcaactgcctcttatttgatcatgagaaaattaagagaaacagctgtccagtattctttaaaaaacataatcaaaatttttgcttgtgataaaattacccatgatttacaataatattagtactaatttatttaattgcttatctaaattatttcaagatagagaggtgattcacaaatagaaggagataaagataaatgttcagaattaaacgaagtttataattaaactgtaaaagagtatatattttatttaatgtaaagcgttatccttttataagtaaatcggttaaggtgttctgaggctttttaaaaagtgttttaacttaagatcatataagcaatattttgattaaaatagattattaattatattatttttttttctatattggcaactcaaaacaataacttatgaaaatttttattaaactattaaagaattacgcaagtaatttaaggcttggtaattacttgcaacaccgaaacaagccccttcaatattactctaaccatcaaaaacttaaaaaaccatgaaaaaagcattaagcattttatcaattttatcattttttatttttattatttatgcatgtactaatcaggatgaaaatatagtaaatacaagtcccgaaacaaaggttgttaacgcaaataaaacaatggagacagaaaatatttcacctgaagaactgggacaaatacataacaatatacttaaacaatattacagtttatatggagaaaatgatacagaagatttgcttgagatgaacaaaagacttaacgaaatatctgtagatttatatccttcgaagtttactctgttaagtgatgatgaaatcgcaaccttcacagagttttcctatggcgcaaccaatgtgactggctgggactatagaacgcattctattaatgcactagatgatgcgctaggaaatggtacaattagccaggatttttacgatatgtttaagtcattagtagtggatggaggtacatacgaagaaactttgggtaaattacaagattataaaactgctctttctaaccaaccagcaagcactattaagactactgaaacaaactttatcaatggagctatttcggtatatactagcagtaaagaatattgggcaaatgacccagatctacaaagtagcaatacttcagggaaatattttggaggatgtgatccggaagatcaaattgcaattgccgacacatatggttcgataatggggggactttttggagtagcgacaagtggaggagtgtcttctgtagtatggggagctgttggttcttggggcttctcaaaagctatcagaatgcagatcaaaaaaaataatgggaaatgtgtttaaatgagataaaaaaaaaattagacaaattaaatttcacttattcttgtaaagatagcacattagagataaagcttggattcggtttaattgctgaagtaaaacaaaataatactagtatatcggtttcgggaattctgaccccttggaatccaatttcaggattatttagggtagatattgagaaatcgttggtctacaactctatttcgttgattatattctatattctattatttttaatgatattagatgatttcaaattgaatagctttttgttaatttttgcaagcttaatctgtgtccatcttatcttgtggtatattttatttttagtaaagtactattcttttcgatctcaaatacaacaatggatcataatggaccactaaaattatcaagtttatacataagagactgcttaaaagcagtctcttttcgtttattaaggagaatcaatactgaattcttcttttgatttacgtagtttttcctcattgacttttttcttaaatcccttttatgattcccatcagcttaatctatttatactgattctgtcggtcacttcaatgaatgtatcgtaatctttcatttactctcatattactctgtcttgtaattgcatacttttaagttagcaaggaatggacaaaagatgtattaaaacgttgataaagaaaatcaaattctcttttccactttcctgagaattttgtcggaattttaatttaaaattttcgtaaatttattaggataaaactataccatgaattaaatatggttgttaatcttcaagatcttacttaatgataattgattaaaataattttcttttttataacaagtcacaaagatagttttataccttccaacaaaattgtgggaacccgtagccattataacttcttaaacatgtatagtataaaagctaatgtgctacttacttcatatactgtaggagagttcgaagtcctctgtaaccatcacttttagcctagccatcattccgaacgtgtttcgtacaatgagatcatatatgttctggtcatcatttgtacaaatgaaagcagtaaaaagcttcatttctagatcttgttttgtacgggcgtgtctttatttatgaccgcgctttacgctgcaagtcctcgctttgctgtggccttttctcttcaatcactcacgcaggtctttctatgcattttcctggtgcaaccaccctggagccctatgccaaaaaacttattattcctatttagcaaaggaatatgggatgcaaatttaccctgcatccttatttacgctattgccattccattatatgcccatagaggacttgagcccggcagattgaatagaaagctttaatatcattcttccaaaaaaaggataaaaaggcagccaagttacatcagccatcctgtgtagtattcccccaagagaaaaatgaatgaacggttccccccgaagggtccccccattaaatcatttttctcttggtctacccggctgtccgatgagttggtctgctttctttttttcctttttcttttgaaagaatcatatcggggaggccccggaaaggactggaagaacataacaacagtaaaactctaaaaacagaacgttatgaacattacagcaaaaattacaaaaaatgccgtggtcagaaccaccactagcggtaaagagctcgttagctttggtattggcatccgccacacctacaaaaacaaacaaggcgaaaaaatctcaatggatacctatcttgactgtgcctattggagaacaacgaacatagccccataccttaaaaaggaaaaatcgtagagctgtcgggaagaatcagcgccagtgcatgggtagaccgtgaaggaaaccttaaggcaggcttaaattttcatgtttcggaaattatttttcatggacaggataacaaacaggacaaagctacaaaaggtcacgagcctgtaaaaatgctttcgagagctttggaaacagcacaggaaaataacgatgatctccctttttaacccttaaccctcaaaatttaacatcatggcaaggtacccaatacatatagcagatgccagtgtttatgttggcacatacacgaaatacaacgaaggctcacttttcggaaaatggcttaacctcaatgattttaccagtaggggggaattttacgaggcatgcgcccaggtacaccgggacgaagaagatgccgagtatatgtttcaggactacgaaaatatccccgaaaacctgatcgatgaatcatggatcagtgagaatgtttttgaagtgctccacgagctttcccttttgtcggaaaatgatctcgaagcattcctcttatggtgtgataacgaccacatcgatttatccaaggaaaatattattgacctgattactgattttcgggatcactatataggtacctacgactgcgaggaagattttgcttttgagcttgtcgaggagcgcgaagatctcagcgattttgcaaagcagtatttcgactacagagcctacgcaaacgaccttttttgcagtgactattggtatcgggacggacacgttttctacaactgatccataagcacgggcgactgtgggagcagtcgcccttaaaaaaataacatcatgacacagacagaactaaaagataaattcagggatttactaagcctaaaccctccattaaaagagatggaagaactttttttcaaggccgttaaaagcggtgccttagattataagaatgaagatccgcacacttatcgcactgcaaaggtcatttaccatgtaatacattctacaatggccgaatcatggaaaccgctatccgaaagtaatcgtcaagaagtcgaaaaccttaaagcattcttgtagtcatggcaatttcgtgtaacaatacggctgttcgagtgaaacaaaaatttattaaaaatgaaaatcacggatttaaacggtttggagattacagtgacaaacctggataaagccatcaggcaggcggagttttttaaggacttgcaccatgtcccgcctgcagcttccgataaacaaaggcagatgtactggaatgacatctacaataaacttttggaactaaaatcaaaaatatcatgagcaatctggcagataaaacagaatatcaggctttaaaaatcatcgcccgaatggttaaggattttgaacgtttgcattgcctgaatatgacggcatcggacgattgggatgccacaaaagcaaggaatcttttgcaaggtcagagcaacggctatcaaattaattacggccgtaggggcagggttaccatatcctgttccgtgaaaatgacaaacaataacacgtccctaattttataatcatggacaattacaaaaagttcacagactaccttttcgaccagtttgtaacactggaaagatgcattggtaaaagcaggtcacacgactacctgcctatttttttcaattatattgaaaaaggattctattacaggaattcaaaaaaagcaaagcgatatgcccagatcgtattttccagtatatcctacgctgttctaaattggaaaacacatcttctcgacctgaaaaatgaccccaaagatgcccaaaagaattttacggcctatctcaagaggttggaagtattgcagtattcccccgaccagatcgccaacatgctgatcgaacgctataggctcaatcatcccacggatattttagaccctgaaaaccccctttaaaataagcgattatggaagcaaatttccatgatattgaaaggttcagaatcctcctcatacccctggggtaggcagagcgttcccaatgcaagggaacgcttttacctgttattctttcatgcatttcaggtgccccctgatagagcgatcgaattttttactgtttatgggtaaaaggaaaaacgggctgccaaaagctgatgacttttggcagcggctcgagatgtagcgaagggactagctgataccttcttccaaaccctcatctttttcttcaagtaagagatcatctaaatgctcagcaaaattcatctttttgagtatttgatacaaagcctcctgatcatctgtattctccacgcccttgcttaggtagttggccataaaatcttcgaaaaactgatgaaacaagcggacaaaagtttgcgcctcctgggcaagtgtagaatctgtactatagatcagattttgtaatgcaagataaaagcgatagagcaggattacgtttttcgaacgaaagccgtattcataaagtgctttcatagatccagtgatatgcataaaacttttttggatcgactgtacgatggcttctataataccttccttgccattgatgatctgtccaacaccgtcccaatcataaagttcataatatttcatctgaaggaaagactttttatttggcctgataaataaatgcgggtccgaggcaatctggcatataagctccagatgaatctcgaaaggtgatccctcatgctgttccgggtcctgagaaatcctttcaattggatagccggcgaactgggaaagaatggaataggcattataatcggcaagaaaggatgattctgctggatcgaaatctgaatcaaaaataatatttaagtgtccgatatcttccatatgcagctgtgcttccgttccttttttaatggtctccgttctgggctttatggcccgcaatccgctcagaagggaggtaaatagaaccggatccttttgtgaaagcccgataagaacggccgctcctacaatatcccactggggagcagcttcgactaaacggagaaaataacgggtcatctctgacctgtccattccctgggattttttggcgaaaactgccaggattggacgtatgcaatgataagcaaccagttccggaagtttcggataaatgattgtttgatctgtttgcggtagatcacggatcaatatcagggaactctggatgagttcctggtaatcatcctgatattttgttttaaaagttgtggttagaacggctccgcttccaatggcagcgatacttagccttggtacggttctacgggtttccagttcctcaacgaaacagttcgcaattttttcgtaaagctggtggacacgttttgaaaatatcccgttccgggcaatatcctgtaacagttcaaagtcggggacagcgacgattttgataacttcattggccttaagtcccgaactatcccggcctgtgagcagatatcttaaaattcttggctcccgatattcttcggtaaaatacccccctcgctcaatggttaccttgaaactacggaacatgatttccctagcctggtgatattcttcgtcatcaaaatcattgagttttaaaacggtacttttatggcctaatgctgtctggtgaattctatggggtacctccgagatctgcttgtaattgaattcgtctatgctgtacaatatccgatgctgactgccctcaaaaagattgatcagttccagaatttcttccataattccttctgaaatatttttattgaaattatccagtaacaggtagaatttaccagaactttcatcaaaaagtgaagtggatagccagttcctgacttgttccggattgaccgaatttttggcgcatgaggtaaatgaatttgccaattgcctgaatatagacatattcagttcattacaatcaatataatacacaaagctgttttcagaagttactttttgataaaactgatacagtagggttgtctttcccgagaacgcagcacccttaactcctacaagtgtctgtcccgtagagaaaatatcgtctatttccttaagaatactacgctcgacctgaaagtcatcgcagatcatggcggttgggtcagaaatattgcctctatgggatgcaaatttttcaccgctcataccattgatgagccctgcaaatagtgcagggtctctattgagaagaagatcgacagcatcccgtaaatcttttgtggcaatttcaaaagcattgccaatacactcctgaataaaatcccagtcaatctgctgccggtcaatcttttctttggtgaaagtatcgtaaaagacgttgtcctttccattggaaatcaaagtaataggtggcatctggtccagcagccttgcataagaaatgccctgatcccggtcagcatcactgagctgcacattttcattttttaactcgagcataataacgttctggttccctattgtgaaaagtatatcggaaatcgcacgtactgaatttctattgggggttttcgctttaacaacaatgctgtggtgtcccacttttaccgaaaaagatttttggtggaccaaacctactttgtgaaatgtcgggaaaacctgactcatgattttactgatcatggcctctaaggtggcctcgtttactttggcgttgctcatggttttgaatagttattagttaaaatatagcataaggggtacccctccttcacaagataggaaataaaaacaaatgtaatattgtttttagaggaatttttattgtattgggagggtcttcgtgtaactttagctttaaatattgctgtggattttgtaaatttatagtaataaccaaaaaactaattttatgaaaacgagttctttacactatatgaaaattgtaattttgctctgctttgtggtttcatgtaaatgcccgatgctgcctgctccagcaatcaaagtcagccatacgaatgtctacgatggtacaagcctccagttacttgttccccatctcaaaaatgcagaagtttattgggaggggcccactgaaatacaagaaggagaaacttggcagatggattctgtaaacaaaatgatgtccggaaaatatagtgtatggtatagaagtactaagagaaaacgatgttattcagcagaagccgtttacaatctaaagattgattctttttccgggtttcccaaacctgaaattatccagtatcagaatagcctgatcagtgaaggaaatagtattgtattgagtgtgcaggatattaaagatgcaaacgttcattggaaaactcccaaaaacgactttactggaaatccactgattataagaaattcaacggtactggattccggactgtactctgtaaactatgtccataattttattcccaatgtgtcatcggagtcttccactaaaactattttcatatatcaaagacaatttgtaacctcttataaagataagaaatattttctcgattttgctttctttgataaatccatacagatctggttaagagaggatcagctgaagaatgatatagtgaaagataaaatgcttgccgaaataaacttcggaacaacaactcgtaaggatttttcggaattcttctgcgaacatgttggttatctagaaaaaagtaaatttctggccggttgtgcagtaactgctggagcctctgggtgtctgttaggagcaggtgaaggattaccattagttccttcctgtgttgtactacttaaattacttgagccagcaggtgccgcatgtcttgaaggagtactgggtgaagtgacaaaagtattgggtattcccgcagcagcagatatgggagggcttggcgccgcaattgctaaggaggaatttgcagatgcgattacaggtttacttaaaatggccctttgtaaaactgcaggtaaggagctggtctttaatcttgacggaagcgttatattaaagccaaaagctctatctgcttcgggtaaacctacgacaaattcttcaggatcacaggattggccaggtggacatgatggatctcaggggcagggaggaaaaggttcaaatagtggtgagaccggaggcggaaaaccgaacagcggaaatggcggtggcgataaacccaatagtagaaatggtggaccaaaaggagatggtggcctaggaccgatgccttttcaaaaaagcagtaaaaaacagcaaaagtaatttctcaacgatgtaaaattgtataagaatgtatctgcctggggttaagtgaaaagcctgctagaaagcagttttttttgctttattaatgtcaggatggtatgctatagttaaaatggagtgttgaataaccataaatacaatctgctccagtcgtagtaccgcattaatagtgcaaatatttatatttttttatgtcaaaattgtatcaccttttgaaagttttgaataagggggggatattatattttttttattttcgccccacaagtataataaccagtaatttttttaacgtgaacttctttgcagtcagctccatattttataaaaaacatctttataaagtccctctaaagaatttattctatttgctataacatgcgtgttaaaagttactttggaaacgacgtgtataataaatctctacaatttttagtgaaataatcaaagaaaatctaataatcaatgaaaaaattctatatcagtgcattaaccttgtgcgctgttgtggtgacttccgctcaggaagtcgtatggcagaaagatatcaaatcctctacacaggattttctaagccagattaatccgactatcgacgggcaatatcttatcacaggaagctctatacaagctaaaagccattcgcaagcggctaatagtcagaagcaaaataacggttacgattttcatcttatcaaactcaatcagcaaggtgaagaggtttgggaaaaatacttctcaggatcaaaccatgattatctgtctgcaagcgttactacacaggatggtggaagtttactagcagggacttcatattccgggaaaggtctggataagaaagaggactctaaaggaggatccgatatctggctgatccgtatcaatgaatttggtgatgaattatggcagaaaaccttgggcagtacttcagatgaagaagccagagcagttatccagactacggatcttggattttttgttgccggaaatatacagaatgcctcaaaaggatttggttccaaagatgttttgattacccgactggataaagatggaaaagagttgtcccaattagtcttaggaggaaaagggctggatgaagtagagaaaatgattccaacgagagacggaggagcactaattggaatttactccagaagttcagttggaggatcaaagaaagccgaaaactttggtgagggcgactattggatcatcaagctggataaaaacggtaaagttgaatgggagaaaaattttggaggaaaaggagatgatcatttgagaaccctggccttaacttcaaatggtttcattatcggtggagaatccagatctgaaagatcgggaaataaaacagcaggccttgaagaaggatcagacgtatggctgatatcattaaatgaaagaggtgaagagcagtggcagaaatcttacaattttgggaatcgtgatattctgatgagtatgagtgttcttcattcggcagatgataaatcctcgaaaggaatcttattaggtggctatacccaggcagaaggaagagtagagactgatgatgaaactttctggatgttatatcttgaccataatggcactgagcagtggagaaagcatgtaaaaggtgaatccaaaaagaaggaagaaaggctttcagacctgaggctcaacaaagatggttctattgttctggccggaaccagtgcagaagaattgggtaaagagaattggaagattgtaaagcttggagacaaacaggttgatcagctgattgaaaaatacgatatcaagatctatccaaatcctgtttctgattatgcttacgtagaaatcggctatgacttcaaagaggctgatattattttgtatgatatgagtggaagacagcttcagagtattaaaaccaagaacagagtgaccaagatcaatacccaggctttggtacagggggcgtatctggtgaccataaaaactgaatcgaataaaacagcgaatgcaaagctgattaaaaaataaaaaacaataattcatgaacattaaactcaaacaccttcttgttgcattttactttatgcaatcaggtgtttcttatgcacaaagtgagcttttatataccaatcttttttctcagagtcccgtttctaaaagctttggtttccagggactttatccagtaaatttatacagaggactccctgatatttctgttccgatctttgagaaaaaagttagcaatactaattttaacatttcgctcaactatgatgttagtacggttaaacccgaagcagtacacagttgggttggattaggatggagtaccaatgttggaggggcaattacaagagtcgttaacgggcagtatgatgaactttacacaagtcatcttaacgaacatgacaaactttcctatctcgatcattacaatacattggataaaccggactgggattctcaggcctcattatctgctttttattacgatgcggaaaactcactacgatttacaagtttttataattactcaatgcagagtggaaatacgaacactcttaacttcggaggagggttagataattatacggataaatggatgctgatccccgatccggacgaatttatattaaatgtattgggtattaatggacgattttacatgaatgagaagggaaaatggatcggaagaactcgtgatggaaaaacattttcaatacagcatgtctataaagaaaatcacacaataaaacccaacagttatatcagttataatctgagaaggattttatatggttttacagtcacgatggatgatggtacccaatatatttttggacaggatgataatgccgtagaatttactgaagaaagacctccttgtgccaattgtaattttaatgaacagattgtagcaagttcctggttaatcaatgaggttaaatttccagatggcaaaaaaataaaatacacttacgaaagagctccaaagcctaactatattgcaagtcaggtaggttatgatattgtgttaaaagcacccaatattgaccttttcgaatcctatggttcaacagctttaaactggcagtataatacttatctgaaaaaagtggaaagtgatgaattttccgttgaaattaatacatcacaagtaaagccattaaattatcaggttttgaacgagcaattaagaggccaaatgggttcttatctgggctcaggagatagttcgcttctctttaacacctggtttaaaattgatagtatcattgtaaaggataaggataaccataccgttaacaccacaacatttcattataatagtgttgatacaaccaagcgaatgcatttggaagcagtgataaagaataacgaagaaaaatactcatttgattataatcctaagacgcttcccctataccttgattccaaatatgataaatggggatactatgctccatcaacccatagtactccggatcttgaatatacaaaagctgagactttagaatggataaaccatcctacgggaggagttacccatttcatctatgagctcaatgatttttccaagtatggaaataaaaaccctttctatacatctgcgaatacccttgagctgattgacaccgtttctcctaatgaaatagcgggtggcttaagaatcaagaggatcgaggcttgttcagaacatagtacaggatgtgtaatcaagaactattcctacaatggtgataacggaaaatccagcggtattttaccttatcagttcaactttaccagagctggagaagtccaagatatgtataagtttagtcataaatcaagcagctcatatcaatccttaaaaggggagaataacatgattgggtatagtaaagtaaccgtaacagataccaataatggtaaaactgaaaactattttaccaattttgacacccctaattgtaatgatcagagagggcctataattatgggaccgcctgatcaatttaccggactgtataaaagtgttcctttcacatctttttctcttatgagaggaaaacctcttaaagaaattacatcctctgctagtggagtggtgcagacgaaagaatatgaatatggatataacaatcatctgataaaagcatatggtctggtagaggaaaatattcattatatgttgaacctactaacagttaccgcttataacgtcaattttaatagcagcttccttaaaggaattaaaaccactttaaacggagtagaaacaaaggaatcatatgattatgaatataactataatactctgaagtctcagaaaattatagattcgaacggtgatgagtttcaaacgaactttacgtatgcttttgataagccaaataactttttagtaggaaaatatatggtgggttttccacttaaatctgaggaaatgaaaaacggaaaagtagtttctaaaacagaaacgttgtacccgttaagccaaacagaggctgataataagacttccggtttgccattacctacttctcaagtttcttaccagttgcaaagcaactctccagtcactgaagctacatatgacaagtttgacagtaaaggcaatctacttcagtacacaacaaaaaatggggtttctacatcgattatctggggatataagaataatacccttcccattgtgaaaatccagggagccaagctatccgatatacctcaagcgtatgttgatcagattatcaatgcttctaaaatagatgctcagcaggcgacagatgcatctgaacaagattttgttaatgcgttggaccaatttaaaaaccgtcctgaattggcaggatatcttattaccacttacagttatgatcctctaattggtgtgaaaagcatcggacaaccctcaggaattagagagttttataagtacaatgcagcgaatgaactggaaagaatcgtggatcaatccggtaatattgttaaagagtttgcttataaatataatatcaagaaattctataacagcgaaagaagccaaacctataccaaaaataactgtaactcgttacaggttggaggtacctacacatatatagtacctgctaataagtacgtatcattgatcagcagcacagatgctgaacaacaggcagccaatgatcttgcagcgaatgggcagaatgctgcgaataccaacgcacaatgttataatgcccaatgctatgcaagttcaataaatggattccaagttggacctcatgcagaaatttctcaaaacgttttaggacactttaaggtagatatacaggtcaaagtacctaactcactaaccaatccagatggcagccaatggtggcaaaaaggagttgctaacatcccgaatccatgtcgtcctaatacaaatttagcacctgatatattcaataataatgttaaagagcttacaacaaatacctggtggaaagtacagatcacttctgcgggtgaccttatattcattcctaatggttacgtggctcctggcactcagctgtattttgtttttgagtacgataaagttccaaactaatatggtgatgaatcataaaaaagcgtatttacaagtaaaaacttataacctagaatttgtcatttaatgaaaagaatatatacaatagccatactagtatggaccgttatagaggctcaagggcagacgcaacttccttcaggccttactggtacgattgacgaaaattatgtctacacaagaacgtaccttgaacctaaaactcaaagtgatagcaatgctaagcaaatacaggctattcaatattttgacggattaggaagggctaaacaaacgattaatataaagggctcaccaaagggcagagatattgtgactccttttacatacgactattatggaaagccaatacgggattatcttccggtaccacagtcaggcacacaaaacggaaaaatatactcacaaaattccctggcagttgattttccggttggagatccggaaggaatatatacaggagaaaggccttttatggaaaaagtgcttgaaaaatctccattggacagagttatacaacaaattcaggtaggtaatgactgggccagcaaacctgtaacctttaaatatgaaacaaataaaaatggtgagctgaaaaaatatacggctacctttagttacacctctttagtagcgaaacttatattgtcaggttcttacggaccaggtcagctttttaagaatacaactaccgatgaagacggaaaccaaactattgaatttaaaaatagtcagggccagattgtattggtaagaaaagtaatcagtgctacagaaaatgcagatacctattatgtttacaatgattataatcaactggcttttgtgattcctccaaaagctgccatacaaccagatgctaatactgtactaaacgagctatgttatcagtataaatatgatgaaagaaaccggttggttgaaaagaagctgccaggaaaagggtgggaatatatggtgtataataatgctgatcaacttattcttacccaggataccgttcttaaagataaaggacaatggctatttactaaatatgatcaatttggaaggatcgcttacacaggaatcacaaataatgctgccagtagggtttcaatgcaaaacagtgctaataacaatactaatttatatgaaaccagaacttccacaaccggctttaccttaaatggattacctgtgtattataccaagctatccactcctaccgctcttagcatactgttgagtgtaaattattatgacagctatcctacatatagtttcaaccctgctttgccagtaaatacaccagatatgaccgtgttaacgggaactcctactgctgatggaaaaagtactaaaggacttccggtcatgagttttgtaaaaaatattgaagatgataattggaccaagaattatacctactatgatcaaaagggaagagtaatcgggagccactctatcaaccatttaggcggatacacaaggattgaatctgagctggattttaccggaatgccccaaaaaacggttactactcacaagagattagcaggggaaccaggagttactattacagaacactttgaatatgataatcagtacagattactggttcataagcatcaggtagatgataaaccggagcagattcttacagaaaacagctataatgaactttcccagctaaataacaaaaaggtagggaataatttgcagagtattgattatacttacaatataagaggttggctgactggtattaataaagcgcaaatggcaattcctgatttaggaggaaaattattttcctacatagtcaagtacaatcagataaatggaattgaaaatcccgattctgcactattcaatggaaaaaatgtgaagccaaggtataatggaaacattgcggaagtagactggagagctgtggagtcattaggagctaaccctccaattgcacctaaaagatacggttatgtttatgatgctttgaacagacttacagcaggatattaccaaaatcctgtgaacccttacagtaaagaacatacagaatccctggcatatgatctgaatggaaatattgcaaacctttacagaacctctgctatagaaggaaataatacaaccgccacagttattgacgagctggaatatacttatgggtccaataaccttaccaatcaggcatctgtgattaaagactacaagaataatccttcaggatatgaaggcggaggtggtaatatccagtatgaccttaatggaaatatgtggcagatgccggataaaaatataaccaagattacatataatcatctgaatcttcccaataagattgagtatggaaacttagggctctctggccttcataattacctgtacagcgcagacggagttcggcttcagaaaaagcttcctaaaattgaatgcgggattatcaattgttatactgtaactgagattactgattatcttgatggatttcaatattatcgcaacgaatcagacaataatgggggaggcggtatcgaagaactcagcatgatcaccgacaaattaaaatatgcatacgaacaacaggcttacagtactgaaagtggaattacaatggcacaggcagctccattaggaataactactgttaagactcctcaactcatgttctttcccacagcagaaggtttttatgattacgggaaagatcagtatatttaccaatataaagatcatttgggaaatgccaggataagttatgcaagaaacagcgcaggttctcttgaaattacagatgctaatgattattacccttttggaatgaaccacttaaaaacaggaaatgctttcttcggatctggaagttataagaattacaaatataatggtaaagagcttcaggagacggggatgtacgattatggtgcaaggttttatatggcagatatcggacgttggggagtattagataattacagtgagaattattttcctatttccccttatagttatgtagcaaataatccaactaaatttattgatataaatggtgagtggatatatattaatgatcaaaatggaacccaatacagatatcataatggtgcaacacaacatcaagtagatggtaaatggaccaatgtagatgcaagtactcaattatcagattatgttgttcagactatagcaggattaaatcatttagacaaaaatacttcaataggaaaaacaatgattggatattttgatcaggcacaaggcaaagatggaaaaataagagatatttattttaattctacgagtgatgtttcacatataaaatatggtatcagcaatataattgaattaaacccatcagacaaaggagtttggactactttgggtaatgactctaaatatacccctttatacaccacaatagcacatgaaatggggcatatttacgaaaactatgctttaggaataacctctcaatccgatacaagatttggacctaacagtaccacagcggaaatatatggtacgcacgttgaaaatattgtaagagcagagtcgggtctaccattgcgaacccattatggtagtacttgtggaggttctacttgtattcctaatgatgatgggaggttgatagacaacgcaggaagtagtatttattataataaaagtggaggtcaaatatctcctactcctagtgttgaaagtattcttaagataaacggcaaaatattgcaaaaccgatataattatattggaactgccggatattataaattgcaaaaattcaaaaatcgccccagataaactataaacttttgaaaatgaaaaattttttattattatttagtattatgttattttcttcttgtaactcccaaggaaagataactatgagacaaatgaatgaaaacttactaaaagataaaaattctattacctatcgtgatcccaagacaataaaaatgcttacagatgcatataaggtttttagattgttaggtgtaaagtcttgcgatatagatcctgacaaaaaatattctcagatttatatagaagacggtttccacgatgaagaaggtttttacaatgggatttttataataaataataaaaatatttgtgaggttaccacaagtccttataaattacatcaagacagtgtttcctatactaaagtcaaggaaaaagatatttcatatggtgaaatggttttctacactaaaaaactttctatcgaagattttaagaataaatatcctgatgaatatttcaggtacgaattggttaggcaaaataaagtcaatgcttttgaaaagtgtttagaaattgatcaatataccccaaaatcaattgtttatgcgcgaagccattactttacaggaggaaaaatgcaaacttatcatttgccaataaagtatagtgatattaaaaatggtatagaagaattgccttattttaaggaaagtaagaagaaggaatttacagagtgtatcaatgaattgaatatattaaaaatacacaattcgtcgattaaaacttcatcttttcaatgatttaaaaactgtaaacggaaaagttacattgattgaactatttcgaattaaataaggtgaaaaaatcagtaattagagaaggatgcctgcaggcatcctttcttttttttatatttcagatttcggtaggagattatttattaaaaacagtaatctcaaaatcttgatatgttcaaggaattagtaaggtaaatcagcttttcttttcgactggaacctcacgcgactgtggtaagttcaggaaccaattcatacgctggtaataatctgcgttttcatttgccatgttgtgttcaaacattaaaattttatcatcactgctttatctgataaatgatataatatgtcaatcaaaatgtataagataatactgctcaatgctctaaacttagcttaactttaatatttaccttttaaataataatacaagtgaaagatttgttttataaagccattacgtaacggagggataatactgccggcaataaactcaaggtcagaacgatgacattagaagaatattaggtagttgtgttacaccaaatgacaaaacgttttgttcaggatttaaagttaagagtcaaataattgcgaaacggcaataaccgatataaaaatgccccgaagatagtcgaggcgctaaatgttttcacaacggaataatccttattgtgaattgctttcaaaattattagcacaaatataaactaaaaattaaataaatagcttacgggtatccgtaatttgaatatttttttatttctatttttatatgatatcaaaaaaattaataacgatgactaaaaatatacttggagtagatttgggagtttcatcaattggctgggcgtacgttcaggaggatcccgaaaatttggaaaacagtaaaattatcaaattaggagttcgtattacaacctttgacaattttgtaagcactaaaacaggaaaagaatctaaagaacctgaaaaggattttaaaggaggaaaagggatttctccaaatgcaggaagaactttagccagaagtgcgagaagaaatcttcaaagatttaagttaagaagagccaatcttattgatgttttaaagaagaataatattcttaaagaatctgacttacttgccgaagttggcaaaaattcaacatttcaaactcataaattaagagctaaggcagtaaaagaaaaaatagaacttgcagaacttgccagagttttgcttcttatcaataaaaaaagaggatacaaaagcagccgtaaagctaaaaatgtagaggatggacaggttgtagatggaatggctgttgctaaaaaattgtacgaagagaatttaacacccggagaatactcatatcaacttttacagcagggcaaaaagcaattgcctgatttttaccgttcagatttacaagcagaatttgataaaatttgggagtttcaaaaacaatttcatcctgatatttttactcaggagctgtacaaagatttgcagggaaaaaataaaaacgctacctgggcaattttgcaagagcctctttctcttgtaggcatcaagcaaataggaacagttcaggaaaaaaaggtcgaaaaatgcttttggagaagtgaagccgtaaaaagacaattggattttgaaagtctggctattgtatttcaggaaattaacagcaatctgaataattcaagcggttatttaggagcgattagtgatcgaagtaaagagctttattttcataatcaaacggtcggagaatgtttatttcagcagttgaaagccaatcctcattctaagctcaaaaatcaggttttctacagacaggattacttagatgaatttgagaagatatggaaaactcaatcggcacattataaagaattaacgaaggaattaaaggaagaaatccgggatattgtcattttttatcagagaaagctcaaatcacagaagggtttaatcagcatctgtgagtttgaaaacagagaaattgaagttacggataaaggaaaaacaaaaaagaaaacagttgggctaaaagtggcaccgaaatcatctcctttgtttcaggagtttaaaatttggcaaagattaaatgatttagaatttacaagtctagaaacaaaagaaaaatttcctttagaattagaacatagggaaattctatttcagaatttaaatataaaaggaaatttatcttcaaaagaattaatagaactgctgggatatccttcaaaagattggaagtgtaatttcaaagaacttgatggaaataaaactagtgaaaatttatatactgcttttctaaagattattgccagtgaaggaatagaattcccaaaagaatttaaattaaccattgatgatgaaattaaggtttctaaaataaatgcttctgcagagatcataaagttatttattagagagaagctgtcagaaatggaagttaatacatctattctggattttaatccggaattggaaggaaatgatttcgagaaacaggcttcttatcaactgtggcatttgctgtattcttatgaaggtgatgattctccttccggaaatgaaaaattgtatgatttgctggaaaagaaatttggattcacaaaagaacattccaaacaattagccgagattggtttttcccaggattatggaagccttagttctaaggcaatgcgaaagatctatccttacattaaagaacataaatacagcatagcctgtaattatgcaggttacaatcactctaaaaattctttgaccaaagagcaattggagaaccggattttgaaagaacaattggatatacttcccaaaaactctttacgaaatcctgtcgttgaaaagattttgaatcaaatgatcaatcttgtgaatgaagtttctaaggaatacggaaaacctgatgaaataagaattgaattagcgcgagaactcaaacttaatgcggaagaacgcgctactatgacttccgaaattaataaagctactatacaacatcagaaatatgcggaggttttgcaaaaagaatttggtataaaatgtccttcaagaaatgatatcatccgatataagttatatttggaattggcaaataacggttttaaagatttatacacggatgtaaaaattgaacgggaaaatttatttactgagaaatatgatatcgatcacattattccgcaatcccgtttctttgatgatagtttctctaataaagttttagtcccaagaagtgctaatcttaaaaaaggaaattttacggctttcgattatcttgaaatcgaaggaaaggaaaaattagagaaattcctcaatattataaaagatctgtatgataagggagcaattactaaagcgaaatatgaaaaactacagaaaaaaggctctgaaataggagaggggttcattgaaagggatttacgaaacacacagtatattgctaaaaaatcaaaggaaatactttttggaattaccaattctgttattgccacttcaggaaggataacagacaaacttcgtgaggattggaatcttgtcaacacaatgaaagaacttaatttagataaatacagaaaattaggtcttacagaaacggtgatcaattcaaaaggagagagaaaacagagaattatcaactggacaaaaagaaacgaccatcgtcaccacgcaatggatgctttaacggttgcttttaccacacataatcatattcagtatttgaactatttaaatgctagaaaagatataaagcataaagagcatcaaaatgtttttgcgattgaaaatttaattactgagatcattgataagaaaaatggttcaaaggaaagaagattcaaagagcctttcaaaaattttagagctgaagccataaaacatttggatgaaatattaatttctcataaagctaaaaataaagtagttaccaaaaacacgaataaaattaagaaaaagggaagtgtaattgcaaaaacagagctgaccccgagagggcagctacataaggaaacaatctacggaagttcaaaatttcttacaacaaaagaagaaaaagtatcaggaaaattcgacgctgaaaccattcagaaagttcagaatgaaaaatataaaaatgccctgctaaaaagattacaagagtatggtggggattctaaaaaagcattttcaggcaaaaatgttatttctaaaaatccaatatttcttaatgccgaaaaaacggagcaattacctgaaaccgtaactttagcctggtatgaaaccggctatacgattagaaaagcagttaatcctgataattttaaagattttaaaaatattgaaaaggttattgataggggcgttcgtgatattctaactgaaagattgaaacaatttaactctaatcctaaagaagccttttctgatttggaaaagaatccaatatggcttaataaatcaaaaggaatctcaataaagacggttactattacagggattaataatgccgaagctttacattataaaaaagatcatttaggaaacgaaattttagatgaaaacggtcaaaagatagccgttgactttgtgagtacaggaaataatcatcacgttgcaatttatgaagataacaatggcaacttaaaggagaaagttgtgagtttttatgaagccgttgaaagagtgaatcaaaatttgcaaattattgacaaagaatataattcagagttaggctggaaattcttatttacattgaaacagaatgaaatgtttttatttccatcggaagattttgatccgaaagaagtagatttatttgatgaaaagaatctgagcttgatttctaagaatctttatagagtgcagaaatttggagatatttctacatcaggtatttgttttaggcatcacttagaaacaaacgtagaaacaaatgcaaaattaaaagatattacattcaaagttattcaaagtacaaaaaatttaaaagcccttgtaaaaattagactcaaccatctgggaaaaatagttcaaattggagaatattaaaacttttacaaaatgattacccgttccatctacatcggaaatcccgcttatcttaagctcaaagatgagcagctgaaaatcctatgtccggatacccaaacggaaaaagggagtgttcctgtggaagatttgggcttattgatgctggatcattatcagattaccatttcgcacaatttgattcagaaaatgatgggaaataatgttgtagtagtgagttgtgacgcgcatcatctaccgcatggaataatgcttccgttgtatggacataccgaacattcagatcgggtaaaagatcagttggaagcaagtgagcctcttaaaaaacaactttggaaacagacggtggaatataaaattgaaaaccagaaaaatgttctgatgaaactgggtaactattatgagccgatgattgaatatcagagaaatgtaaagtcaggcgatataacgaatatggaagggatcgcggcacagcattactggaaatacctcatcagcctggattttttgaggcaacgtttcggagattcacctaatcagttttttaattttggatatgccgtgctcagaagtattgttgcaagagctatcgtggaaaccggattattgcctgttctcggcatttttcataaaaataaatacaatccgtattgccttgccgatgatataatggaaccttaccgtccgttcgttgatttactcgtgatgcaatggttgaaaattcattctgataccgaagaactgtcgaaagaattcaaggctcatattctgcagattgcaaccaaagatgtgcgtattgatgacaaaacaagaccactgcttgttgctgtgaaaatgacggcttcgtcgctttacaaatgctacacaggagaaaaacgactgatctcttatcctgaactgttatgaatgccgaaaggtttaatgcataccggattatgtgggttttagtattatatgatctcccgactgagaccaaagcgaatatgaaagatgctaaccgctttcgcaaggcgctcattgatgatggttttactttgtttcagttttccatgtatgtgcgccattgcccaagccgggagaatgctgaggttcatattaaaagagttaaatttatgcttccaaaaaccgggaaagttgccattatgtgtatcacagacaaacaatttggagatattgaaatcttctttgccaggaatagagaagagccacctccaacctttcagcagcttgaattattctaaattttaaattctaaatataaaaataatctactggttttcagtagattattttttgaggctgtgactaatcacgaaggtaataatttctgaaagcaattcacaacattaagacctgcaacatctatgtacacaccgctgtgactaatcacgaaggtaataatttctgaaagcaattcacaactagcgcgttaatttctgcgcgtatgttttcgctgtgactaatcacgaaggtaataatttctgaaagcaattcacaacaatttttttattgagattatcgacatttttgctgtgactaatcacgaaggtaataatttctgaaagcaattcacaacacctcttcgttttaggtgctgaaggtttttgctgtgactaatcacgaaggtaataatttctgaaagcaattcacaactgcatgctcgagttttaaaattctttcctggctgtgactaatcacgaaggtaataatttctgaaagcaattcacaacaatcttttcgtttaatacgtagcctgaattgctgtgactaatcacgaaggtaataatttctgaaagcaattcacaacaacactgttagatttaagtagtacttatgagctgtgactaatcacgaaggtaataatttctgaaagcaattcacaacttcgccatacataattctttttcttaattcgctgtgactaatcacgaaggtaataatttctgaaagcaattcacaacagccaattgaaactctccaattttagcggcgctgtgactaatcacgaaggtaataatttctgaaagcaattcacaacctcatactaaaaacacatattaatgtcactgctgtgactaatcacgaaggtaataatttctgaaagcaattcacaacttcaatatctgattctttaccatcttctttgctgtgactaatcacgaaggtaataatttctgaaagcaattcacaacttcataagccaattgtttactttgctcaatgctgtgactaatcacgaaggtaataatttctgaaagcaattcacaactgtaggtattatatagttagaattgtaaacgctgtgactaatcacgaaggtaataatttctgaaagcaattcacaacacaatgggaataagttcatctgcacaccttgctgtgactaatcacgaaggtaataatttctgaaagcaattcacaacttgttcagtgcaggcatatttcccgttaacgctgtgactaatcacgaaggtaataatttctgaaagcaattcacaacgattgtcctttctttgccctctaaattttagctgtgactaatcacgaaggtaataatttctgaaagcaattcacaacagtctggcctacacgttttttatcaatttcgctgtgactaatcacgaaggtaataatttctgaaagcaattcacaacaatggtgtctgcatccataacggggcgtttgctgtgactaatcacgaaggtaataatttctgaaagcaattcacaacagtgaagtgattgtttagctgtttaaaggcgctgtgactaatcacgaaggtaataatttctgaaagcaattcacaaccgtacacactttggctataccagctcacaggctgtgactaatcacgaaggtagtaatttttgaaagcaattcacaacactgtggagcaaaccaaagaaagagtatttgctgtgactattcacgaaggtagtaatttttgaaagcaattcacaacaactcaaaaacaataatacaatggaaaacggctgtgactattcacgaaggtagtaatttttgaaagcaattcacaacctcaaatgttcggagtgcaaatatagaaatgctgtgactattcacgaaggtagtaatttttgaaagcaattcacaactttcacgagggccttaaccatcaaaccgtagctgtgactattcacgaaggtagtaatttttgaaagcaattcacaaccattcggtccaatggttctcacatttatccgctgtgactattcacgaagggagtaatttttggaagcaattcacaacttgcagtgcgtcaaacagtggtttgttgaggctgtgactattcacgaaggtagtaatttttggaagcaattcacaactaaaagagtttgttccggatgtgaagaaaagctgtgactattcacgaaggtagtaatttttggaagcaattcacaaccttgcagactctccggaagtggtcactgaagctgtgactaatcacaaaggtagtaatttttgaaagcaattcacaacccggaagtgaactatattcagtaaatggatgctgtgactattcacgaaggtagtaatttttgaaagcaattcacaacccacgaccccggaataagtttgataccattgctgtgactaatcacgaaggtagtaatttttgaaagcaattcacaacacacagacgtaaggaaagaggtcttgttgagctgtgactaatcacgaaggtagtaattttaaaagcaattcacaacaaacagataagactgtacgctattgtttttgctgtgactattcatgatggtagtaatttttgaaagcaattcacaacgcgcaaatcaaaatccagtttttaatttttgctgtgactaatcacgaaggtaataatttttgaaagaaattcacaacgaaccggcttcagattatactagggaacctgctgtgactaatcattaaggtaataatttttgaaagcaattcacaacatgttcaaactgtactgagccgctgacacgctgtgactaatcacgaaggtaatcattaaggtaataatttttgaaagcaattcacaacatgttcaaactgtactgagccgctgacacgctgtgactaatcacgaaggtaataattttttaaagcaattcacaactcataaaataaatggtgccatacgtaatgtgctgtgactaatcacgaaggtaataatttctgagagcaattcacaactagcccaaagatttcacgagacattggcagttgtgactaatcacgaaggtagtaatttttgaaagcaattcacaactagggcctcctgtgcgttgtatgttcttccgctgtgactaatcacgaaggtaataatttttgaaagcaattcacaactaaagcagtgacggctccttgcataacaccactgtaactaatcacgaaggtaataatttctgaaagcaatttacaaccatgagatcctgcggggtttctacgatgaagctgtaaatcaccacgaagataataaattttttgaaagtaagttgcaacttaagctggataagaaaggatgcatggatcatcttctgcgaagaatatctttccccatgccactgatttcgtccattgttttctttttgccttcctgtatccaatctagtaactctgctttggaaaagtgaagcctattgcccttcttgtagtaaggtacctcgcggtggcaaattttagagtacagtgtgggtaaggaaagcttcagcagttgactagcctctcttgcccctataaacacctcttcttcaggttcattttgcattctagctgatagtaatttctctattttttctaaccggtcttctatattgcgaagaattttcggtatctcttcaaatgtatagcccatgatttttttttataatattatactaagtcgattaattattttatgtaatgtcttgcagtggtacaatttgtcatcttatggaattggacaatcgcttaattatgagtagactctttctctcgtgctggtctacgctgttccatttagtacgttttttccaatgttatataaatccagtttgatcttttctgaagcctctttttttagactatctacaattttggcgtaaatcattgtggtttttatgtccttatgtcctagtaattttgaaactgtatatatagaggtgccagctgctatttgtagtgtagcgaacgtatgccgaaaaccatggaaagtaaaatatttggtgataccggcattaatcagccatttttttaatgcactaacagtatggtcatatctcaatcctttaaatactttttcattaggttccccaacagggcccaatagttgaatcacttgatctgaaaccggaaagtattccgcattttctgtcttctcctgactgtatactatataatagtttccaagggttccgtggatctcattccatagcagactttcaatgtcagaatatctaaatcccgtcattgcagaaaataatcctgcttttttaacaataggattcggacaatgagcatttgccattctttcaagctcttccaaaaataaaaaggaacgatgggtctgctgagtggcaatgctttctattatttcacctaaattattgggcatgaaacgctttttaaaagcgtttttaagggtcaatttaaaacggctataataagcagcggcggtattttttactattggctttttgctgcgaccaagagcaggaccggagagcagataatcggcatactcctcacaaatcgtttcattcaattcgataaaagaaatgttggggccaacaaatgatgtgaaatacctcacagccataacccagttatagcaatttcctctctttcgggcctccgccgtgaaaaagtctataaagtttgatttcatttttgaatccgagataaaatcaaatcgtttgttttgcaactctatttgacgttgcgccctgatatactctgctaatgccagggtttctttattgtaatccttctccgtccgattcttcggattatcgtagatatatagtttcaaatattgttttttttgcatcttcccagtatctgcattataaactggtggatataaatttagatacaaggaatgtcttcctttactaataggccttttttgtaaggtaacatttgacattatcactatttttagttgaaaattaataagtgattgatcataacctgtaaagtggttacgtcaaggaattatttggcggtaaattaacgaggttgttacggctttcactagccactgtatttacctgtctctattttttgtaacaaaaattcgattatttttcttggcacgtaaacaaaccttcccctgggatatttagggattttatgacggttaataagggtttttaaactcgtttcggaaatattgtatcgctgttgaatctcgccaatgcttaaaaaatctttaaggattttctcttctgagagtttttcgtcttgctgattaatcaaatccacaggaagtgtgacatgaaatagctcatcaatgtcttttttcagtagccgtattcttcttattgataggttggcagagggaattttacctgcttttatcattcgatagatcgtgcgtcgtccacacttaagtaaagcggctgcttcactgactgttaaatagtctactgtttttagagcgaaataggatttgtcgttttcgttttccctacggattacaaggtctgagggggcctcagcttttacttgactgtctttgatcttttgatcccgtacttttgccttatatgctcttttagcacagtggtcaccacagtattttgtcactgtagttctggcaataaaccctagtccgcagtgctcgcagaccttcttgattttcatatttgaactcataatatctttttgcgggagttcaaatgcacttaaggtgtatttaggtacgtttaaggtcattaaggtgcattaagataccttaagtgacataatttctcccttgtttgaaaaactaagatatttagagtatgaggggacaatagggggaacaaacgaataaaaaaaaccaaaattttaaaaaatcttacaaaaacagaaaatatgtaatatgttgatttttagaatattggtgtattttagattgtttcgacttgttttcttattttccgatacaaaacttagaaaaaatattccctaacacttcatcattagtcacttcaccggaaatttctccaagatgttccagggcatttctaagctcataggccaatagttctgtagagatctgaaatgaaatggcttccttcactttataaacggcatccagagactttcttaaggcttcaaagtggcgttgattggtgattaccacgttattttcttcagattttaaatgctcaacatatgatgaaagttcattcttgagatcctggatattttggttttcaaccgcggaaattttaatgaaatcaaactcatgggaaatggcattcctgaaaatgtcttccactgtttcgtatttggtaggcatcacttcatcaatttttgtagcgcagataatcagtttcagatcttctcttagcaaggattgaatcatttcaatatcctcggaaaaatcttccgtagcagcatcagcaagatatacaagaatgttggcgttttctaccttttctttagccttttttaccccgattgcttcaatttcatccacggtctcacgaagtcctgccgtatcaatcaatctgaaggcatgtcctttaatatggagaacttcctcaatggtatctcttgtagttcctgcaatattgcttacaatggctctttcttccttcaaaagcgaattcagtagagtagattttccggcattgggttttccgatgatggcaacagcggttccgtttttaatggcatttccgtattggaagctttcaatcagtgaatttaatttgacttcaattttatccagtaatccgcttaaggcacttctgtcagcaaactccacatcttcttctgcaaaatcaagttccagctcaattaaagaaacgaaattcaaaagatcggttcttaatatagaaatctcattggtaattcctcctttcaattgattgatggcaacttttctcgaagcttcattttcagaggcgatgacatccgcaattgcttctgcctgggaaaggtcaattcttccgttaataaaggcacgaagagtaaattctcccgctttggccattcttgctccgtttttgatcagggtttcaagaatacgttttccgatatgcggcgagccgtgaaaagcaatctccacagaattttcagtggtgaaacttttcggggccaggaaaatagagagcattacttcatcaatagcttcttcctcatccataaaataaccgtaatggatggtatgggatttttgctttgccaggtttttagccggaaaacttttctgaactacagataaagcttcatttcctgaaactctgatgatgcctaaggcacctattccattggccgtagccaaagcacatatcgtatcgttattcatgctgcaaatttacggtttttaatatgaattttcgtggaggtctgttattcagattatctattgttttatttaggttaaaacagggagagttggaaagttgcttgttatttttttgaattaaactacgtcttcagaggatgaaaaatcaaaattttagaattaaataatgctgttaagcgtcaggctttttaatgtttgtaatctattgctggatagtaggtcaggttgtttttgaataaagtgtgaagtggagattaaagtcaaccaatttatgataagtgaaaaattaaacacgtgtttggtatgttaattgtttcttaatgcgccaatgatgttgagaattgaaatattgttcaaataatcggtaataattcgttaaaatattataaatgtacatgaataaattattttttttaaatattaatgaaaaattgatttttttattagtgcttgctttcaatgctttagcctatgctcaatgcattccttacacagggcagacgatgacaagcggaaatacctattgtcttaacggaaatcttaccgtaagtacaaatatcagtatcccgaacggcgcaacacttatcatacaatccggacagctgcagtctaacagtattcaggtagatggaatcttggaaatcactggcggaacaagtgtgaagtctacaggaacggtgaaagtagggactttcgggtctcagaaaaattcaaaaatcaaattaggaaccaagtctttcctgtctcttgtaggatcagtgattcaggaagaccctaccttcgggggcttttatccgggaaccacttcagtgatcgaaatgggaacaagcagcgtggtggagatttgcggaacatttacccagcagtctactacttatccttccgttgaatatgtaggtgctcctgccggcaaagcgtattgcattgcaaaagcagatgtaagtggtggcggaggtgcttccatcatcagtgatgacagtcagattgtaaccattgccatgggatctgtaataggattaggaatggggaattcaagcttctgcggaccgaatgcaacaaaggcgatgtgcccttctctttggcctgaaggattatcagaagataaaacaagctgtggaaatgctccggtgattattgatgatattgacggattctgtacaaagcccggaattaccggtacaccggatggatataccagattcggaattactgtacagcagaaaaacaattcctggccggaaaacattcctaatggatttttagcgatggaatcaaaaaataaaggatttgtcatcaccagagttcagcatgtaagccagactccacagcccggagatgccatcgcagacccgaaagaaggaatgcttttatatgacattcaggataaatgtgtaaagctttacaatgggacagaatggaaatgcatccagaaaagctgtaatgattaatctaaacgataacaaaatgaagaatataaaaaacataagtatagcggttggtctggttgcttttaattcattttttgcccaggttgccatcggtaaacaaacagtggacggaaacagtaccgtattagactttgataacgtgcctgggaataccaaaggtttgattcttccggctacagcaggttttccgaccgggaatctggccaatggaacattgatctttgatcttacggataacaaagtgaaggtatacgaaaatgacacctggaaatctttgtcagatgccggaaattcaggccagatcgctcttaataattctgcagaatcagggaaaggagtgattataggaaaggctgaaagcactgcagatggagtattggtattggaatcagagaataaagcaatggtactgccgaaaatagaagctccacatctcaacgtaaaaaatccttatccgggaatgatgtgctatgatacagccagtaaaacgcttgcagtattcgacggttcagtctggaattattggaaatagcaatagaataattctgatgaaagataacaaaagcagctgtgtgaaaatatacagctgctttttcttttggattaaacaatctgagcactttccttgatgctgttcatcacaaaaatacttttggtctggccaatcccttcaatctctgataatttgttcacaaaaaactcatggaactcatccatattgggagccaggatcttgagcataaaatcaaaatctccgctgatgttgtaaaattctaccacttctttaagtttgccaacttcctcaataaattttcctgctgtttttttattgtgaacatttaaggcaatcatacagattaccatcattcctttattgacctttttacggtctaccacagcggtatattctttaatgattccctgtttttccatacgcttgatacgctcatgcgtaggcgtgggactcaggttgattcttgcagaaatatcacggacactcatcttggcgtctttctgaagcagacggagaatcgacaggtctttttcgtcgggaatataattttcagttgccattttgttctgtttttatagattttttttaatgcatcagttgttttgttcttttagatggattaaataattaatattgttccaaatgtaagcttaaatttttaaatacgttctgttaattctaattttgcaggaaatttgaaacatgggtacaaagaagaatattatattaattttagcatcggtaggaacatttgtggaggctttggatattgccattattaatttaactattccttctattcaacagcagtttcaaattggagccgagattgtacagtggcttcagacgctttatgtattgttcttcggaggcttcctgatcatcggaggaaaactttcagaccagatcggaagaaaaaaaatgtttttactcggggctttgattttcatgctgacttcattaggggcaggattgtcgcaaaattttgaagtactggctgttttccgtgccttgcaggggcttggagctgctttagtaatgccatcagcattatccatcgtgaccaataccttcagggaagagcaggaaagaaaccgggcgatcgggatcttcagttcatttgctgcaattggttccggcagtggtctttcggtaggaggaattatcagtacttacctgagctggcactgggttttcctcataaacgttcctatccttttaattacactggtattatcatactattatcttccggcagatgagaaaaatgaaacagcgcagaaaacagatatggtgtccggtatattaatggtgctgggtcttttaagtctgacctatggaacacacgaattagttcacattaaagaacagccttttctggtaacaggctctttggttgtagcattaatccttcttactgtggtatattaccgattgaagtctgtggctgaacctttagttgatttaaaattatttaaacacagatctttggtcgtttccaatgctgcattctttaccctgggagcattttttatcggatttttattcctgatttcactgatgcttcagaaagatatgggatacagtgctgcttcagcagggttaatgcttgttccgttcagtatcatttccgctttaacggcaaaatttattctgcctcatgtctcaaaacgtctgggctcgtcccaaatgggtgttctaggatggttgtttatgctgatgggaggcctgttattgctgatctctgtttacactggacatccgcttgcagttgttttattcggagccgcttgtatttcgggggttggaatgacgttctgctttaccgcgctttccgtaatgggaatccaggatgttgaaccttctcattacgggctggcatcaagtctgagttctacaagttactttctgggtgcagggatagggttatcattcatgactttgatgggccagatttttccatcggaattttcagtgggaagccttaacctgataatattgattggttatgctcttttagcgctcgggatgttattttactttatattgaaaagtttaaaaataaagcaggcagaagtagctgtttcataagcgacttaaaaatacacaaactatatgaagaaagaatcgatgcttaggtgttggttttttttttgtgaaaaggcaaaaaagtaaaatggctaaatagcagaattgtaaaatggcaaaaccgctaaatagcaaaatttacctgcctgtcttttatgtctttctatctttcactcttttgcccttttgctgttttacccttttgccttaaaaatgataaagtaaaattaaacctgtttcgtctgtagtgatgaagcaggtttttaatccattatcattatgaagacaaatatacaagaggggatcattcttattccggatttcagcggatttacagaatttgtgttcaatacaaaattgtatacaggcgagtatattgtgcgccagttattgtctacactgattgatgtcaatgatcagtactttgaaatttccgagattgaaggagatgccattttattttaccgttatgataaaaatccgtcttatcacagtatttcaagaatgctgtggaagatgagagctacctttaacaggaaaattgaggagctgagtaaaagtttaagtattactattgacctcgctcttaagtttattgttcattatggatctttttcacaatataatatcggaagcttcagaaaactatatggaaaaacgattgttgaagctcatcagcttttaaaaaacggagtggcagagcagccttcttatgtgcttttcagtaattcctttctggaaaacagtaagaatcaggattctgattttaataaggatccgttcctgctgcctgaagtaggggtaatccattattttgaaaatttaaactagcgtatacctttttaatatcattccttgtaaatttgctattgctagcagcccgggtgagatccgggctttttgatgggcaggtcttccggaaatatattgatcaggaactattttcgtatgttgctgtaaaatattcatgtattgatgaataaattttaaattttttaattgaaaatttaaattatatataaaatgcttttttaagaatatttattatggaagtagtttgcattgtgctgctttattgaaaaatatgcattattttctgttttatgtttaaaattaacactggtatctcgctgtaaattaggtatttattttaattttttttctcttttgatgtaacaaatttatgttcatagtggtcttatagaaaaaactataatttcacatgaaaataatcttatttccaatagcaatattagcgggctcattagcaatggcccagcaggctcagacaccggctgcaaatgatactgtaaaaggaaatgcaaaagaaatagaagcggttactctggttgccagaaagccgacagtagaatctaaagtagacagaactgtatttaatgtagctaatagtgcaattctggcaggaaatacaacctgggatgtccttagaatgactcctttggtaagcattgataataatgatgaggtaaaagcggagggacaactggttaccgtatacattaatgacagaaaatctgtttttactggaaaagaattaaaggaatatcttaaaaccattcctgctgataatcttatgaaaattgaagtgattaccagcccttcttcccgttatgaaacttccggatccgttatcaatattgttcttaaaaaaagagatgatgaaggagtgaaaggaagcatctccctgaacaacagacaaagtaccaaaaattcacaatacacgaatttcaacctgaactatcataagaaaaagtttacccaaaccctcataggaagttacaatagtggaaactatgtacagaagacccagacctgggataaccggtatgaaggaaataagcttacccggttcaatcttgaaaatctcatgcgaaatgaaagcccctctctttcttctacttcagagtttgaaatcaatgaaaagaataacttcggtcttgtcctggaatattcacaaaatcggaatttagtttcagcagaatcggatgggatgacttcaaaggacggagatccgggagaatctttccaccagagtcaaaacaactggggattcagccgtaatctggggactaatgctttctataaatattatgacaaagagaagaacagaattttagatattaatttaggaaccaattactccagtgataatgacgatgatttaattgataaacagattaataagcagggagttataacaacccagcaattgggtgtaatcagcaaaaaccagatgcgtaattattatctcaaggttgattatacacagccttttggtaagtcgggcggaactatggaagtggggggtaaaacggaactgaacaatcatgttattcctaatacactctatggtttcagtatcaatgatccctcatcagaatattttaatctatccaaaaacgacagatttcattatgaggataatctgagctctttatatgccaattacagcaaaacattttttgaaaaactggaaacaagaatcggaatcagatacgaatatattgattataaagtaagacaggatgtggcaggtacagaaagaagagactcttatggaacttttcttcccaacctgttgctgaaatatagtttttcagaaaagtttgatctgagccttacctataaccgaagtatctggagaccttggtattctgaatttaatcctttcgtaacacctgaaattaacggaacctattcacgaggaaatctttatctgaatccaaaccctaatgacaggctttatctgaagttcgggattttgaaaaagtattttatctctgcgaggtatatgtacaccaatcaggattattggacaacctatgttacggaaaacggaagaacagtttcattacccggaaactttgacggaaaggttgaaaaatattatctttttgccaataccaatcagaatttcctgaaaaataagctgaacgtaaatgccggatttggatggtactatatcaataataaagatttcaatgaaaaaaataagttgggagctaaagattatataagctattggggggcttctgcgaatgtatcttataccaatctgtttaataaaaacattaatgtaagcgcctggatggagcttgccaatcagaataacggaaattcttatgcaaataacaccaatgttttccataatatttcagtcaccaaaatattcccgaaaacccagatggaactgagcatgcagctgatgaatatctttaaaagaccttacggtgataacacaacctatagtcctgacggaaccttcagagagtattcaaaatgggactggtacggtgtttcgcttacttttgtaaaacgtttcgggaaccagaaggtaaaagaaaataccaaaacagatgttgagaaaaacgatggcggcggaaaataattaaagatcgttagataaaatgaaagcagattcccaattggaatctgctttttatttttgattggaagctggaagtgaaaagattcatctttactatttgttttaaaaaatctgtgaaatctctgtgatctgtgggaaaaatttttaacgcaaagttttattgagtttcttattattttaaggttgcaaagttttgaatcaatcaaattgattctttctaagcgtaaatacaatcagaatccttcgtaagcaactttgttgctttcttaactcccttaaaaatattacttttttatttaaaactttgcgttaaaaaccttcgtaaatctggcagctttcaagaaatctggaaaaataaaaaaacagattccgatctggaatctgtttacattctatcaaataattatcaaacagagttttactcttaacgctttttatttaagggtaaatttcacttttgttttaatcgcatcggaagaatttccaatcagagcttcaaagtctcccggttcagcaacccaatcatgtttttgaggatcaaaataacttaaagccgttttatcaatcgtgaaagtaacttctttttgctctcccggattcagatatactttttcaaatcctttcagttcttttgccggacgcggaacagatgattttaaatcactgatgtaaagctgggcaacttcagcacctgcttttttacccgtatttttaaccgttactgtaaaggtaatcttaccatcctgtgatattgtgatctgatctgcttttgctttcccgaattcaaaagaagtatagctcaaaccatgcccgaagctgaacagaggttttatatttttagtgtcgtgccagcggtaacctacaaaaatgctttcattgtaagtgatgttgataggatttttctggtctttaccttttccagctgccaattcatccttttgacccggatattctccaagctggtgtgctgaattgtcttcaagttttatagggaaggtaaacggaagttttcctgacggattggcatctccggctaagattgctgcaatagaatttccagcctcagaacccagataccaagcctgtacaacagttggaacttctttaatccatggcatggccaccgcatttcctgataccaaaactacagcaaggtttttattggcttttgccagagcagagatgatctgatcctggttgtaaggcaacccatagctttttctgtcatttccttcactgtcctggaaatctgccttattaaggccgcctataaaaatcacataatctgattttttggccagttctacagcttctttcagtaattcagcttcggagcgggtatcttttaaatcctgaccggattttaccccgttatattctcctccgatatcccctacatatcctctggcatactgtacatcagcctgctttccaaatctggttttgattccgtccaaaggcagcgtctcatattttacttttaatgaagaggaaccaccgccaacagtcattattttgatggcattttctccgataactgctatctttttagccttattaagatcaacaggaagaacatttccctggttttttaataaaacgattccttcttcaccaatttctttggcaaccgctttatgctcttcagaagcaatatttccaaatggtttattacggttcattgtagttttataggcaagacgtagtaatctcgttaccttatcatcaagctcttttgtgccaacttttcctgctttaattaaatcaagataaggctttgccagataataattgtcataggcatttttcgttcctgctgaaagtccgttcgtccatgatccgaactccagatcaagaccattatgaatagcctgttccgtattgtttacagcaccccagtcagataccacaacgcccttgtaattccattctttctttaaaatatcatttaaaagatactgattctggctggcatactgacctttgtacatatcataagctcccatgatcgtccatgaatctccctctgttaccgctgctttgaatgcaggaaggtaaatctcatagagcgctctgtcatccacattcacattactggtatgacggaacatttcctggttgttcagggcaaaatgttttacagaagttgccacaccattagactgtacccctttgatgtagggaaccaccatctttgaggtcagataaggatcttctcccatatattcgaaatttcttccgttcagcggagttctgtaaatattgactccggggccgagaagaatatctttttttctgtatcgtgcttcttcacccagagctttcccgtagttccatgccatttttttattccatgttgcggataaagcggttagggcagggtaggcgatgatagaatcgttagtccagccggcctgatcccattcatcccacattacttcaggacgaactccatgtgggccgtccgtagtccagaattcaggaattcccaatcttggaacacccggtgagctgaatttcgactgtgcatgaagcatagccactttttcttccagcgtcattcttgatagtgcatcctgaatacgctgttctacaggtttggattcatctaaataaacgggaattgagttattggtctgagccatataagatgcagaaataaaggtgagtaaacttataatgacggttttctttaacataatgcctttcagtttgattaaaaacaaaagtaaagaaaatttttattatctcaaattgagaaaataaaaaattatgaataaaaaaactgcttgcttatttacagacagcttattatgaaatatttttaatgataaagaaaaaattgaagagaagttgtaggatagatataaaagtgcaaagggctggattcctacggaatggacaagatggatgtatagataaagcgtgtaatttgtccattctgtaggaatctacgctcttaccctcaaactctcaaaccctcaaactctccaactcatcaatcccatcctttcacagcacctcccttgaaaatttccttagctttcttttctacttcaggagactcataggctttcacaaagttttttactttctggctgtttttattatcaggtctcgctacaaccacatttacataaggtgaatctttatcttcaacaagaactccctgtttttgctgatctaaacctgcctgagccgcaaaattattattgattacccctacaacaacatctctgtcatctagaacccttggaatctgggctccttcaatctccataattttcagctgtttcggattttctgtaatatcagttacttttggaagaagtccgacccctgcttttaattttaataatccgtttttctgcaacagaagcaaagaacgtcctccgttggtagggtcattcggaataacaatcgtactgccgtcctgcagttcactgatatttttaatcttttttgaataagccacaatcggatacacaaatgtatttcctaccggtacaagattgtagcctctctgtttggattgttccgttaagtaaggaatatgctggaaggcattggcatcaatatctccgttagtcagtgcttcattgggaaccacataatcgttgaagggaataagttccacttccagattgtatctatctttagctacttttttcgccacttcagcaatttcctgttcaggaccataagtaattccaacacggataaaattcgggtcgtcctttcttccagaacaagcactgaatagcaacattcccgcagccaataaaccaaaaatttttattctcttcattctattttttatttaaatactattagggtaaaagataaatgaaattactctcaaaccctcaaaccctctcactcaaaattacctgtgatcaaacctttttgacaatctgtcgcccataaactggataatgaaaaccaaaagaaccagcagaatcaaaactgtattcataataacaatatcatatccgatatatccatactggtagcccacctgtccaagtccgccggcaccaacggcacctcccattgcggagtaaccaacaagggtaatcaaagtaatagttgcattgttgattaatgaaggaagtgcttcaggaagcaaaacttttctgataatctgtaacggagaagctcccagcgctctcgcagtctctataagtccatgaggaacctcaataaggctattctctacaagtctcgcaataaaaggtgctgctcccacactcagaggaaccaaagcagcattcactccgatagaagttcctgctaaaactctggtaaaaggaatcatccatacgatcagaataataaaaggaatcgcacggaagatattaacgataatagaaagtcctctatgataaaaagtattttccagcagctggccttttctggttaaaaacaacaggattcctaccggaagtcccagtacaaaaccaaaaaagccggataaaaatgtcatgtaaaccgtttcccaggttccttttgccaaaagggcaattaccgcgtcactaagcatatccttttactgtgttttgaattttattttgattgaaataatagatcgcctgttggttttcctccgtaccaccctgaagctgcagcagaagtttaccgaagttggaatctccgaagtattccacgtcagcttttaaaagtttataagggattttatattggttgtatagtgttgaaagaatttgttcaacactgacgttttcgttaagttctatttctatcagcggaaacaaaccgtctttcggttctttctgaagtctgctgatgagttcctgtggcagggtcatgatgtctgaatttataaattggcggatgatcgggttttctctgtctgaaataatctcgcttaatgtaccttttgttaataattttcctttgtcgatcacggcaacgtggttacataccgatttgatcacttccatttcgtgggtaattagaagaaccgtaattcccagcctctgattgatgtctcttaaaagctgaagaatagactgtgttgtagcgggatccagtgcgctggtggcttcgtcacaaagaagaagataaggatcattggccagggctcttgcaatagctaccctttgtttttgccctccggataggcttttgggataatcgttggctttatcctccagtcctacaatcttcagtaattcgttaacttttctgttgatctgatccttgctggtgtgatccagctccagaggaagcgctacattatcaaaaacagttcttgaagaaagaagattgaaatgctggaaaatcattcctatttttttgcgctcctcagccagctgtttggagttgagtgcagtaaaatcttttccgttaataataatctgtccctcatccggtctttccaatagattcactgtacggatcagggtactttttcctgcccctgaaaatcctataattcctacaatatctcctttctctatggtaagactcaccttgtccagcgctttaaaagactgttttttctggtgaaatgtttttgatatatttctgatttctatcattctgattttatatactgtttaaataggctgataaggtctgcctgttctgtttaaaaatctcctaattcttctgattttgaccttcgaccgttttgaaagtttgaaatacttggtcacattcgttaaaagtactccaagcaatatgacaaataaaccatacagctgacctccattgatgctttggtgggcaacaatccagcctgcaatcactgttacaataggattgatataggtatgggtgctcaccaaagcagccggttttacggacagaagccaaatgtacgacaaataagcgactatcgatccaaagaagatcaaaaatagcactccggaccatgcagataacggaaccgcagaaaccgaaaaaccagtccattcttttctgaaaaaagcaattaaaaaagaagccagtcccgctattataagctgttgcgcaatattcataaaggtagattgagacgccggatttttcttcgaatataaagagccaagcacccatgcaatagaacttaatcccaacaccacaaatgcagtaatgcgaagatttccatcaacggctgcatgggcttcattagcatgtacactgccttttaaaaagagtaccagccctacaaacccaataaccagtccgatcggaataaatttatctgaaaaataatacttccagtttcttctgtcgatggcaataaaccagaacggcccggttgcaatagaaattgcggcctcagaagccgttacatattgttctccccaggctacaaggccggttcctccggtaaggatgagaattccggtaatggcattttttttccagttgatgagggaatttgctttttctcctttagaaagaagatatccgatcatcagaattccggccaccagaaatcttaatcccgaaagaataaatggaggaaaacctttcaagccaaatgaaatagctaaaaacgtaattccccatatcacatagatatttgtaaacgccaatggaatcaaccatttgtttttagaattgctcatttttatgtttttaatgttgtgttcaataaaaaaggccctacaacgtggtagggcctttacaaaatatgtctaaataaaagtaaggtcaaccacagtattcctgatttacaggcatacagatatgcttcatcatttttttgatggtatgtttctttattgaattattttttaattctgccttcattttattttatttcctgaatacggttgcaaatatataatataatttttattagtccactaaaaaagtagacaatttagatattaatttattgttaacagtctaatttatttaaaatcaaattgttgtatattttgttttttagtgtttaaaaatgctttatgtagttttttcttatagttaaccgaaatttcattgaaattatacagccattggtgttgtggaaaatataaaataaatagggatttttgggaattgtgtaaatcttattctggacttatatattttgaaggaaaaggagaaattgtatttattaaactagttaaatgcacaggatgtctgttcactgtaatttagcatcaaaattaaaagacatggacaatagaatattaggtctgcaccatattacagcaatagcagacaatgcgaaaagaaatttagatttttatacaaaagttttaggcgtaagactggtaaagaaaacagtgaattttgatgatccgggaacctatcatttctatttcggaaatgaaaacggaactccgggaaccatccttactttctttccatgggaaggaattggtaaaggaaccaatggaagcggaatggctacccacattggctattctgtgccgaaaggaagtcttgaattctggaaaagccgtttgcaggattttaatgtcaatgtagaagaaggcgaagtatttggtgaaaagatgatctcttttacggatccggacggacttcagttacagtttatagaaccttcaggtgatgacaacagaaaagtatggacaactgatgatattaaggacgaaaatgcattgaaaggatttcacaatgttactttaaccctaaaaaaagcagatcctacgatcaaagttctgaccgatattttaggatatgatctgaaaaaacaggaaggggaaagatacagatttgcaaccgatgccattgataccgctaatctggtagatattattgaaaacgatagcattcctgcgggaagaaacgctgcaggaaccaatcaccatattgcattcagagtaaaagatgataatgttctgatggaataccgcgaaaaagctttatctgcaggattgagcatcactccgaaaatcaacagggattatttctattcactgtatttccgtgaaccgggcggtgttttatttgaaatcgctactgataatccgggattcacagtggatgaacctttgaatgaactgggaaccaacctgaaacttcctgtacaatacgagggaatacgcgagaaaatagaaggagtgcttccgaaattatcatagatcatcggcaggctctgataaagatgctaattttgaattaagaattaaaaacaaacaaaatggaaagaacagaaatcgtgttagaaggaagaaaaggagaaattcagcttttctcagatgatcataaagcaggtaaaatggatatttcagtcattggaaaaaaactgactgtttaccatacggaagtgaatccggaatatgaaggaaaaggctttgccaaaattttactggagagactggtatcttatgctagagaaaatgatttgaagattctgccgttgtgtccgtatgttcatgcacagttcaaacgccatccggaagaatataatgatgtctggctgaaggaagaactctaatgattttgagagctgggtttcgggatacgagtttataaattcgagtttgagagtgagagggtaagagggtttgagcgtttcgatcttataaacccaaccccgaatcccatcataataaccaattaacaattttatcactatgaaccttatcacaggactgcatcacgttacggcaattaccggtaatgcacaggaaaatatagatttttataccggagttttaggacttcgtttagtcaaaaaaacagtcaatttcgattactcggatgtctatcatttttatttcggtgacgaatacggcacaccgggaacaattatgaccacttttccgtatggtaaagatctgatcaatggaaggcatggtaatggaatgcttaataccacagctttttccgtttccatagatgctctggattattggatgaaccgtctggagcggtttaatattccttttaagcagccacagcaaagattttcagatgaagtttttatttatcttgaagattttgacgggctgggactggaattggtttttaatgataaggacgaaagaaaaggatattacaatggttatattcctaaagattatgcaattaagggaatccatcatgtagaaatctggcaggatgcctatgaaagaactgctgctctgcttacgacacagatggaccataaagtaatcaaagaaagtcctgacagactgagactgggaacagaaaatgtgccgggaaaatatgtagatttgctttctacgcctaatgccttgaaaggattggccggaagaggaaccgttcaccatgtggcttttgctactccggatgcggcatctcagcttgaaatggtaaagagattaaatgcatacggactggaacataccgaagtgaaggacagaaaatattttacctctgtctattttaaagagccgggcggtgtattgtttgaaattgccacttcaggtccaggattcgatgtagatgaggaagcggcatttttaggagaaaatctgcaattgcctctacagtttgaaaaaagaagagagcgtcttacagaagttcttcctgtaatcaattacccaacagaaaaattcagatagaaataatgagtcatattttaaatataaaaacagcaggaatacctttgagtcaggcagaaaaagctttgatcatgattcatggacgtggaggaagtgctcaggatatcttaagtttatcccagcatttgaatgtgaaagattatgcactgctggcaccacaagctttgaatcatacctggtatccctattcatttatggcaccggcagaacaaaatgaaccctggctttcatcagctctggaaatggttggcgaaacagtaaaagcagcggtggatgcaggaatcaaaccagaaaatatatactttttcgggttttcacagggagcctgtcttacccttgagtttctgtcccgtaacgctcagaaattcggtggtgcagctgctattattggcggagtgataggagataagattaatcgtgaaaattataaaggtgactttgccggaactcctgttttcctgggaaccagcaatcctgattttcatgttcctgtagaaagagtatatgctaccgcaaatattttaagagaaatgaatgctgaggtaaccgaaaaagtatatgccaatttcgggcattccatcaatcaagaagagattgagttgtccaacgcgattatttttaattaagtactttacctttgaattattggtaatttttgatcctctaagtgtttaatgaagtgaagattcctatggaatgataaagtatgcgcattatctatccgctcatattgtcattccataggaatctaacccaatgtataacttagcattcaatagcggcgggctttagcccgccaaacaaaaaaataaaaatcactggctttagcccaaacctaaataatccgaacctgagaactaacttctaacctctaatttctaacttctaaaaacatgcacgaacagttacttttaatactggggcttttattactcgttatgatgctggtaatgctggcgcaacggattaaaattgcttatcctatttttctggtgcttgccggattagggatcagtatgattcccggcgtacccattttaaaactggatccggatattatatttttaatttttctgccgcctcttttatatgaagctgcctggtatacctcatggaatgatttctggaaatggaaacgcaccatcagcctgctggcgtttggtctcgtatttttgacttccctggtggttgcctatacgtcacagatgctgattccgggtttcaccttggcattaggatttttattgggcggaattgtttcgccgccggatgcagttgctgcgactaccgttttaaaaggactgaaggttcctaagcgtaccatcgctatactggaaggggaaagcctgattaatgatgcttcatcattgattgttttcaggtttgcgctggctgcagtcatgacaggtgctttttccatgcatgaagcaacaggacagttttttctggtagcaggaatgggagtcgtggtaggaattgcgggggctcatattttctatgccatacaccgctttttacctacaacaccggcaattgatgctgctgttacggtgattactccctatattctgtttctttctgcagagcattttcatttttcaggagtaatggctgtggtgagcggagggctgtttatgtccttccgtgcgcatgaaattttcaaaacaggaaccacaagaatcaatatgacgggagtttggaataccctgatcttcgtaatgaatgctttggtttttgtactgatagggcttgaacttccggatattattaatggactgggtgaaacctcattaatggaaggaataaaatatggtttaatcataagcctgatcgttattgcagtacgtttgttgtggatctatcccgtagcccatcttccgagatggttcagtgaaaaggtccgtcgtgacccaagtccgggatggaaaaatcctttaattataggatgggcagggatgagaggagtggtttccctggctacagcactctcaattccggtcatgatgaacagtcaggaagaattccccatgagaaacctgattatttttatcacgtttgttgtcatttttgtaaccttagtgttccagggattgacattgcctctgattattaaactgacaaaaatcaaggaaatagatcctattcttccttctcacgagcagcaggcaggaattcagattaggttggataagctggccgcagatcagcttgacaaaaagtatactgaattgctaaacagtaataacctacttatcaatcttaaaaagacactggaaaatgatattaaagtccaccagaatcatttaagctccattgagatgtgtaccaacaggcagaatgatatggcagaataccataaagtaatgctggatatatttgcactgcagagaaaagaattgtttaaaatgaaacgtgaaaaactcttcagtgatgatgaaataagaaaagcagaatcacagctggatctgaatgaattgaagattacgggaaacagacatttgtaggatgacgagcgatgagggtttgagttggagagtcgggagggtttgagagttactaggagtggaggcaggtttcgaggttcggttattgagtgggagcatttggaagtaaaagtgtttaggtttctactgaatggacaaactaagcactttatttatccacacactaggtcattccgcaggaatctaaatcgtcattttaccttttatgtaaacaatataaactttaaaccctgaaccttaaactttaaaccttgaactttgaatttttaaccttaaacaaaatgaaaacattacattttttagtgattggaaagaatcaggagattcttgatacgttaaaaagaattatagagaataatgaaggttggacagcagaaatacaaagtgatgaaaattactgctatgactatataaaaaataatacggttgatattgtccttttaagctcaggcttagaagatgattttgagaaagatataaaagttttttgtgccggtttggataaagatgtgaaagtaattgatcattatggaggaggaagtggacttttaaagaacgaagtttacagtctttttcctaatttgcaggggtaaactctgcattatgtttgaaaatatcatcaaaaatattacccgtttcatttccattactcaggaagaagagaaagtttttacagatctgctggtttgtcagtcattttccaagaaaacagttttgttgagggaaggtgagatctgccagtttgaagggtatattcagaaaggatgtttgcgaatgtattgtctggatgatgatggtacggaagtgactcttctgtttgccattgaagactggtggatcagtgatattgcatcatttcaggaacagaaaccttctaaagtttttatcgaaacgttggaagattcggaaatctatatgctgaatccggcaacaaaagaaaaattactgcaggaagttccaaaattcgaaagagtcttcagaatgctggttcaaagaaatcttgccacccttcagagcaggttggtagacaccatttccaaaaccgcatcagacagataccttgaatttatcaaattatatccttccatcccgcaaagagtagcacaatattatatcgcttcttatcttggggtttcaaaagaatttgtaagcaccatcagaaagcgtcttgcctcaaaagaaaagtaagcttcatgtcttaaactctctgcttagttttgttaattcaaagatcaacagtaataaaacagtgagattcctacggaatgacacaattgaaataatggctttacccacacaatttgtcattccgtaggaatctagacaaagtctaagggtaaaaaggctcttacactttccaaaaaaacagcaatccactatagttacaatgccgaatacaaaaatatccggcatttttttttgttgcaaagtcatttattaaactagttaaatgtataggatttccgacatctctaaatttgtactattaaaatgaacaaacaatctgatatggacagaaaagattttttaaagaaaggattattgggaacaggaatgtttgtggcatcagcctctctggcaagtgctatgaaaaatgacatcgatgagatcgaaccattagaaccgatcggatataatcatcttcccaatacagaatcaaagataaaagaaaactctgtgatccacagagctgacacaagaggaaaggccgatcacggatggctgttgagcaaccatactttcagttttgccaattattacaatcctgaaagaatgcacttcggagtcctgcgggttttgaatgacgataaagtgaaagcaggaagaggtttcggaacgcatcctcacgataatatggagatcatcagtattcctttggaaggcgatcttgagcataaagacagcatgggaaatacagccgtaatcagaagcggagatatccaggtgatgagtgcaggaaccggaattatgcatagtgagttcaataaaaacagcgataagcttgtaaaatttcttcagatctggatttaccccaaaaaaagaaatgtgacaccgagatacgaccagatcactttagacaaaacgaaaggtcaaaatcagtttcaacagatcctttctcccaatgcagatgatgaaggcgtatggattcatcaggatgcatggttccatctgggaacttttgatcagaataaagaaaccggttatcggatcagaaaaaaaggaaatggagtgtatgttttcatcttgaaaggaagtgcggaaataggcggagagactttggaagaacgagatggattcggagcatgggatatccagaatctcaatatcaaagcccttaaagaaggtacggaaattcttctgatggaagtgccgatgacactttaaggttactaaaagtctttttaatggccaatgccattttaaaataaaagaaataatgaactagtttcattacatgagtcgtcctaaaataggttgacataaattaaacaatatttaatccggagagatattttatttcttcggattttttatgcactttatctggagtttgcatattaaggcttagatgtggtctttta

SEQ ID NO: 16 - DNA, 91521 bp, Chryseobacterium sp.
ctacttgagaaactattcttaatttaaaggctatactgtagtctttttgtgtgcgcttttctctttttaatacttgatctttcataaataagtcgattagttgtcaacttatttcaggacgagacaacattgttgatttagcctccttttttaagggggcttttttataaaaaatatgataacgattgcatatctgacaagtaatttttaaacgcaaagtttaatattcctttttttaaattctaaggaagcaaagttggaatcaatgaaattgatcctttctaagcttgtgtaatatcctttcgcttcatcagcgactttagtcgcaattctttgcctgcttaaataaataatagcatccaatttcctttgcgttaaatacttaaaataagttttgtgaagcttcatatctttagaacggccaaatctaatttcctctctttcagttctaagtgcagcaaacccaactgaatttgaaaagtcaaaaaaaatcccgatttttgcactccttcaataaacccgagttcatgaaattatgtattgccgagaaacccagtgttgccagagatatcgccaaagtattgggcgctaccacgcctaaacaaggctatatggaaggaaacggctattgcgtaacatggacgttcggacacctttgtacattgaaagaacctcacgactacggcccacaatacaaatcctggaatctcttttcactgccgattattcccaacagctttggaatcaagctgatcccgaataaaggtgtggaaaatcagtttaaagtcattgaaaaactagtcgaagaatgtgatgaggtcattaactgcggggatgccgggcaggagggagaactcattcaacgttgggtattgcagaaagcaaaatgtaacaaaccggttcagcgtttatggatttcttccctgacggaagacgcaatcaaagaagggtttgcaagtttaaaacctgcagaagattataaaaatctatatcttgccggaaacgcaagagcgataggagactggctgctgggaatcaatgctactaggctttttactaagaaattcgggggaaataaagcggtgctttctatcgggagggtgcagactcccacactcgcaatgctggttcagcgtcagaaagagattgatgcctttacgacagaagagtattgggaactgaaaaccagataccgtgacgtccttttcagtgcggcaattgatcgtttaaaaacgttggaacgtgcagaaaaaggattggaataccttaaagtcaatccatttgaaatcgtctctttcgaaattaaagaaggaaaggaaaaaaatccacgacttttcgacctgaccggacttcaggtggaagccaataaaaaatatggatattcagccgaaaatacgttgaattatgtgcaaagtctttatgaaaagaaacatgtaacctatccgcgtgttgataccacttacttatcagacagtttatatccgaaaataccagggattcttcagaaaatgtatccttatcaggagctgattgccccgttgctggaagctccgattccaaaatcaaaagccgttttcgatgataccaaagtaaccgatcaccatgccatcattcctacggaaattccgccttcacagaatttgagcagggaagaaaaactgatttatgatctgattgcaaaacgtttcattgctgtattttacccggaatgtaaaatttcaaacacattggtggaaggaaaagtaggaaccattcctttcaaaaccagcggaagacaggttcttgaagcaggctggagagccgtttacgccaaagagcctaaagaagaagcaaccgataaggaaaaagaaaaagaggaagaacagaccattcctgaatttgtcgtaggagaaacgggaccccacgatccgatgatccaccagggaaaaacaacacctcccaaaccatacaccgaagcaaccttgctgagagccatggaaacggccggaaaacaggttgaagatgaagagttgcgtgaaatgctgaagaataacggtattggaagaccttccacccgtgccaacatcattgaaaccctttttaaaaggaaatacatcgaaaagaaaagaaaaaatctgattgctacccaaaccggaattcagctgattgacaccatcgaagacgaacttttaaaaagtccggaactgacgggagaatgggaatctaaactccgtaaaattgaaaaaggcgagtatgaagccaatcttttcaaagaagaactgattcagatggtgacagaattgactgaaaaagtagtgtatggaaaaggaaaagtgatcactcttgaggaagaagcaaaagaagaagtgaaggagaagaaaaaaagagaacccgcacagaaaaaagaacttcagtcctgggaagaaacaaaatgtccgaaatgtaaagaacataatctgatcaaaggaaaaactgcagtcggatgttccgatttcaaaaattgcggctttaaaattacttttgagattttcggcaagaaattatccgataaacagcttttagacctggttttaaaaggaaaaacttcaaaactgaaaggcttctccgcacatacggaagcaattacagaaggtgttttgactttaagtgatgattttcaggtacagcttagctaatccaattttggcattatccaattttatcagagataaaatctttgcgcgttaaagcatacaattcaataaacaacatgcgcatttgcgttttctaaccaaactgcaccaagactatttcggaatgataagctgtatggatagactaaatgttgtattttgtcattccgcaggaatccagccttgtacttttctagctattgtgcaacaataaccattttctcggagataaaatctttgcgtcttaacagcatacaattaggtacacagtctgcacctttgttttttccaacaggctataccgtgattcctacggaatgacaggctgtatggatagactaagtgttgtattttgtcatttcgcaggaatccagccttgtacttttctagctatccggaaacaataaccattttatcggagataaaatctttgcgtcttaacagcatacaattagatacacagtctgtacctttgcgttttccaaccaagttatactgagattcctacgaaatggcaagctgtatgaatagactatgcgttgtatttgtcattccttaggaatccagccatacgcttttctattcaatctcaattctttattctatttgcaaatacttcatctgaagacgtaaaaattcccctctttcggaggggtggcgaaaattcaaagaatttttgacggggtggttttacgctttgctgaacacatagtcatcaagaaatcccaacattagctcttttctgcttgataaactgaaaaaccgatccaacgataaaaagcagaaaaataacaagaagtgtctgtccgatgatgggatctttaatatctttagccaaagggtgcccaatcggaatccttgtgaaagtctcattgatagtaggaactaatgacagaaaaaaactgaatgacagtaaaaaattctcaaaatacctggctttcctgctttcttttttattggcaaacagaaagtaggcagcagagatcaaaacgatgataaacagcgaaaatacatgcccggcattaaaaccgccgtgtttcgagattgctaatgctgtaagtgatgttatggcagtagcataaaaatatacttttcccgaccgctgagccaggtcaattttaccatatttgataaatcctgtaatggctccaataagagcagcgataccgataatggtatgaaaaattcctaaaactgatagattcatattgagataattttaaattatacacattttgtttctcgtgaaactgatggtacaaatttgcggcagaaatacagaaatggttttgtgatttggttcaagtatttgagagtttggttcagcaaaaaagcatctctttacaataagaaatgctggataataatatagaaatgtttttactatttttctttctgtttctggcggtatccggagggagaaatatgatatttatcgctgaagtttttggtaaaggtggccaggtcattaaaaccgcagtcaaaagcgatatcggtgatacgttcatctgatattaacaatagttcggcagccttttccagttttttatttctgatatagttggccggtgtatcatgatatagctttgcaaattctcttttgaaagatgatacgctcaggttgctttggtctgcaagctgttcgatcgtgagctgtgaaaataaattggcttcaataatttgcttaaaagaataagtggagggagagaaaagctgtgaaagaatcaattgaactgaatctgcattatgtgactgggccagcaacagcataatttcttttaccttaagaattaatatatcttcattaatgagtgaaggattttcaaagtaaaaaagcagtccttctacatatttttgaatcaggaaatcattatttattttcccgcttgatttgttagaaaccgtattgacaggcttttgcagcaataaaggcagctccctgtcatagattcttttcaggatatccgggtagaaagtaacgatgacaatcttgcagtcctctgattttgaatgctgaatatgttttccggcactgatacagttcagaagcagggaataatttgtggcaatattaaattcctgctcatctgttttatattgaaactcacctttaataacatacagaaaacaggcctgctccgcaaccggaaaatcatatctgaacggacctttcagatcaattttctggatcagggtttttccaaacaattcgtattttttgtaatcattcagcataattgatgagttctgttttgaagaaaaacaagtgaaagttaattaatttcatgaaataataaccattttatcggagataaaatcattgcgccttaaaaacatatgacttatgaaataacatgcgcctttgcgtttccaaccaaactacaccgggattcctacggaatgactagcagtacggataaactaagttaagtgttgtattttgtcattccgcaggaatccggccttgtacttttctagctatcctgaaacaataaccattttatcggagataaaatcattgtgccttaaaaacatatgaattgggaataacctgcgcctttgcattttccaaccaagctatacctagattcctacggaatgacaagctgtacgggtagactaagcgttgtattgtctttcctttactgaagttgtgaagttccaacattggctttttgcttcttaaaaattactcttttcattctttactatttaaatcaatgtttaaatttacatacaaattcaaattatgacaccagagaaaagaaaactcatcacagacagcttcaaccgttcggaaactttacagttttataaagcagaactgctggaagtagaaaccggttttatatccatgaaaattcctaaaatggaaatgatgaccagaaaagccggaatgttcaatggggcaatgattgcctctttagtggatgtttcttcaggatacgctgctgtgagccattatcctgaggactgttatgtagtgaccgttgagctgaaagtgaattatcttcgtcctgcaatgggagatgctctggtttcaaaatcttatgtcattaaaggtggtggaaaaatcattgtggtgaggactgaaatctatgttcagactgaaggctctgaatcagaaagtcatgtagcgacttcattagtgaccatgatgaaaataaaataatatattaagcgaaataaaagacaaaatattccatcaataaagggttttaaagaattcttttttccggaatggaatggcttttgctccacaaaccccataaacattaaaaaatatcacaatgaacttaattatccgactatttattacagcgattgtcgcttaccttttaaccaaaatcttacctggggtacattttgaaggattctcttcagccattatctttgctattgtgcttggggttcttaacatatttgtgaagccaattttaagtctgttcggtcttccgctaacgattcttactttaggattttttgccctggtaattaatgcagcaattgttctgattgcagactatttcatagatagtatggtcgtagatggcttctggtgggcatttattttcagtatattactgtcaattgtaacttctctggcaaactcaatgttctcagatggagattaattaaaaacattgcatacctaaataaaaatccgctcaacgagcggatttttttatttttgataaacttagataaaacaggattccgctcgaatctgtcgttagctgtgaaaaaagaatgagaacacaagaaatgaagaagtaaggagaaacttttttatagaagggggttattagtttgttttttataaattaataaagtttacctgttaataaatcacctggtttaaattttaatgttaattctttcgtccgtttttattttaaatattaactttggcaatctttgaatttaataaaaggatgataaaaatcagctgattttttacatccgttaaaaaatgaatatcaacatatgaaacttaagtacagtctgctggctttggcagctccgcttttaatgaacgcacaacaagtaatgacgcctgaaattctttggactttgaaaaaagttggggtacaggcagtttcaccggatcagggatcccttatttataaagtaggacaggtagatctgaaaacagagaaaacgaaaaatgagaactattttctgaatgttcttaatcatcagtcttccaaaattgatttcggtaaaaaagcacttattcagtgggataaaaacgggatttatgctcaggaaggggataaaatctatctttctaaagatgccggaaaaacatgggcagaattctatactattggagaagcagataatattgtcatttctccggacggaaagaaaatagctttcagcaagcaggtgctggtggaaaaagtaatggggaaagacaaattcagtgatactccaaaaaccacagcacaggtttacacagacctgaaccacagacactgggattacttcaatgaaggaaaatacaaccatgtatttgtagtgaacgcttctgataaagtagaaggagctaaagatcttctggaagggaaaacatgggattccccgcaaagacctttcggtggagctgaagactttatctggagcccagattctgcacagcttttatatgttacaaaacctaaaagcggtaaggagtatgctaccagtaccaataccgatatctttgcttacgatttggcatcaggtaccaccaaaaatcttactgaatccaacaaaggatatgatgtaaatccaaaattcagtccggacggaaaatctctgatctggcagagcatggccagagacggatatgaagcagataaaaatgatgtgaaaatcctggactggaagtcagggaagatcacaaatcttacttcaggatgggatgaaagtgtttcaggagatgtgctttggggagcagattcaaaaacgatctactttacggcagcgttcagaggaacaaaacagcttttctcactggattcaaaaacagcaaaagtacagcagatcaccaaaggagattttgacgttaacgaaatctttacagacaacaaaacttcacttttagtaggaagaacagatatcaaccatgccacagaattattctctgtaaatattaaaaatggagaaatgaagcaggttactgaagctaacaaagaaacatacgctaagttggctcaggggaaatctgaacttaaaatggtgaaaacttcggacggtaaggaaatgggagtttggttccattatccgccgaactttgacccgaataaaaaatatccgactttagtgtactgtcagggtggtccacagtctgctcttactcagtttttcagcgtaaggtggaactttgccctaatgacagctaacgattatatcgtggtagctccaaacagaagaggtatgccgggctggggaacaaaatggaatgaagaaatttcaagagactggggtggacagccaatgagagattatctggctgcaacagattttgcgaaaactttaccgtacgtagatggtgacagagtagcagcagtaggagccagctatggaggctacagcgtatttatgctggcaggaatccatgagaacagatttaaaacgttcattgctcatgacggattatttgatatgaaatcatggtatctgactacagaggaactttggtttgcaaactgggatcttggttcaccatgggaaaagcctcttccaaaagcatatacagagttcaacccaagcaactttgtagataaatggaacaaaccgatcatgatcgttcagggtggaattgatttccgtgttccttacgagcagggtcaggaagctttccaggctgcaaaattaagaggattaaaatctaaactggtatacttcccgaatgaaaaccactgggtacttcatccacaaaacggactggtatggcagagagaattcttcgactggctgaaggaaactttataaaacaaaaaattaatagaaacgggctttagcccgtttttttatgattaaaaattccgatagctttagcaaaatcctcaataacttcctgcattaagctcccagcttccagcctgataaaagaaaataaaatctctatatttgaatatgcaaaagcgtatttcttcatttccacctattattgatgctcagtctgaaattctgattttaggatcaattcccggagtgaaatcattggaaaagcagcagtattatgcccatcctcaaaataaattctggaaaatcatttttgaattgctgaatgaagattttactgatgattacatccaaagaattgagaccataaagaaacatcatattgccctttgggatgtcattgattcctgtgagaggaaaggaagcctggattctgaaatcaggaatgaagaagccaatcagattgctgaactactggaagaacatccgaacatcaaagcaattttctgcaatggtggtaagtcttacaaaaacttacaaaagctgctgggaaaaaattataaattgcccatctttcaattgccctccacaagtccgcttcacaccgtttcctttgagaagaaactggaagagtggaagaggatattggagtttttggtttgagaatttgagcgtgggagagtttatgagttagagtattgaaattgtaaacgtatagattcctacggaatggacaactgggacgctttattaatgcatacactttgtcattccgaaggaatctaaatatagaatgcaatctaaataaaaatcattcattctctaaatattcccttaatccttttaataattccagctgatttttggtacggtctaaattatgttcaggatatttcgtagcataataaatactgccattcagataatccgttaaaaaacgaagttcctgaatatagatagcgacctgtgcggcgtagtcaagattctcagtttcagctggggtcagtttatcttttaaatggaacagaaacccttcttttaccgctttatacatttcagggttgaagttatttatggcacttccgtcatcttcatgggatgtattggtataggattgaatcattgtcccgaaatcatacaaaatagtagaaaccatcgtagtatccagatcaattaccgctaaaggatgatgctcctgatcgaagagaatattgctgattttcacatctgcatggataattcttttaggaatatgaccgtttttctccatctctatccattgatcaggtaaagacagaaactggttggtgatttctatttcagcttttgcgttttcttttaaatggggtgctgcattttttagcgagcccttatagtctgcaattcttttttcaaaattgagaaagcctggaatcggatcttcaatggcaggcagcttttccgtattatttacggtgttaaggaaataactgaaagttttagccgcttcaaaagccgtttgtaacgatggagcggtaagaaaggtaacactgttttctataaaattgagcatgcgccatggatggccatccgcatcttttataagaattttatgggttggtgagaggataggttcaataatttcaaactgatagttattggccctgagaatgtcattgatcattaaatgattattaacgatcacctccggctgtctgaacacatgatggttaattttctggaggataaactttttcccctgatctttgtcttccagaaggtaagtggtattgatcagtccgtcagtaacaggagtaagatcataatgatctgtaccgataaattcaaaaacaatatcgtttagctccataaattttccgggtatctgttgttgctgatctctgaaatcagaaaatctttaatatcctttttatcatcggcatatgtaacgcccatccattgagaaggagaagcttttaccttcacctttaccctttcttcgtccatcatcctctgtacagcagaaggaatataaaattcctgtttgggcagagggtcagattcaataaaatcatagaaataagcttccagataacagaagatatgaggatggaaaataaaaaagttcatggataccagtgcttcaggatccagttttatattttcgccgtttttaatgtaaacaatagagttatttattctttgaatagaagtttgttcctctattctgatcaggtaattttctgaatcaagcgtacatattcctcttgctacagctccgttaccgctcaatgttgtgcccacaggataagcaatcattcccagctgtgtatctgaaatatgatgctggttgatttcatgagcagccagctgataggcttcttttccgtaaaaatcatccgcattgatcatcacaaaaggctcctgtatcgaatatttggcacagagaacggcatgagcagttccccatggtttttcacggtctggataatcaaaaccttccagtgaaataggaatgctgtctatctcctggtatacccaatgcagctcaaaatttttagtttttgaaatatggttgagtctgtcaatataactttcgggaatcagtttgttgacaataataacaactttgtggaaacccgcttccagggcatcatagatagaatattcaagaatcggggagccgttaccgagtattccatccacctgtttaagtcctttgtacctgcttcctaatccccctgcgagtatgagtaatgtcttcttagaactcatcggtcattccaaatacaggtttacgggttttccattttccgttggtgaaatcagggatgtcaactacctgacctcctttggcaatagactcttcactcaatggggtaattgaataccacagcgccagatcgtatacatccatagggaattctatatttcgtttgatacattctataaaagtattcatcacaaagaaatccattccaccatgtcctgctcctgcagcagtgctttcaaacttcttccatatcggatgatcatattctttcatccatttttccgtattgtcccagcggtgggtatgattcattgttttttcaaaataaatatgtccctggttaaaatctccccatccgaaatcctgccacaatccctcagttccctgaaccctgaaaccaagatcataaggtctctgtaaacttgtatcatgagtaagaaggatggtttcgccgttggcacaggcaatctgggtggttacaatatctccctggttgaatttgactttggcgttcggatgattttctccaccttttggatgctcaacaatgtatttatggagtcctacagattttgaagagaatgaagacagtttggttaaacggtttcctctgttgatatccatcatcatagcaaccgggcctaatccatgggtaggataaagctctccgttacgttttacataatgttcggttctccattttgcttcactgaatcctttttctccgaattcagcaccggaattgtatggagtaactccgtcattgaaaagaacacctctcagatcatgctgatagccgcctcttccatgcaccaattccccgaacatccctttacggaccatgttcagaatagccatgatatctcttcggtagcaaacattttccatcatgaagataggaactttcgtttcttcgtaaacctttacaaattcccagcagtcctgaagctttatggctcctgaaacctccatgcccacaatttttttagcacgcatggcctcaacaccttgtgtaagatgccactcccacggtgttgcaataacaacggcgtctattgtttttaattttaaaagattccggtagtcatattctccgttggaaaactcctgagcagccggtttattattgtcttttagtattttttgagacgcggcaagcattcttttctccggatctgcaaatgctacaatctctacatcattacgttttgccagtaattttacatgttcctgcccacgaagaccgacgccaataaaaccgacgcggacctttttatctgttttaaaatcattggaataggcaaataaagaattgggtaaaaccagtgccccaaagcctgctaaagctgctgtcttaagaaagttcctgcgggagttgctattgtccatctatttttttcctaaatatattaaaacttttgtaaatggcgatggataaggggttgagatttgattggagagttagagaattgagggtttgagtgcttgatggaatataaaatctgaggagcgcgggaagaagcagaaagaagtttccataatgtaattattacggaaactccggatcacttctaagttgtttgtcttatttttccatatagtatacctcttcataaggctgaatcaatacccatccatgtcctgagaatttcatctggaactcttcgccgcttcctcttccgataaggcttttgaaagaaacattggttttcagttccgggcttagggttccggaccatgcaacagtagcattcggatctgtaaatacgggtgtgtcaggagttaccaacaaggtcaatggatctccgtgcgtggtaatggcgatatgtcctgttcctgaaagtttcacctggaaaagaccaccggacatcattcctgcgatacttttcagcatggtaatgtcactttttacgctttgctcatgagcaagtacgtcatttccgtttacacaaacggattcattattcagataaaggatgcggactttcttcccggaatccgcaacatataattttcctgtaccttctgctttcatcagcctggctccttcaccactgatagctttctttaaaagatttccaattccgccagccagcattccctgtctttcaaaattgatgtttcccacatagcttaccatgcttcctcttttcgtccataccgcttgattatttagattgatttccagaaggtgttttgtttccagctcaaaataatctctttgctgtggattttcttttgtttcgttaataaatgcttctattgaatatttgctcataatgatatttttacttttatagtgctattattttagtttgtcggattgataggctcttttgttactacagattatccaattgggaatgtttgccaggtacgtttcatcttcttcctgttgtcttcattattttttattttagtttttaaataatttggctttttcagttgaatatttcaaatgtataacgatcaggatacggattatcaatgaagtatatttgcttaaagattccatattgaattttaattttcccaaaaatactctttttgtgccttgaaactccccgtaaaatcacggttttatatctgattgtaaataatacttgacaaaggggtattcaatgtcgtatatttgcactccgaaaattacaccttgtaatttcagtaatttttaaaccgtaatttaaaaaatgaaaacatcagattttaattttgatcttcctgcagaattattggcagaacacccatcagagcacagagacgaagcaagattaatggtacttgatagaaaaacacagactatcgagcacaaattattcaaagatgtagtggattattttgatgaagaggatttgttcatcttcaacaatacaaaagttttccctgcacgtctttacggaaacaaagaaaaaaccggagctaaaattgaagttttcttattaagagagcttgataaagaaaccagagtttgggatgttttggtagatcctgcaagaaaaatcagaattggtaacaaattattcttcactgaagatgaatctttggtagctgaagttattgataacacaacttcaagaggaagaacattaagattcttattcgacggttcttacgaagaattcagatctaaattaaaagaactgggagaaactccgcttccaaaatatatcaaaagagctgtagagcctgaagatgcagaaagataccagacgatctacgcaaaagtagaaggagcagtagctgcacctacagcaggtcttcacttctctaagcatttgatgaagagattagagatcaagggaatcaattttgctgaagttacgcttcacgtaggattgggaactttcaacccgattgaggtagaagatctttccaagcataaaatggagtctgaagagatcatcattgatgagaaaaatgctgctattatcaacaaagcggtagaagctcacagaagagtttgtgcagtaggtactactaccatgagagcattggaaacttcagtttcttcaaataaaaaaatctctgcttttaatggatggacaaataagttcatttatcctcctcacgaatttggagtggctaactcaatgatcaccaacttccacacaccgaagtctactttgatcatgatgattgctgcatttgccggaagagatttcgtaatgcacgcttatgaagaagccgtaaaagaaaagtataaattctattcttacggtgacgcaatgttaattctataaaaaaagtaaaaagagccaagttaaaggtaatacaagtagagatgagacaaaatgatttacttataagaacttttacatttggggttgattgtcttaagtttttaagaacgcttcccaatgattctgaaagtaaattaataagatttcagctcggaaaatcagctacttcaataggcgctaattatgaagaatcccaggccggatcttcaaaagctgactttaaaaacaaagtgaaaattgctttaagagaagccagagaaagtcatttttggcttagggttttagaaggattagatggttatgattctgaggaatttaaagctttattgactgaaagtaacgagttaaaaaacattttggctgcaatagttaacaatactaaagtttaaactttttactttaaacttttaacttggctctttaatattatgaaagatatccgtacattatcattagaccagcttaaagactattttgtgtctttaggagaaaaaccgtttcgtgcgaagcaggtctatgactggctatggagcaaaaacctccattcaattgacgaaatgacgaatctttcaaaatcacttcgtgagaaaatttcggaagaatataccattaatcctgtttccgttgaccttcttcaaaaaagttctgacggaaccatcaaaaacggagtgaaacttcatgacggactgatggtggagtctgttcttattcctacagaaacaagaactacagcctgtgtatcttcacaggtaggatgctccctaaactgcgaattctgcgctacagcaagactgaaaagaatgagaaaccttgaagttgctgaaattgtagaccaggttgccctgatcgacagccagagcagaatgtatttcgacagaccgctttccaatatcgtatttatgggaatgggagagccaatgatgaactacaaaaacgtagtggaagccatcaaaaaaattacccagccggaaggattgggaatgtctccgaggagaattaccgtttctacatccggtatccctaaaatgattaaaatgcttgcagatgatgagctgcgtgtgaagctggctttatcccttcactctgccatcgaatccaagcgtaatgagatcatgcctttctcagataaatttccgttgacggatattatggaggcgcttcagtactggtaccaaaaaaccggttctgttatcacctttgaatactgtgtatggaaagggatcaatgacggtgatgaggatatcaaagctctaattaaatattgcaaacaggttccttcaaaagttaacctgattcaatataaccctatcggggatggaaaatatgatcagtgcaataaacaggcggaagaaaactatatccgtcagcttgaaaatgcaggaattaccgtaatggtcagaagaagccgtggaggtgatattgatgcagcctgcggacagctggccaataaaactacagattaaaatttccttaaaaaaagtctaaaactttcttaaaaaataggttaaaaccctacctttgcacaaattattttgtgatgatggattttcttatgagtgaggacgggctggaaaatgtatatgcatgggctatcccattgcatgctacagttattttagctgaaatgatttacagccacgtttcagaagctaagttatatagtgggaaagatcttgcgaccaatgtttatcttgcattgatgaactttggccttgaccttatcatgaaagcatttgccatgggtgtaatgtttttcttttaccaccacaggattttctcatgggatcttagtatctggtatttgctggcttgctttgtaatcacagattttgcctattatgtgctccattatgtagatcatcgttccagagcattctgggctgttcatattacccaccacagttcagaatatttcaatcttacaacaggattcagaagccctgttctgcagcctctttacagatatttatatttctcaccgcttgcctttttaggattcaatccgtggcatattatggtcgcttatgcaatcgggcaggtgtatggaacatgggtgcatacccagacagtgaaaagtatggggtttttagagcatattctggtaacgccttctcaccatcgtgtccatcatgcatgtaatgtaaaatatcttgataagaatatgggaatgtgcctgattatctgggataaaatattcggaacctttcagaaagaagaccccaatgtacctgtgaaatacggaatttatccaaagatgccggataacagaccagatacggttcttttttatgaatggagaaaaatctggaaagaccttaagcaacccggattaaaattcacagacagaatcaattatattttcaattcgccgggatggaggcatgacggaaccggaaaaacagtaaggcaataccagaaagagtattttgcaagacaggctaaaagaaaagaacaacagcaaaatcagaaagagcagaaaactgcttaacttctgatttaaatcaatagaaatctaagtgaaaaacgggctatcttggtccgtttttctgtttttagaattaacattcaaggcttttagattcatacaaaagtgtatggatggataatgtgcttagtttgtccattccgcaggaatctagactctcacttccaacttgatcgccaaacacgaatctcgaaatctcgttcaggctctcaaatactcttaccctccaactcaccagctcagaataaaaccctaattttgtcttatgaaaaaattctttctgattatcaccctgatcattatccaatctgctttttctcaacagacagactttctgaaaataaaaaaatacagagtcaattatctcaatgataagattgaagagacttcaggactgaatattttaaacggaaaactgtatacattcaatgatagtggaaatcctgccgaactttttgaaattgataaaaaaagcggagaaattatcaggacactgaaaaccaatttaatcaatacagattgggaagcgttagccaatgacggagaaaatttttatataggagatttcggaaacaataccgggacaagaaaggatctgacgatttacaaagtcccatacgaacgtctcgatgagtctaatgccattaaaattccaggttcggaaagagcccttgatggaacgaaaattctgttttattatcctgaacagactgagttcatttctaaaaatataaagaatgatttcgatgcagaggccatgatttatctgaacggaaagctgcatatatttaccaaagaatgggtttcaaaagcaacctcacattatatcgtagatcctgaaatctcagaactgcaaaaagcagaaaaaatagaaacctataaaactggttttgttgttacagatgcctcttattttgataaaaagctttatctgataggatataccaggaaaacagaagtctttttagatatttttacagaaacggaacccggaatttttttcaaagaaaagtccaagcattattacctcggaaccgcatttgcactggggcaaattgaagggataagcgcagacgaatcgggaatttatatttcaggagaaaaattcagatctccgttgggaagtgcaaaaccttcattttattttattccgaaagatcaactcaaagattaattttatcttaaaattgagcgaaaaaaattatctttgtgagaattaataattattcacccagtatcgcagattgtggcaaacattgtagaagagattaaacgaccgatcaatgatgaaatgaaactttttgaacagaagttttatgaatcaatgcagagtaaagtagctttattggataaagtaacccgttttattgttaccacgaaaggaaagcagatgcgtcccatgttcgtatttctttgtgcgaaactggtgggtgaagtaacggagaagacctaccgtggtgcttctatgattgagctgatccacactgccactctggtgcatgatgatgtagtggatgaaagttttaaacgtcgcaatttcttttcaatcaatgcgttgtggaaaaataaaatagcagttttggttggagactatcttctgtcaaaatcagttttattatctacagaccataaagattatgatttgctgggagtgatctccagaaccatccgtgaaatgtcagaaggagaacttcttcaactggaaaaagccagaaaactggatattacggaagatgtttactatgaaattatccgtcagaaaactgccacgctgattgcagcctgttgcgaaataggggttctttctaacaatgcggatgaagctttagccaaaaaaatgatggatttcgggacctttacggggatggcgtttcagatcaaagatgacctttttgattatttaagttcaaacgtcatcggaaagccggttggaattgacattaaagaacagaaaatgacccttccattaatccatacccttacaacagcgaacgagaaggatagaaaatattatttcgataccataaagcgttataataacaatccaaaacgggtaaaagaacttatagaatttgtaaaaagctccggcggtctggaatatgctattacagttatgaaggattttcagcagaaagcaaaagatattctaaatgaatttccggattccgaagcaagaaaatcgttgcatattatgctggattatgttattgaaagaaaattctgatagtcaccttttttatcaatcctgattttttgttctcctatttcctttaatcctgcatggtgtaacaggattcgtattactgaaaagaaataaccctgtttttcaatgatccaatgagttgtgattatttttgttttttgtaatagtaaattgctgtaaattaatattttgcataaatcaactaaaataattgctaataattcattgatattcaatataaatgttgtttatttgttattacaaaaaacaacaaataatgaaaaaaatcaaaacaatgatgatagcatgtgctatcagttcaagctttcttgcgtatgcacaagtcggaataggaactcaaaacccccagacaacttttcatatcgatggatctaaagacaatcctgtgacaggagctccttctgcagctcaacaggataatgattttagtgttacttcaggtgcaagggtagggattgggactgttgctccgaccgaaaaactggatgtagcatctggaaatgcccgtattcgtaatattaatgcgaatgtaggtattggaggaactgacagggttgttgtagctgatgctaccggagtactgaagactatcgattttactgcttattcactgtttcatgcgcgtttagcagctaaccagaacatcagtgcttctaccattacaactttattattttccacaccagtagcaacttctccgttctattcctataatgcaggaactggagtattaactcttaatcaggccggaaattatctggtaaccttacaggcaagttttaccaatatgcctgcagatagtcagctgctcatcggtataagacctgtaccagatgccaattacctgggaaggggaagtcattacaatgcaattgcttcttcaggaacggtaggtgagctgatgaattatacaactgtaattgttgctcctacagcaggctatcagatccgttttaccgcagctcccaatcaaaatgctacgattattgcaacagaaacaggatctacaggaagtggaaatgttaccaatgtaacagtacagaagatataattctatctttacattacaattaaaacaagtaaagtgttttgtatatgtttttaggaagctgaaagtgtatacagaacactttctttttatattcaaaatccaataagagttaaagatcacaatattgccggattttggtgcctagagatctttatttattttccggattaggcaattaagtgaaaattttaaattaaattattttcagggttacaataataacggccagaactatacaaaataaagcgattaaaaataaataatccgcaatgttctcaaacgtatattcccgcttttcgctttttgttctgatggccaggaaggaaaagaagcagctacaggcaaaaaggatacaggcaaatccagcaaattcgtccaaatatgtactctgactgatcttagagatttttaatgaggtaataataatcagtgaaaatcctaaaagattgctggatgcattcaaaatgtgaggcgactttttttccatcttttacaatttttctcaaaataaagcacaattttttttattatcaaatttttaaaaaagattattaaaaattaaaattaatttaaaaagtgtatattagcaaaatacttgaagaataaaaacttttttacttagctatgcaaacaacctatattgaaacacagcaaatatcctttcaagattttaaaaatcagatacttggagattacaggttaggaaggatttcccgtgaaatgtcttatcttggaagaagagaagtgctcacaggaaaagctaaattcggaatttttggggatggaaaagaacttcctcagcttgcaatggcgaaagttttcagaaatggagacttccgttcaggatattacagggatcagacttttgcattggcaataaatgcacttacggtagaaagtttctttgcacagatgtatgcagatacaagtgtggaaagagaacctgcttcagccggaagacagatgaacgggcatttcgcaacaagaagtttaaatgaagacgggagctggaaagatttgacagctcagaaaaatatttcttctgatatttctcctacagctggtcagatgccaagactactaggattggctcaggcttcgacaatttataaaagtgtaaaatttgacgggtcagaaaaattctcaagagaaggtaatgaaattgctttcggaaccattggagatgcttctacagcagaaggacatttctgggaaactcttaatgccgcttgtgcactacaggttcctatgattgtttcaatctgggatgacgggtacggaatttcagttcctaccaaaaaccagagagcaaaagctgatatcagtgaaatgttaagcggtttccagagaaaagaaggggagaaccagggatgtgagattatccaggtgaaagcatgggattatcctgcattactggatgcctatgcaaaggcagaacattttgcaagaacagaaagtgtaccggtggtagtgcacgtagttgatgttacccagcctcagggacactctacttccggatctcacgaaagatataaaaacgaagcacgtcttgcatgggaggctgagtttgacggattagtgaaattcaaagaatggattcttaattattctattgaaattgatgggaaagaagaagtaattgctactgctgaagaactggacgccattgatgaagaagctaaaaaagcagcaaaagcaggtcagaaaacagcatgggaaaattatcagaaagccatttcagaacttacccagtctcttttacctttagttgaaaatcttaagggacagaatgctgaagtggaagcttatattactcagttcaacaagttggtttcaaaagcgaaaaaagatatcttccacctggtaagaaaagcattattggcgacaagaggaacaaactctgcagaaagagttgaactgatgcagagatacaatgaattggctgctgttgaaaaggataactattcttctcacttatattctcagtctcaatggaaagctgaaaatgttcaggaaatcaaacctgtgtattctgacagttccgaagatgtagatggaagagtagtgatcagaaacaacttcgataaaatttttgaaaaatatcctgaaactttaatctttggagaggataccggaaacatcggtgacgtaaaccaggggttggaaggaatgcaggaaaaatatggtgctttacgtatcgctgacaccggaattcgtgaagcaacgattcttggacagggaattggtatggcgatgagaggtttaagacccatcgctgaaatccagtatttagattatgttctttactgtttacaaggaatgagcgatgatctggcaacggtacactacagaacgaaaggaggtcagaaagctccattgatcatcagaacaagagggcacagattagaaggaatctggcattcgggttctccaatggcagggatcctgaacctttcaaaaggtattctggtattggtacctagaaaccttacaaaagcagcaggattctacaacacgatgcttcaggctgacgaacctgcaatcattgtagaatgtctgaacggatacagattaaaagaaaagcaaccggataacttaggtgaattcacggttcctgtaggtaaaattgaagttactaaagaaggaaaagatgttactctggtaacttacggttctacatggagaattgtgactgaggctgccaatgaattggagaaattaggaatttctgcagaagttatcgatattcagtcgttgattcctttcgatttatcccacgaaattgcggagagtgttaagaaaaccaacagattagtggtgattgacgaagatgtggaaggaggaactaccggatacattctacaacagatccttgaaaaacagaaagcattcagatatctggattcaaatccgttgacaatctcagccaatgatcacagacctgcctatgcaagtgatggtgactatttcagtaaaccatctgcagacgatatggtagaaaaaatctacgctatgtttaatgaaacaaatcctcagaaatatcctgcgatattctaattgggatttcagataaattttgaaaccgcttccttttgggagcggtttttatttgttaatcctcttcagtcaaagtaatttataatgattttttttgcaaatttgtatcagaaagattttggtgatatacttaccttttcgaaagtgctcaattatattaaatataaaaatgaaaaaaataacttcatttttgaagtccagaaaatgggcactcattatttcgatactgtatgtaggaaccggaacattagcagtatgttcagcttacggcagtgatccattttacggtgaatggactttatatgccttgctgataacatttcctgtgtcagttttgagctttgtctgcagatatactgatcccagtatatggcccgctttattgattcagtttatgatgtttttaagcacattttttgttttatccttatttataaaaagtaagccggataattagaaatgattttcagttgttttaaaaagcaaaaaactattaaacattgacagcctttttatttttcacattctcatttaaaaaaacacagtctttatcatcatgtgatcccttcacctgatattttgcctcccattcttccagcaaatagagaataggcagcaaagccaaacctttttctgtaagtgaatattccacacgtggaggaagttctttaaactcttcacgaatcacaagtccatcagtttccatttctctaagctgatcggtcaataccttcctggaaatgacattaatgcgtactgccagttctccaaaacgtagcttcctgtctttaatcaccagaacaataataggcttccatttacttcctaaagcggccattgccttcccaagagggcagctgtattgcattaattcattctttttcatagagagatctttattttaaaagacatatgagatcatgtttcatatgttactttgatgttactaatgtaagttactgcgaagttaccactatttttttaataaaagatacaaaagtgaactattattagttactttgtgtaacaattataaaatataaatttaaatatgaacacatcatcattatttaaaccgtttcaatataaaaatctacagcttaagaatagaatcgtaatggctcctatgaccagagcacagtctgacaatggagttcctacgcagaatattgcagattattacggaagaagagcagcttcagaagttggattgattctttctgaaggaactgtgatcaacaggccaggatcaaagaatatgcagaatattccggatttttatggaacagaagctttaaacggctggaaaaatgtaatcgatactgtacatcataacggaggcaaaatgggacctcagatctggcacgtaggagatacaagaatgtctgaagattatcctctggttcctatggaaaaagcttctacaatgaccatcgaagatattcaggataccattgcacagtttgccgcgtctgcaaaatccgcgaaagatcttggtttcgattgtgttgaaattcatggggctcatggatatttgatcgaccagttcttctgggaagtaaccaatacaagaacagatgagtatggtggtaaaacactaaaagaaagaagcagattggctattgatgtcgttaaggcgatcagagcagcagtaggagaagactttaccattatcatccgtctttcacagtggaaacagcaggattataaaaccaggctggcattcactcctaatgaaatggaagactggttattacctcttaaagaagctggtgtggatatttttcactgttcacagcgtcgtttctgggaacctgaatttgaaggttctgacctaaattttgccggttgggctaaaaaaattaccgggcagccaaccattacagtaggttcggttggtttaaacggagatttccttaatgcttttgcagggcagggaacagaaaaatcagatcttacggagctcatcagaaggctggataatgaggaatttgatcttgttgccgtaggaagagctattcttcaggattaccaatgggtacagaagatcaaagacggcaatacagaagctcttcttgatttctcagcagaaagtatgagcgttttattttaatatcaaggaatgatgtttcgttttgcttgtcaatttttaacagcataattttttggctagcgaggtagaattatcgactcaaactggtattaaatcagcataattcactttattttatatttaattttcacctatttattaaagaacccgatttcagaacttctgaaatcgggtttttaacagatttaaatatctaaaactgcccgtaaaatggcagaaatgattttcttataaaccaatattcttagttggctttagttgcttcagaatgcttttcgggatagcatttttgtgaacaaggattgctgttgatttgtattcaacataaggtcttgttacgtaaatatatcctgcgaaatcattggttactccccatgaattcttcaccatataatattctttaccagtctggtcttttgccagtcctacgatatgcataccatgatcatccgttgtagaaaggttgttaagcgctttctgacgcatgtcttcagtaattgttttatcttttttaggctctgtaaacaaagtctgcttattctctgcagtaatttggtcaagatccatatccggaacgtaagctacaccgtttttataagagaagtaaggctcggaaacgtcagttgcccaacctacagaatatcctttatttacggcattgtcaataattgctgtaagatctttcatcggaacattccagtcagaatcatgactccagttatcaggaatcggaactacaaatttctggaaatatgggtaatctttgtaagaagataattccacataatcttcaggattgattcctacaacttctttagcaaatgttttcggagtatagtttttcccttcgtaagtgaagttggcaggtacttttcccaaatattcatcaagaatagcatctacagaatccatccagttatcggtcagttttccttttgaagaagcctgaacaaggctgtcaagaaccggtttcagttttccctgcatttccttgaagttgttggtagtctgtcctgcttttaatcccgtgtaaacatcctgaggaacggctccgtactttttgtacatattgattacatcgtgaagttctcctccgtcaccccagctgatagcaccattattcaaaacatataattttgctttatcgtggtaagagtttcttgccgtaaagatttcagcaagatctaccggttttttgcccattctctgcatttcagattcaaggaaagagtttcctgagtagctccagcaggttcctgatgaaccctggttctttacagaagttgcgcccacgtcctttaacgttgtgaactgaaaattagcattttgtgattggttgttttttaacttgttgattaagtcatcttgggcaaacatcatacttcctgcagacaaaacaaaaagtaatgatgcaattttggcatttttcattactataaaaagattatttatattaagagtcgttgataatagagatttgttacagagggaaaagttaaatttggtatgctaaaaaatatgataaggtacatggtaaaaaaagaaaatatttatttgcaaattgtcttttttacctttttgccaaaaaaaagattatgtttccaactctcaccaaagtttctgcatctatactcatataactcctgactatggaacgagaattattattagaatgccagcgtagcgatcgcaatgcacagcgggaagtttacgagaaaatggcgggtaggctgtacgcggtctgcagacgttatctgaaaaacgatgaagatatagaagaagtattggcagatacattctataaaatctttacgaaaattacccagcttcataatcccgatacttttgaggcctgggcgagaaaaattgcagtgaatgaatgtctgcagaaattaagatccaataaagaactcttgatttctatagaagaaaattatattgatcattctgaaggtaatgcagataacctttctctggaaaaagatattttaagtttactcaactttctccccgaaggctgcagagcgatttttaatctttttgctattgagggatatcctcataaggaaatagccaccatgctttccatcagtgaggggacctcaaaatcccagctcaattttgcacggaagaaactgcaggaacttttagcaaatcaaaacatttaacttttatgacaatggaaaataatcatatagatcaacaattcaatgaagcgtccaggctttcagaagagccagctgtttttcctggttttgagaaggtatgggaaaagattgaagagaaattagataaaaaagaagaaaaaaagagaattatacctctttggctgccttatggtattgcagcaagtttgatgattggtcttggggctttttactttatgaataaaaaaaagactgcagaacctttacaacctgtaattgcagagaatacaagttcaagtggcccgattaacaaaacggatattgcaaagatagacaggactatcaaggagaatatcagaaaagaagaattgtctgtatctgtacctcttcctttggcgcatcagccttcaccaatgataggaatgaatgtatacaagtctccaattacctgcaatataccaccaatacaagctcccgatagaatactttcatctctatccccaatatataatgataccttacaaacaaaacaaattgaagaggttgtaatgatgggatattcaaaagtggttaaaagaaaggatgtgacagcatcgagtaccattacaagttctgtcagcaacttaacaccacaacctgctgcttattcttcattgcagggaacagttcagggaattcagatcaatgggacaggaaatcagggaattaatatcgctccgggatatattaataataatcagttagtgatcagaggagctgcgtctataaaaccggaaaataaagctttgtatgttgtgaacggaatggtaacaaaagatgaatatttcagaaaattagaccctaacaaaattgaaaatattaatattctgaaaggaaattctgctacagcaatctatggaagtaagggggccaatggagtcattgtagtgactaccaaagatctttccagaagagaaagaaaaaaactgaaaaagctgcaggaggaaattaacaaacaacagcagattacaccggttactcaaaataatgaaagctatgatgcttttgttgaaaatccttttgaactaacccgaaaccagcctttgtctactttttctatagatgttgataatgcttcctattccaatgtaagaagaatgatcaataatggtcaggtagtcgataaaaatgccgtgagaatcgaagaaatggttaattattttaaatatgattatcctcagcctaaaaacgaaaatcctttttcgatcaatacagaatacagtgacgccccatggaatcctaaacataaattacttaaaataggacttcagggaaaaaatcttccgatggataaattgccagcctctaatctggtgttccttattgacgtttcaggatcaatgagtgatgaaaataaattaccattattgaaatcttcctttaaagttttgctgaatcagctcagaccaaaagataaagtcggaattgtagtttatgcaggaagtgcaggaatggtattgccgccaacttcagccggagaaaaagataaaattattgaggctctggatcgtcttcaggctggaggaagtaccgcaggaggagcaggaattgaacttgcttataaactggcgcaggaaaattttgtaaaagagggtaataatcgtgtcattatcgcaacagacggagatttcaatgtaggaacgtcttctacctcggatcttaaaacgctgattgagaacagaagaaagtccggcgtttttcttacctgcctgggttttggaatgggcaattataaagataataccctggaaacccttgccgataagggaaatgggaattacgcctatatcgataacatgcaggaagccaataaatttctggggaaagaatttgcaggaagtatgtatgccattgccaaagatgtgaaaattcagattgaatttaatcctgaatatgtaaaatcataccgcctgattggttacgagaacagaaaactgaaaaatgaagactttacaaatgataaaatagatgccggagaattgggaagcggacacactgttaccgctttgtatgaagtgattcctgcaaatgtaaattcggattttgctcctaaagaaagtgatctgagatatagccaaaacgcttcttcaaaaggattcggagatgagttggcaaccataaagttcagatataaaaagcctgacggagatagcagccgggaaataacccaggtggttaaaaattctgataacagaatatcttcagcaagtccggattttaaatttgcttcttccgtagcgtggtttggcttagtactcagaaattcagaactgattacgaagaaagatctttctgatattgaaaatctggctaaacaaggcaaaaataaagatgaagaaggctaccggtcagaatttataaggcttatagagagctataaaaccgttcagaagtgattttaagaggagagatttcttccggcaatttctcctctatattcaaagaaatctgttttatttaataatgatggaagtttaaattaattttaataatttcctgccgaaattaatagtagatgaaaaaaattgtaataaccatgttagggcttgccgcattgacaagctgtaaaactcaaaaaaacattgaaacatctggtgaaccaaagacttacagtgttcgtaaagataaggatcaggatggaattcctaataagctggataagtgtcctgatattgccgggcctgtagaaaatgagggatgtccttggccggagtcggatggagatggtgttattgataaagatgacgcatgtcctacagttgcgggacctcctgaaaataatggctgtccatggccggacgcagatggagatggaattctggataaagacgatgcctgtcctacggttccgggattaccggaatataatggctgcccaaaaccgaagtcagttacagcaatggaagtagaatattctataaaattccatgaatcaggaagggtgtatgaccatcaggttggtgacaaaaaagatgttaaaaagactacaaaaaaaactggtcaggatattgattataacaatgaagaatatgtagcgttagttgaaaatgcatttgaattaacccgtaatcaacctgtttctacattctctattgatgtagacaatgcttcttattccaatgtcagaagaataatcaattacggaggtaaggttgataaaaattcagtgagggtagaggaaatgatcaattattttaaatatgattatccccaacctggagctggtcatcctttctctattaatactgaatatggtaattctccatggaatcctaagcataaattacttaaaatagggcttcagggaaaaaatattccaatggataaacttccggcctccaatattgtttttcttattgatgtgtcaggttcaatgagcgaggaaaataagctacctttgctgaagtcttctcttaaagttttactgaaacagctcagacctaaagataaagtaggaattgtagtatatgcaggaaatgcaggaatggttcttccctctacatcagcaggagaaaaagaaaaaatcattaaggcgttagataatcttcaggctggaggaagcactgcgggaggagcaggaattgaactggcttacaaactggcaaaggaaaactttatcaaaggaggaaataacagagttgttctggcaacagacggtgattttaatgtaggagcttcttctacgtcagatatagaaacgctgatcacagaaaaaaggaaaacagggattttccttacctgccttggttatgggatgggaaattacaaagacaataccatggaagttctggcggacaaaggaaatggaaattatgcctatattgataatatgcaggaagccaataaattcctaggaagagaatttgccggaaatatttataccattgccaaagatgtaaaagtgcagattgaatttaatcctaaatatgtaaaatcataccgactgatcggttatgaaaataggaaactaagaaatgaagactttgccaatgataagattgatgcaggagaactgggaagcggacatacagtaactgctttatatgaagttatcccggccaacgtaaattctgaatttaccccaaaagaaacaaaattgaaatactctgaaatttctaaaaagaagaactttggagatgaaatggcaacagtaaagttcaggtataaaaaaccggatggagataaaagcattgagataactaaagtgattaaagaagataaatcttcagtgagtcaggattttaaatttgcttcttccgtggcctggttcggtttagtcctaagaaactcagaactgattacaaaaaaagatctttccgatattgaaaaccttgccaaacagggaaaaagtaaggatgaagaaggctatcggtcagaatttataaggcttatagagagttataaaacaattcaaaaataattcataaaaaaagaaatttccacagaaatttctttttttatatttttaagcatactaataactgatgaaaaagaattatttgctgttattgccgtttacaattaccttattacaggcacaaaattcacaactctattacactggaaaatttttaaccacaaaaaataaagaacagaattttttaaaagtttataataaaaacagtggtatatatgaactgactgatgagaaaggatttgccattattgcagctaagccttatgatacacttgtctggaatcgtggcaaaaatacccatattatagcttcttatgaactcagggaattaaaagttattcttgaaagtcagacggaaaagaaaagagtagaaaatgttcatagcaaagattatgacagccttatttcaaaggaaactaaagatgatttcagtattgaaaaaaatgagaaacatttaagtaaaagctcacactcttattttgatcagataagaaaattaaaacaaaaaaatgacagcatttacatcctgaaaaaacttaatcggagaacattactgttgaatggaagctttactacctcttttgatattaaaagcaggaatgcaattcccgcaacccaaagcagatatgtgcagggaagatcagaaaccggaaaccttgtttggagaggccctgaaaccaatgaaatgttcagttttggaccggatatttcaacgctgggatttaatggattagcttatgaatacgatcagaatggaaaactgattccatggattgatggacttcagcgagcaaaaatatatgacaacaacctttttaaaacaacggtaggatacaacaatcagctgaatgtaaatgcttttataaaagaaggatacaatgagaaaatccggctttcactgaatctgggacagcaaaaaaatcaaatgtattttatagatcagtttgatattgcgaatacctttaaagcaaagctgaatacagaactgggtggatattacattaatctagcatttaattatgaagaagataaagcaaccaacaccaatagaataggacttttcaacagggtataccagaattcattgctcactcctgtttctttttccaatgaacaaaatacttttctgaataacggctcacaaagaagttacagcaaatatgcagacaacccctctttcctttttcagcaggacagtaaataccattatcagaaccgtgaaaggcagtttagtctcaatgcagcaaaaaactggaataattttaaactgaatatcagtcagtcctatgaaagtaacaacatccggaatcttgatcagtataaacccactgcttacgggttcaacaacggaatacaaaatgaaaggattcaaaacaacagttcatatcattccaatattctggggtcttatactttgggcaattatgatttcaaaaatatcttcagcctgaattttatcttaaatgataaaaaatctgatgtttataacagcctgacccatcgcaagtacttctaccagagaacttcacaggatcatatttttaattataatttggaaatccgtgattatgattttgaagcaggctttaatcttgggaattcattttacatctccaatacttcccttaaaaataattattggcttccaaaggctaacttttatctgaagtttaatgacatcttcgattggaataattacagtttcaaactactgggaagttacacgcagctaagctccgagcctgaaattacaagatcatatgccgcttatgccactacattgctgaatgcagaaaattataatcagtactttcctgtgcaggaagtagaaaccttcaaaggtttatccaatatcaacaccaaagaatggaaagctggagccaggctgaacctcgggtattatataagtctggatggcgaatatttcaacagaaaaagtataaacgacatatttcctgtttttgaaaataatcagttgaggttgaaaaatatagcagaccatacctacagcggatatgaattcaattttgcttatgataggctgcgacttggatatgacgcgtatgtaaccaacaaggtttcattttttaaatataaggacatcgtagatcatattttacccggatatcagaatatggccgtttccggttttaaggatatttacaaaacactgttggaaggacaggctttgggagttgtcatgggaagttattttgagagaaatgcagccggacaactgatcattgatgagttcggatacccgaaaaaagcaggaggaatgaaaattattgcagatccaacaccggattttgtgatgaagttcaatcatagtcttgcttataaaaacctgtctctggatatcaattgggaatggaaaaaaggagggcagctctggaatggaacccaggccgttctcgattattacggccgttcttatgaatctggagaagaaagaaatattaagaattatgtttttcagggggtagatgtcaatggaagtgttaatcagattcctgtagatttttacgacccgtaccggagtgttcaggaaaacagatggtcaagatacggttatctgggggtggcggaaagttatgttcaaaaggcagattatataagaatcaacaatatttcgctctcatccactttccctgttaactacgggaagcagaatcttaaactgaccttttacgtaaacaacataatgctttggcaggccagtaaaggagtcgatcccaatcagaatttttatgatatggataacgggagagggctggattttttcaaccttccttcctttaaaaccttcggatgtattgtttcatttaaattttaactcatgaatctcaaaattatatctacctatatcatcctgttgggcttgttattatcagccttttctctgaaagctcagcagtcattccatgactttgaaaaagaaaaaacgtacattcagaccaaccatgttttttataagcctggagaggaaatgtattttaaaatatatgtggtaaaaggaattaataaccttccggtggaggaaagcagagtggttaattttgaaatcattgatccggcaggaagtgttcttaaaaaattgaaatatgaaattaccaacggctatgcacagggctatttctatttttctgaagacatgaaaggcggaatctacaagatcagggctttcaccaactggatgcagaatgaagaagggaaaaatacctttgagaaagaaattactcttcagaaaatcgtatctccaagaattcttatgaaactggattttcctaaaaaaggatatggaccaggagacgaggtgaccgccgatttttcaatgagaagtctgagtaaccttccaatccctttttatgaagccggttacacggtaatgtacaacgggaataccgtttccgagggaaaatttattactgataaagaagggaaaaaacttttgacatttaaacttcctgaggtattgaaatcttcagacgcacttctgaatattaaagttgattttgatgggtttacagaatccatttccaggaatattccgattgttctgaataatctggatgtgaaatttcttcctgaaggcggaacttttatcaacggaatagaacagaatatcgcatttaaaattctggatgaatttgaaaaacctgtagatgctgtcttggctgtttacaatcagaatcatgaaaaaataaaggaaatttcagcctataattttggaatgggaagctttcgttttatcccgaaaaatggggaaacttactatgcaaaagtgataaagcctgaaaatattgcccaaacttttaattttccggcggcaaaagatgaaggattgattttaaatattaaaaatgaaaacaaaaaactgatttttactatcatttcaacacaggaaaaaacaattatcctgaaaggaaatttccgtggaaaagaagtctattccaaagttattccgttgaaaaatggaaacaacccactggaaattcctgagaaagactttccggcaggaatctgcagatttaccgttctggaaaataatgttcctcttgcagaacgtattgtttttaccaataaagaaaatcagctgaatataaaggtaaagcctgtaaaacagcattatctgccaagagaaaaggtagtcctggacattgaaaccacggatgaaaataacaaacctgttcctgctaatcttggagtaagcgtggtagatgataaactatggacctatgctgacgacaaacagaatcatattgtttcctggcttctgatggattctgagctgaaaggaaaaattgaaaagccacagttctattttgataaaaaagaagaaaaagcggataaaagtttagatcttgtgatgctgacaaacggttaccgctattttgagctcatcccggaagttttgaaaaccgataaatacaaatacctgccggaaaagaaaaatacaatctatggagtagtagaagaccaaaataaaaacccggtaaaagctgatgtttttcttttgaataccgacagcaaaaaaattctcaaacaaacagttgcagaagatgggaagttctatttttcagatttaaatgcagatgattcatataaaatcattgctaaatcttctcagcctaaacatcaggttaaaatcaggattttgtcttataatctggacattaatcctttagtaaagcaaaaaatgtctcatatagatgtggaagaaattgtaaaggaagctgaaaaaaaagaggaaataaagactgagaacagaaataatacccaaacattgaataaaccgggacgctcaagatctgataccattcagaatcaaagaattgaagaggtagttgtagttggttacaatatgaataaagagaaagcagcggttgcttccacaactataacatcttctgtggaaattcagaatcccaatgtaacgtctctattgaacggaaaagttgcaggaatcgttataacaccttcttcccaacagggagcaggtgagcagatcaatatcagagggacagcctctattgccaatagaaatcctttattcatcgtagatggcgtccctgtagaaaatttcaataccaccatcaatccgaatgatatcaacagtataaccgttctcaaagatgctgctgccactgctgtttatggaagcagggctgcaaatggagtcatcatcataaactccggtaaaaacagcagctcaaagatcagttttgatatcactccggaatcttattttgccatacaggccgtcccatacggaaaacttgtctcatacgctccatcgagagcctttgcctatcctgaatacaaaactaccaatacatcctatcgttttgattacagggaagcgctttactggaatccggtagtggaaaccgataaaaacggaaaggcaaaagtggaattctataactcagatgccacttccacatttagaattatgacagaaggtattgctgcatcaggacttgcaggaaaagatgaaaccacctatgctgcgcagagccttatttcaatagatgcgaaaattcctcagtatctgacaagaactgatcagatgataattcctgttgtcctcaaaaataattcttcagaaaccagaaaaatgaccatggatgtcattgttcccaactatgtcaaattgatgcattctgatagcttgattactctgaaaccgttagaatcaggaagattatttgtcaaaatacagactgatgaaatagtggcttccaatattcagtttaccatcagatccggagatttcagggaaacgatgatcttaccgtttaaagtagaagaaaaaggatttccacataaattttccattatcaataataaaacggaagatataaaaatcaatattccggaatatatcaacggaagtctgttttcctcatattatgtatttgaaaatgctgctttacagatgtttgataatctggaacaactgaagaaggaaccttacggatgctttgaacagctttcctcaacggtgtatcctaatatttttatcctggattatttaaagtcgggcagaaagatcgatacatctacggaaaatctggtggttaaaaatatgaaaaaaggcttccagaaaatgctgagctataaaaataaagacggtggtttcggatatttcaacagtgaagaatcagatgtggcagtttcagcatttgccttattggaatttactgatttaaagaaatatgtcaatcccgatgttaaactttttcaagggctgtcttcatttattttatctaaaaaaaatggaaacggattatttgaggtaagaaaaggctatgagttaaaaaaggaatattctgagtatttctgggctagaaatatgtatgttgtatatgctttatccagatcgggctttaaaaatgaaattgaagactcttttaaagtaatgatgaaaagagctctcgccacaaaagattcctatcagctggctttgctggccaataccgctgctcatctgggaaaacagaaagaatacgatgatctgatgaaaattctggacctgcagtatgaaacaaaaaatataaaatgtgacattaccttcacaggttcatggtggggaagatctgccgaagcggaaacgctttccttatacattatggcgcttcagaaagatgaaagccttaatcagttgaaaattgcagaagcagcagatcagcttattaatctcaatggatattacgggtttggctctactcaggcaacaacattagccgtgcaggcgttgtcagattttttgtctaaaaatgagaaattatatggaacggaaaggccgataattaagattaatcaggcacaaactacaacgatgatgagcctttcttcagcatttaaggccggagaaaatatgatcagcattcattatcctgctaaaaatggattgccttataaactcgaatatcaatattatacccttcaggccccggaaagcaaagatattcctgttattatggaaacaaaactgaaatcagaaacatcaaaagtaggtgagaccaacagactgactgtcaccgttaagaataagataagcggccagctaccaatgaccattgcaaagatcggtattcctgcaggactgacattgcaaaatgctttactgaaagacctgattgataaaaaacagatttcctattatgaaatctttgataattatatggtgctgtactgggaacaccttaatgcggaagaaacaaaaaccatcaatcttgatctcaaagcagagtttgcaggaacatatactgcaaaatcaagtaatgtgtatctgtattatatgccggaagcaaaacactggaatcagggaattactacaagtattgaaccttgatgttataaataaaaaacaggctccttcatggtggtctgttttattttaaaattaattttcaaaaattattgaaaattcaaaaaatataattacatttgttacaggaatttaaaaaacagataacatgcagctttcagaagccaaagaaaaatacatccaaacctgggggacctttgctaccaattggggaattaaccgtacaatggcacaggtgcatgcattacttttggccagcaacagacctctttctactgatgaggtgatggaacagctggaaatttcaagaggaaatgccaatatgaaccttcgcggcctgattgattggggaattgtaaaaaaagagctgataaagggagaccgaaaagaatatttcgtggcagaaaaagatgtctggtacttgttcaaacagattactaaagagcgcagaaaaagagaaatagaacctgtaatttcttttctggaagaattaaaaaatattgaggataaagattcggaagaagctcaggaattcatcaggctgatgaatgacttcagctcggtaaccggaaaaatcaataatattatggacctggcgataaaaagtgacgatcactggttggtaggaaagattaccaatctgttgaaatagaaaattgaaagaggatgaaaatccttttttattttaatttaattttcaaaaattactgaaaatacaaaacttataatatcatgaagaatttttttaaacgttatctctatttaagtctctttctgactgttgttttaattgttgcagtctggttttttctcgttgccaaaggtgaatatggagtgacaatgttttttactattcctgtttccattggatttattatcggatatgtaaagtttttcaaaaaaatcggattaatgaacgttctgaagaccattttgaaaatagtcttaggattaggtattttctctctgattttgataggagctggcgtagaaggagctatttgtattattatggctattccatttattggctttgctatgtttgcaggcttcactattggttttagcattggggttcttgatgaaaaacggcataccggaagtgtcatagtatttattctttttatcaatcccgcatcttatatttttgatagctatacaaaacctattgaggaaactattacgacagaaatgattgtgaattcttccaatgaaaaagtatggaaacgtttaaatacacaaattaatttcaataagcctgattttatactctttgaaaaaggagtcagttacccaaagaatataaagctcgttaatgaaaacggaaaattaggctacagctgtcagactaataatgatcaattacaacttaatatcaatgaattcatagaaaataaaaaagtgaaattctctctggaaaatcagactgttcctatgaaagaaataacaccttataaagatattgatgccaaacatttgcatgattattttatcgtgaagtatggcgagattactctagataaactgtcagaaaataaaacaaaagtagtcgcaaaaacaaaatacagttacaaaattgcacctatctggtattggaaaaaatggtccggctatatcattgataaaatgcaaagccatgtattacaatctataaaaacacaatctgaaaatgaatgatctgcaacaatactttgaccgcatacagcccagatattatattaatgaaatagcgtccctgggttttaccagactgttcaggaaaatggccgttcaaaaggttaaaagctataaaaacaaaagagttcttgatctgatgagtggccagggtgaaaatctgaaatttcttcgcgaacataatgagaatacagagattataaccctggatttttctacagcaatgaatcttaagctattctcaacatttaaggagaaattattcataagacagattcgggatgacttttttgaaactaaaattccagacaattcgatagacattattctttgctcttacggaacaaaaacaataggagaagatcaaaaacttgttcttgcagacaggctgtcaagaattgttgatgagaaaggtgaaatcatcattgtggaatttgtaaagccgaaaacagcctggagattcacttgtgttaaatggtatatcgaaattattgttgcaaagctcttcggaagtgagtttggaaaattatttcattatatccataaaaatgaaagtctgcaagacttaaaaaatcaatttgttatcaaccagctttcagtagtttctcataagagatatttagatctcgtggaaatactgcatgtaaaaagaaactagttgtattaatactgatttcaagaattgctgaaaattttaaattaaaatgaatatgaaaaatctaatcattcacctgttcctggttatttatttcacaagaaaaggatcattataaagtaaaacgctaacaattataaaaccatttgaaatgtcaaccatctatttaaacaccgtaatcaacgcagatattcattatgtctttgatctggcgagaaatatagacttgcaccagcaatcaacctcaaatcccatgaaaaagcaattgcaggccgtacctcaggactgattgaagaaaatgaaactgttacctggagggcaaaacatctcggagtgtatcaaaatctcactacaaaaattgtcagcatggaaaaaccgtttcagttcattgatgtgatgcagaaaggtgctttcaaatctatgcgccacaggcatatttttaaatctgtaaacggaaaaacactcatgacagatatttttgaatttgaatctcctttaggtatcattggaaaattattcaatgctatttttctcagaggctatctcaaaaaatttctgattcaaagaaatgaaatgatcaaaacgattgcagaatcttcccttcgggacggaattgcagttttttaatgctaaaaattacagttatgaactttttaaaagcagaatggcgaaaactggccatcatcaattatgagatcaatccagaaattttgctcccataccttccaaaagggacagcgttagatttttataaaggcaaatgttatgtaagtcttgtagcatttatgtttttaaatactaaactattggagcttccagttccttttcaccggaattttgaagaggtaaatttaagattttatgtaaagaaaaaagaaaaaggaacctggaaaaggggtgttgtatttattaaagaaattgttcccagaccggcattaagctttgtcgctaataccatttacaaagaaaattatcataccatgcagatgaaaaacctgattcatcaaaaagatgatgagctgctgatccggtattcatggaaagataaaaactggcattccattcagattattgcagaaaatgcaccgagacctatggaagcaaactcagaatttgaatttatcacagaacattattttggctttacaaaaaagggaaataccacttccgaatatgaagtatgccatccgaaatgggactgctatactataaaagaccatcagttggacattgattttcaaaaaaattatggaaataattttgaatgtctgaatcaccggaaccctatttctgtcatgttagcagaaggatcagaagttcaggtcaaaaccaaaaaatatatcagctaaaaatccaaaaatcaaaggaaccctgttcacaatcatcaataaaatctgtggtatctgcaggaaaaactaaccataaaagtcacaaaacttttttagagacttaagatgaagataatatcattgtgcagaataagtacacaaaagtttttaaaatcttcgattttataagtgtaaaaatatttaaacatacacctctgtgaaatctgtggttaaaaccttaaacattgaatctgaaactttaaactttaaaacaatgaaaataatcatagccggaggcaccggatttcttggtaaaagcttagaaaaatactttacagaaaaaggagatcaggtatatattctgacccgtaatccaaaacgtgaaaatgaaatctattgggatgcccaaaccataggagaatggaaaaacagccttgaaaatgcagatgttctgatcaatcttacaggaaaatctgtggattgtcggtatcatgagaaaaacaaaaaagaaatctactcctcaagaatcgacagcacaaaaatactacagaaagccgtagatcagtgttctgaaaaaccaaaaatctggttaaatgccagttctgcaaccatttatattcattccgaaaaaaatctcaatacagaggaaaatggaattataggagatgatttttccatgaatatttgtaaaagctgggaaaaagaattttttgatgtcaaaagtgaagatatacgaaaagttgccctacggacttctattgttctcggaaaaaatggcggtgcatttccaaaactgaaaatgattacaaagctgggattaggtggaaaacaaggaagaggaaatcagatggtaagctggattcatattgacgatttctgcaaagcagtggaatggattattcaacgtgaaactatttcaggagttgtcaatctaaccgctccggccccggtttccaatgaaaatatgatgaaaaaacttagaaataaaatgaaagtaccctttggactcaacgcaccagtctggcagctggaagtagcatccatatttctgaatacagaaacagaattactcttaaaaagcagaaacgtttatccggaaaaactcattaaaaacggatttcaatttatctattccggatttgaggaagccattattaatctcttggaagcctaatgtttgcgggtttcccaaaggataattaaattagcggaaaactattccatatgccggttaaatccaaaataaaaccctttttcctttcctcttttttaataagttcaatagcattttcgcaggctcataatgtgtctgacggctatcagaagcccacagatcccttggtagcccaaaatctggagcagtggcaggatatgaaattcgggctgtttatgcattggggaacctacagccagtggggaattgttgaaagctggagcttatgtcctgaagacgagtcatggactcaaagaaaacctgaacacggaaaatcttattacgaatatgtaaaaaattatgaaaatcttcagacgactttcaatcctgttcagtttaaccctcagaaatgggctgatgctgtaaaaaaagcaggaatgaagtatgtagtttttacgaccaagcatcacgacggatttgccatgtttgatacccaacagtcagattataaaattacctctcctaaaaccccgttttcaaaaaatccaaaatcggatgtgacaaaagaaatcttcaatactttccgcaaagaaggatttaaaataggagcttatttctcaaagcctgactggcattctgatgattactggtggtcttactttccgccgaaagacagaaatgtcaattacgatccgaagaaatatccggaaagatgggagaactttaaaaaatttactttcaatcagttaaatgaaattacttccaattacggaaaagttgatattctttggcttgatggaggctgggtgcgccctttcaacaccatagatccgaaagtagaatggcagcgtaccatcaaagtagagcaggacattgatatggacaaaataggaaccatggcaagaaaaaatcagcctggaattatcattgttgaccgtaccgttcccggcaaatgggaaaactatgtgactcccgagcaggcagttccggaacacgctctttccattccatgggaaagctgtatcactatgggagattccttttcctacgttcccaatgataactataaaacctctcaaaagatcattgaaactctggtgaagatcatttcaagaggaggaaattacctgatgaatattgctcccggacctaacggagattatgatgccattgtttatgaaagattacagcagatttccggctggatggataagaatggatcagctgtttttgccaccagaagcattgctccttatcacgaaggaaattattattatacccaaagcaaggaccatcatactgttaatgtctttcatcttgatgaaaaatccgaatatcaggctccagctttgcttacttttactattccggaaaattttaagcctaaatccttgaaagttctgggtatttcatcaaaaattcagtggaaaaaaacaggaacaaataccattgaaatcaaattacctgaagaaaggaaaaacctgaaatatgcaacggtaattcaaattgcacaataatgaaagttcttagctttaaactcacgggaattgctttattgttgaatgttgtcattatttccgctcagaaacctttatataaagatcccgcacaacctgttgaagccagggttcaggacttgttgaagagaatgacgcctgaagaaaagttctggcagtgttttatgattcccggtgatttggataatgttcctgaagaacaatatgctcacgggatttttggattacaggtaagcgccggaaaccagggaggcggggctgccggccaactgctgaaatacaatgccaatgaagatgccgttaaactggcaaagaaaatcaatgcgattcagaaatatttcgtggaagaatcaagattaggaatcccgattatcccttttgatgaagcattacatggattggtaagagaaggagccaccgcttttccacaggcaattggtctggccgctactttcaattcggatttgatgaacaaagtttcagcagctattgcaaaagaatcaaaattaagaggaatccgccagattctgacaccggtagtgaatcttgctaatgatgtacggtggggcaggacagaggaaacctatggagaagatccttttttaacatcggtgatgggagtaaacttcgtcagctcttttgaaaatatgggaattattaccactcccaaacactttttagccaatgtgggagaaggtggaagagattcatatccgattcattggagtaaaagatatctggaggaaacccatttaattccttttcataatgcttttacaaaaggaaaaagccgctctgtcatgacttcttataatctgcttgacggaagaccttcaacggccaatcactggctgctgacagaaaaactgaaaaaagactggaatttcaaaggttttgtaatcagtgatgcaagtgcagtgggaggcgctaacgtcctgcattttacagcaaaagattatgatgatgcctctgcacaggcaattaatgccggacttgacgtgatctttcagacagaatataaacattataagctttttattcctccgtttctggatggaaggatctcaaaagaaagaatagacgatgccgtttcaagagtgctgagagctaagtttgagctaggtttgtttgaaaatccttatgtatcatcaaaagagattgaagaattaaaaaaacttaaccacaaacccttagcagaaaaaacagctgccgagtcctttgtattgcttcagaacaatgaccatacacttcctgttcctgaaaatataaaaaaaattcttgtggtgggaaccgatgctgtagaagcaagattaggcggatattcaggtccgggaaataaaaaaataagtattcttaatggtcttaaaaattatacaaaagataaagatattgagatcatgtactccaaaggaattgactggaatgtaaaagattttaccacagtttctgatcaatatttgtcgtctgaaaataaaaaagggttaaagggaatgtatttttccaacacagatttaaaaggagatcctgcatttgaaagacaggacgaacagttcaactttaaatggactttatattctcccaatccagaaaagcttcagccggataactacagcatccgctggaccggaaaactggaggctccggattccggtaaatatcaattgggattgcgtgggaatgatggtttcaaactgtatctggacggaaaattaatcattgaccaatgggaaaagctaagctattcaaccaaaactgtcgaagtagattttgaaaaaggaaaaaagtatgacattgcaattgagtttcatgaaaaccgcggtgaagctaatctggaactgatctggaattatgggcagcatgattatcagaaagaatttaaagaagctttacatcttgcccagaaagcagattacattattgttacagcaggaattcatgaaggagaatttcaggaccgttcatctttaagcctacccggaaatcaggaagcgtttattcatgaagtttcaaaattaaataagccaactgcagttgttttgataggaggttcagccataaaaacgacaacatggaaagataaggttggagcaattctggatatttggtatcctggagaagaaggtgggaatgctgttgcaaaaacactttttggggctgaaaatccatccggaaaactgccggttactttcccggtggaagagggacagctgcctttgtcatacaatcaccacccaacgggaaggggaaatgattattacgatctgagcggcgaacctttatatccttttgggttcggattaagctataccacttttgaaatctctgatttgcagttgaacaaaagccaatattcagaaagtgaaacaattatggctaaactgaatgtgaaaaacacaggaacaaaagccggaagtgaagtggtacagctttatgtcaaaaacctgttggcaaccgtttcaaggccggttattgagctcaaaggatttcaaaaagtagaattacagccgggagaatcaaaatctgtcactatcgaagttcctgtaaatcagctacaatttctgaatgaacaaatggaatgggtagtagaaaaaggaacctacagaattatgataggaaattcatcgaagaaccttcctttaaaacagaatattgaagttttatgacaataaaaaagagcagaattttctactctttttgtgtatatttctgaagttgtttagtattttctggccagtaaaacgttcaataagaatgttcctgcccagttactgttattagtaccgttggtaccgataaaatctacacgggctacagatacagttagtcttgttctaccgcctgtaccattattggcaaggcttacaaatgatgctgtaaatacatccgggaaacttgagttatttcctgccgtaagaataggatacatattggtaacattgaaaggagtaccctgatattcatatacaatagtcattctgctggcattggaggaggtggcagtatgagctctgtccacagatgttttacttattatccaccatctgtcagtcgcagaacctgaatcaaaggttgtattagtatgattggtccagtctgcaatagctgctgttccgagtgcatgaggaggaataaaaagctgtgtaccataaatttccacgttgcttggcttaggaagaactgtaaaagataaatcccaggttcctgcggaagtattactattgttaaccacttcagcataagctcctgtaggaattacaaaagaagcgacaggagtgttgtcaatccttaatgtattaccgcttgatgcctgaagcgtaatattattaggcgaaatgtttttaatcttataaattcttccggtaaaactcgctgttccggttccgatgacaggaagggtaaatgtggcatcagcagttccgttataagtgatataatgatcagtagccagaatattgtaggttgtggcagtgatctcagtatagccggctcttaatgaaccgtttacggcaagtgtactgttgggagttgtggtattaataccaacttgtgcagttaggggaacggctgcaaataaaaggatcgagatgtattttttcataactaaaatatttggtttctaacaaaaatataaaaaaaacagctaaaaaatcaactgatactgaataaattaaatgtttttggttaaatcccttcctggcgataggagttattgatgaaattcattagatcagcctgcatggtaccttcagatcctcagtaagatagtagctgcaacaaaggcggtgataaccatccgcaatgatcagttcattttgtcccctgaccaataatattggcgaaagttttttatttttttctacttttttaagattttctttcacgtgaatattagtttctggaagcaaagcaagtttactggctcttaaaatgtctttcgattttttgataatggtaggagcagtttttaatttttcaaccagctttcgtgcatcatctggcttgaatagaagttcgagataatcctgggctgccggaaagtcatggtcttctggttccttcagccatatggtgtctttagggatattgttttttttcaaggctttcataagtgctgtttaagataaataaaggtatgaaaaatagattgttatcagcatatttaatttcagatgaatgattggtttgatgtagattttaatttcttttaaaaaatattggtatgatatatgtaagatttatgatgaaccggaatgaatttaatcgagactattggattggttgaaatcattcaaaaatatgaacattatgaaaaagttattaatttcaacagtattgttattaggtttatccatgaatgttgcagcgcaaaaacatccgccagttcctccacacccttcaaagaatgagctggtgaatattaaaatgcaggaacttaccaaaaaatataacaccgagaaaaaactgattctgaaccaccctttggctacaaagcagatgaagagagatcagatgaaagctttaaatgcaagatacgcggctgaaaaacgattacttagacaggcgagataatatagattttttgcagttatttaaaatgtagaagccgttttttatattttcaactttgagaaatttttaatataaagtaaagtttattgaaagagaatacgtattgtgttctctttctttatataaaattgaacaggaatagccttattgatgcattttaagatcagcctgcagaaaaatggaacatccaatatttttccttaaattcgcataaaaatttttaaagtaatgaattacgatattattgtcattggaagtggtcctggtggatatgttactgcgatcagagcagcgcaattaggtttcaaaaccgcaattatcgagaaagaaaatttaggaggaatctgccttaactggggatgtattccaactaaagctttattgaaatctgctcaggtttttcattatatcaaccatgctgaagattatggtttgaataaagtggaggcaagctttgaattcccgaacgtaattcagagaagccgtggtgttgccagcaaaatgagcaaagggatcgaattcttaatgaaaaagaataagatcgacgtaattcttggtactgcaaaagtacagaaaggtaaaaaagtttctgttacagataaagaaggtaaagtaactgagtatacaggaactcatatcattatcgctacaggagcccgttcaagagaattaccaaacttaccgcaggatggtaaaaaagtaatcggatacagacaggcattatctcttcctgagcagccaaaatctatgattgttgtaggttcaggagctatcggggtagaatttgctgacttctataatacaatgggaaccaaagttactattgttgaatttatgccaaacattgtacctgtagaagatgaggaaatttctaaacacttagaaaagtctctgaaaaaatcaggtattgaaatcatgacaaacgcttcagtggaaagtgttgatacaactggtgaaggcgttaaagctaatgtaaaaacagctaacggaaatatcactcttgaagctgacatcctgttatctgctgtaggtattgcggcgaacatcgagaacatcggactagaggaagttggtattcagacagataaaggaagagtattggtaaacgaatggtatgaaacttcagtaccgggttactatgcgatcggagaccttatcccaactcaggcattggctcacgttgcgtctgcagaagggatcacttgtgtagagaaaatcaaaggattacacgttgaaaaaatcgactatggtaatatccctggatgtacgtactgccaccctgaagtagcttctgtaggtcttactgaaaaacaggctaaagaaaaaggatacgaaattaaagtaggtaaattccctctttctgcaagtggtaaagctactgcaaacggaaatacagacggatttgtcaaagtaattttcgacgctaaatatggtgaatggttaggatgccacatgatcggagatggagtaacagatatggttgctgaagctgttgtagcaagaaaactggaaactacagggcacgagatcatcaaatctatccacccgcacccaacagtttctgaagctattatggaagctgctgctgctgcttacggtgaggtgattcatatttaatctgaaatacaaaatcttatatataatgaaacccggagaaatccgggttttttagttgaagtaataagaactttgtcaaaggtctctattctactttaataactttggactgcatttcttcattgagtttataactatcctctataaaatgatattttacaatcttaccatgtactactttaaaaattactacaaactcagtactgaataccttgttgtaggtaaggatttttgaagacagatgtccggtagcggtagcattttcaccattaacagcaataaagtcgatttcaaatttttccggtttgacatttgagtataattctttaaaaaactcttctatttccttcttagtttgccttttacctgtccatggaaatttttgtttattcccgggtaagtcccagtctatataatcagaaaataaatctataatatttccttccttttttccggattgtaaagcaaaaaattcatctacaacctgctttgttgtcttttgagattctttattgatatccggcaatggatttttaaagatatttactctgtctgcatcttctgaagtaaaatcgggatctacataaacatgtatgcgtttgataaattcgtccttgaactcaaaaacattacagaatttaccatgagaagtcctgtaatcgggccattcctttccggatcttgtgattcctctttctgttccctctaccacaatactatggtcagagattacatatttaaaattatcaatatcatggcttaggctttgaagatgggctcccattacttttccaaaattcatgattccattttttcccttttcaaaaccgaatttaggataatacatttctacatcatctgtatagagattaaaatattcctcgtcaaattgcccttcatccacttttttgaaataggttatcactttgtttttgcgaagtgtcgccagatctgtattgttcatatttttttgtttttgtattgctggtttctcctgagctttcatattggtaatgtttataaagatcaggagagtagccgttattatgattttattcttcatttattttatttaaaccgatcgttccggaatgagataaaaaaaatttacttcttaatctgttctattaaaaaatcaaccatttccattacttcctttttattttgagtcaggttataatgactccagaagctgctgaaagaagataagatatagcgggcaataatctgagctgaagttgtacttttgatatttccatcttcctgagcctgtactatcgctttttctaaaatagccagtaaagatttgccgctatttaaaataagctgcctggcttcctggtcttccggaacaatttcaaaaatggttttcaccgtaagacatgctttattatcggttatagtctgttcaacaacatcacggataatgttttcaagcgcggttatgccttcattttttgcttgtaatgcctggtaatattgattttctttgaaatcagaataatttgataagcattttaaaaacaaatcatgtttattgccatacgtatcataaatactgcttctgttcagtttcatagcatctacaatatcgtgcattgaggtagcatgatatcccttttcccaaaagagattgcgggctatttccagtttttccgtatagtcgaattctttatttcttggcatactgcaaatatacaatttaaaccaatcgttccaaattgaatttattattatttggattctttaatagcttgaaaagctggcaattgattcttttaaacagatttttattaaaataattttaaaatcagcatatttattaaaattaacttaattatttcagtccgttttcttacatttattctatgaattttgaaagagttggacttgttttatcaggcggcggtactaaaggaatcgctcatgcaggtgtattaaaattcttacaggaaaaaggtattgaagtagatatcctttcctgttgcagtgcaggatctattgtggggtgccttcatgctataggcaaatctccggaggaaatccttgagtttttcaattccgtctattttttcaactggaagcattttacctttaatcagccgggactggtttcttcagtgattttcagaaattatctgaaacctatttttcatgatatgaaattgggagatctggatatagaagtgaaaattgttgcaacagagctcgttgccggaacccagaaaatttttgataaggattttgaaattgttgatgccattatcgcgtcctgttctatccccggtataacaacaccgtacatcattggtgatgaaatgtactgtgacgggggcgtgctgaacaattttcctgcagatatcatcagggatgattgtgataaactgattggtgtttttgtatctccgcccaatgaagctaaaattaaagatctgaattccattaaggccatcgtttcccgttcctatgatcttctttcctacaggatagaaaaaataaaatttgattattgtgactggtttatttcttcccagaaattagcggcttacggaacctttgagcgcaggaaagacaggcttgaggaaatttttaatatcggttacaaatctgcaaaagagagttacgaagaaagcaacttttttacagaattaaaacaatccggaacataaaaaatcctgtatcaattatacaggatttttattttataaaaaggtaaatttgagtaaacaggctataataacttccagcttctgtcctccagcttccagcctctatgcctcctaatttttaaccgcatatccatcctgacgcacaatttcacggtcattcgcatcatttacaaccaatgtgtaaggggcttttttcggagaatctgtaaggtaatttctccaaacctgataactgtgcccttcattgctgaagttaatgtaataatttcctcccgtaccatcaggtatcagttcgccgtcactgatgatcatacttggtttcgctgtgatctttgcattggcattccatgattggtaaaggtatttgccgtttggctgcttgtcaattctgattttgaactttttggttttgataataacagtctttggcacctgttggatggcagaagaagttataaaaccatctgttttcggattgggaaactctttggcattaacgaaagaaaactgagctaagcagaaagtccctaataaaatatgctttatcatattaaatggttattggttaacatttcagattctatcaaatatagcgccatatttcagctaaatgttctttttaagaacaagtgcgtaaagtttatcacaatgattttttaattataataaatttgtatgagctaaaataaattaaaataattatttaaatatttctttaaactcatctgtgtaagataacttttcataacctaagtgcttaaaatttccttggatgtagttttttatctgaaaataatttttatgatagaattccgatatctttacaattttatttcctgctttatataaataaagatattcgtaagtccctcccttaccagtcagatagctaaatttccaaccctcaatttcagaacttttataagtttttactagaagtccaaaaaatcttctgacaacaacattatctttattgattgttacaccgatacattttgttcttacttctccaaatagtactaaagacgaaaaaataagtatagctgggataaatattcttgggaataaaggcgtactaaaattctttgtaatgaaaattccaggaataattaagataatgagatataatataggaattaaaagtaatggtattaataatgctttaaaagtaaattttgtcttcattattaatcttaaagccgaatctcaaaattttgcgtatagcttgcaaacgcttcttccaggctttcaaatttacctttgaattcatcaatagggcagtcctggagaatatttcctttatggatcagaatgactctggagcaaagtgcttctacttcctgcatgatatgcgttgataataaaacagtcttttgctgtccgatttctttcaccacattacggatttcaatgatctggttaggatccaggccgttggtaggttcgtccagaataagtaaatccggctggtgaataatggcctgtgcaagccctacacgctgtttgtatcctttagacagctgtccgatcttcttcgatttttccggggtaattcctaccagttcaataacctcatttactctggattcagggattttgtgaatgttggccacaaactgaagatattcctttacatacatttccagataaagcgggttgttttcaggaagaaagcctattttctttttactttcaatctcattttcagagatgttcaggccattgaaaatgatttcaccctgatcaattttcagtgcaccgacaatagatttcatcagggtagattttccggcaccattcgggccaagaagaccgataatttcatttttatcaatagaaatgttgatgttgtcaagagcagtctgttcaccaaattttttggttaaattgattatctgaagcggcataaattataatgtctttctgcaaaaataaaataaaaaaactcatccgatggaatgagttttgcattatttataaaatataattattttcttgattttttcttcgcaccgccagatccgggagctgctgtagaagctgtatttgtagtgcctttagctgcagcaggatttatactggctggtttatcatacatcgtgtattttccattggttcttccgaagatcttatccacctgcttttgggttaaaaactgtgattttccaatatatttccggtttttgttgatcacctggataaactgcatggtttgctgcccgtaattcttttcataatgaagttcaatgatatcattaggaagctccaatacgacattctcatccggagtggagacaaagccatccataataagcttatataatccggcaacatcattattaaggttctggaatgaaaaagagcggattgtattcaggttgctggtgttcagatcctggtagttcactgtaaatttatcttcctttttatatagaccaacggaattatctttaccaatttccaccaaactttcatttttcaacactttgatctgtgagaaaactgaaataccgaacatacatgtaataagtagaattatttttctcatggaatgaattttaatgttttataaattggtgcacataaacttactcataaaaaagctaaaaagcaattttattcgttagagcaaaagtaacatttttttttaatatctgtcagagatcatctgccggtgctatggattgcattgcttattcaactaactgtgaatcattaatttgaatgttttttacaaaaaactatggtttcagatggtgacagcgtgataattactgaattaaatataatgcactgaaaaacagtttgaaaaaatattcaaatcaatatttgctaaaaccaatttaaataaatgttaaaaatgtggtttagtgaattaaaattaagaccaagagtgaatgcaatcctttataaaagcttatttaattcttccctcatcaaaatgacaatgatgtagaattgtatatagttgcctttgataataaaactctgtgtttaagaaacttataattcagtaattatctatgaaaaaggcaccatttacaagtaaatgatgcctcgtcactgaatatatttgaatgtaaaattgttttttgttttatctactcattctgcttgatttgtgggttattattaatctctttgttaggaatctggaacctgaatttatccggtgtcagattgaatcttccaaaagtatggttggttcctgtgtatatacgctctaatgggatatttaatcttttcatatcgaaccaggcataaccttcaccccaaagttctattcttttctggagaataatttcattgatcagttcactgcctgacttggtagatagggtataagcctgatccctttttgaagtaatattaaataatacctgtcttgcttccgcttctcttccttgtctggccagagcttctgcctgaatataataaagagaagaggctctgatataaatataatctccctcaaaaagggtaggatctttaaacttccagcttacgtaaggcggataatttttagtttttccattgaaggtatatgctgcattctggctgccattgaacactttcttacggtaatctgttgccggtatagcttcataaagacgcttgtctatcagcttacggatctgcgctgctcctgcatagccttcattggtattatcaaacattgagaagaaagaggcatagtaatttccgatactcatcgtggaaattgtgttatgaaaaccccatattacctccggattattaatgttggaaaatccggtagtggtatagtcatcttccgtcatcagagtaattccctgtttactttctccggcatattgagcggcttgtatgtaatctcctgtttccagaaatatttcggcagcaatagctttagcagttctttgatctatctgggctctggaggggcgtgagtaaccatccaaaagtgaaacggattccacaatatcttttttgatctgtgcatacacctcagcaactgttgatctcggaagtccctgattcggattgcttgccgtaagaaccaatggaagaccaggttcagactggtgtccgttataatcatgggcatagaaacgaaccagataaaagtaggagtaggctctcaaagcaagcaactgacctgcaatcgatctgttttttgcattggcatttttatccaggccatcaagaagtttattgatcacaaatattctggcataaaaagttgtccatacaatttcagaagcgatattgctggcattggtggcttcgtaattataaaacattcccaaatgctggttggtagactggatgacatcgttagacatcagatcagcacccgctttgattcccatgattccgaaatctgagtgcacggtagtgcctcccgcaccattgctgcgaagatcaagatagatcccacccagtattttttcagggctgttagcatcattattgagttgttcaccggaaatatctccgtccggtaaagtattgagatcattggcacagctgactgtaataaaaccaatagtgacagccgttatgaagtattttatttttttcattcctgttctttttaaaaattaagtttaaagcctaatgagacactggacagcagggaataacgatacgaatctgaaactccggtcagtgaagctctcggatcatatccttttctcttggaccacagataaagattgtttcccgttacataaattttcagacctgacaagccggcctgctgtgcaaaaccatcgggaagctgataggacagggttacatcctgaagactgatataatctgacttgatcagataaagtgttgaatttccattctggttcgttgccgtaagatctacccttggcaatgcagcatttggattttcaggagtccatgttttatccagatccgttgaatagttggacccataactgtcagaatggaataggctcctgtagatgtcatcatatccataccctccgaattggtaagcaaaattgactgccagattaaatctcttgtaagaaaaatctgtcccgaacccaccatatacctttggaatggcagatttcccggtgttatagtcggtagcctccttataattattggtaactgttctttcttccttttgagtagtaggatttatcgttgtccggtaccataaagcatccccgttttcaggatttactccggcaaattctttgaggaaataagtataacggtccccaccttctgtaagaataaacaaaccggttacaagacctgtatttctctgttcagccggtaaccgggtgatcttatttttataatgagtggcattggcatacacactccactggaattcatcaccgcgaagaatatccacacttagattggcctgaactcctctgttggtcatatccccgatgtttccatatttcacataagatcctgcgttagacggaggaaggggaagtgtatagatcatatcagaaaccttcctttcaaaataatcagcatttaaggttattctgttttttaaaagggagagctcaaaaccggcattcaggtttttcgaagtttcccattttaaatctttattcccttgcttcttcagagacagaacaggcttatcatctccgaaattattaattccgtaaatgtcctgataggcataataatctctagtagagccgcttaaaagaatgttgtcatttccctgctgaccgtaagaagcttttaattttaaagaattaatcacagagttatccttaagaaaatcttcttttgcaatattccaagctaatccaagtccataaaagtttccccatctgctttccggcgaaaagactgaagagccatctcttcggacgttggcattaaagaaatatttaccatcataattatacagtaatcttgtaaaatagccttctacagcatattcatagccgcttccggataaaccggtaatttttacagcattgtcaaaagcttgtgaatcaggcaataaaagctgttgctttgatcctgaaaaaccatcatctttgatcttattcagctcatgccctataaggagattgaagctgtgatttcccagttttttctgataggtaagtaattgctggtggtttagggtatatttaaagtttgaactttgcgaaatagttcctcctacagaagaagaagttcctccttccgtattcccgaactgcaggtttcttgtattttcgagataagccccgaaattataggtaaaatccagccctttaatgatttcataatttagaccaagattaaggttggtgatattacttacagtctgagatttgtttttttgaaggttgcctacaggattttcaaaaacagcataagatcttgtggcgccgttgggtccctggccgtctccatagtcatatagagcatttccatacttgtcataaagcctttggtaattgttgtcccgcagaaagacaggatagaaaggagcaatatttctggcaaactgaaaagggttggaaaaaccgctggtctcaccaaaatcctgtttgctgtaagtataagataaagcactggttaatttcagttttgaagtgatggagtagtctacattagacctgattccgaatctttcaaagcctgaagaaattaaatatcccttatcgtccagataattaagcgaagtatatgattttacctggtcactagtagcgttgattcctacggtggcttcccttctcaaagcaggcctgaaaagcagtttcttccagtcgtcctgatataataatttcgcatcaggattaaaagaaccatcctttgaaatgagttgattaaaaggaacattataagcattatatcccagtttggtcaatgctgcaaggcctacatcatgaggagaagcaccagacggaacagaacccggttgtttcagccttgcgatttcacctattctggctctgttgtagtaggctgtataataatcctgcggagaagtatacacagaataatcttcaatagatctgaagttaacccctgttcggacatcagcctcaatgctcagtcctttgcttttccctctttttgtattcacaataattactccattggcccctctggaaccatataaagcattggaagaagcatcttcaagaaaagaaatactttcaatatccgatgcggcaatactgttgagatttccactgtacgggatgccgtccagtacaattaacgggtcactggatgcattgatagagccaattcctctcatcctaatggtgggctgggaacctggctgtcctgaggagattacctgtactcccgccacttttcctccaattccctgaagaatatttccgttttgaagattagaaagatccttagccttcaacgactgtacagatcctgtaatctcttcttttttctgctttccaaaggctaccaccacaacttctttgatggaggtttccctggaaaggctgtctttgctttgggcaaaaccatattccgcgaatagcagtaaggccaatacaccaagcttgcattgtttctttttcattatattaatctaggtttaaagttgaattgtgtattactgctgatctctatgtaagaaataataattccctgcctccttttccagggaggatataaaaaaagattaaaatttacaggagatgtatccggatgaaagaagccttgaactttctggctttaattcctacagtaatgaatgtatctcttaaaaagttagcacatcatcatcatgcacatcatatcaaagcacatgtcttgagaaatgcagttgtgctgtgaaaggacagacattccacaacaattttgctgtgcaggagctgccgccgtaatggtgcataggcaagaattaaaggcactcttattcatgagaataaagtttatgatttttttaactgtgtcaaaattatttaataaatgacaaacacttataaaaacagaatatgagataaatcatactagtctactaaattagtaggttaattgattttaattaaatttttaaatcgtaaatatttgatttttaatatattgtttgctgttttgaaaatgttaaaaaatgataaaaaagttaattttcaattatgaattaaaattaaaatgagaagtctatttattttgtagactttttgtttattttatagctgtattttcatgagaataaggatcaggagcttcatcctgctatccgctcatactcctcgcacctggctgaatccactttctgctgtggggtaaccgctgctatcagggctagaataggattataaattataaattatgaattatgaattatgaattatgaattatgaattatgaattatgaatggaagagatatactcaaacatctgtgtttatctgtgtaatcagtgggaaaaatgagaatattcaatagaaacgggctttagcccgtttattaaaaaataaaatttcatctggctttagccaaaaccataaaaaagaagcctgccttttggcagactcctataaaaacaagattgaaaaagaattttattgtttgctgatatccggaactgccaacggagcctggtcccaaccgccacccaaggctctgtagacagcaacactcgctttgagctgattaaccttcttttctaccagctcaaacttagattccagggcatcccgctgagtaagcaggacttccatataatcggcacgggcatatttgaacaggtcgttggaaatatctatagattttgttaaagcatttacttccttcgatttgatgttcacactgctttccagattgtggattttcgataactggtttgctacctcaatataagctcccagaacggtctgttcataatggtacacagcctggatctgtctcgcattcgcattgtaatatgcagctttaatcgctcttctgttgatcaatggagctgtaagctctcctgcaagagaaaacagaaacgactgaggtttgataatatacagcggattaaaagcctgtaacccgattccggcagaaagatcaagagaagggtagaaccttgccttggctgctttgatgtcaagtttggctgctgcaagttcatattctgcctgcttgatgtccggacggttttctaaaagttcagaaggaattccgccatacactgcctgcggaacaacagaatcaaaagaattctgactcctttctacaggctgaggaaatcttcctaccagataattgatcttattttcagtttcaacaattttctgctgaatatcatactgcattccctgagttttcagaacctgggcttcaaatctctgtacagcgagttcattggacctggcgttcttctttaaatctctgataatctccagcgcatcgttctgaattttgatattctgattcagaataaccagttcattatccaatgccagcagctcataataagaatctgcaatctctgaaataagattggtggtcatgaaatttttgccttcaatgctggcaagatatcgctgtacctgagctttcgttgcattatgaagctttccccagatatctgtttcccactgggcctgggcacctactccaaaatcaaataatggttcaggcatttcccggccgggttctatttcggtattggcttccatagctccgatattggtgtagcggcttactttgtctacaccagctccggcttttaaacctacagaaggaagatattccccttttttggctttgatttcatttttagacatttcaatttcctgaaggacaatattcagttcctgattattctgaagagcctgcgtaatcagttcctgaagacgcgggtcactgaagtattcattccacttcatctttcccgtattgatagtgtcattttctgctgaaccatatttttcagggacggttttattttcagcacgctgttctatttcgataggtttacaggcagtaaggcttaataagaagactgccagacctgcatattgatatatttttcttttattcataatggatcatgtcttcgcttaatggagattcatcttcgtctttaatcatttttttaccgtcagaccacttggcaaatatgtagtagagccccggaatgacaatcactccgaatagcgtccctatcagcattcctcccaatgaagatgcgccaatggtatggtttccaatcgctccggcacctcttgcaaaaacaagcggaaccaatcctgcaataaaggcaaaagaagtcatcaggattggcctgaaacgggctttggagccttctactgcagcttcaagaatagaatctcctgcctgacgtcttttcacggcaaattctacaataagtactgcgtttttaccgagtaatccgataatcatgatcaatcctacctgtgcgtagatgtcattttcaagtcccattgcttttaataataagaaagacccgaaaactcccaccggtaaagaacaaagtacagcaaacggaatcaggaaactttcatactgagctgccagaaccagatacacgaataccagcacaacaaggaagacatagatggcttcattaccacgctgcgcttcatcgtaagacaatccttcccatgccactttatatccgtgaggaagtgtttttgcagcggtttcattgatggcttggatagcatcagccgttgtatatcctgctgccggaagtccgcggatcgccgcagaattgtacatgttgtaacgggtaatttcgttggggccctgcgtcttcttcatcgtcataaaggctgaataaggcaccatttcatcacggtcgtttttcacatacaggttcatgatatccgtaggaagtcttctgaattccggcgatgactgtacatacaccttaaagaactgtccgaaacggataaagccctgctcataggtactcccaatcagaatgttgaggttgtccatcgcttttccgatagaaactcctttctgcatggcagcgttattgtcgaataccagctcatactgaggataattggctgcaaagaaggtgaatactcctgaaagttctttacgttttttaagctgtgcgataaaatctttattggctttatcaaattcctgataatcggtggttctgttaagatcaagaagtctcatagagaaacctcctgaagatccgaatccaggtacagccggcggttcgaaaaattcaatggttgcgccgaggtcttttgatttttcttccagttctttcatgatctcctttacagaatggtcacggtcattccagcttttaaggttgatcaggcaggttcccgcattggatccacggccttctgtcatgatttcatatccagccagtgatgatacagattccacaccgtctacgcccatacagattttctgcaatgttctggaaaccttattggtctgttccagcgtagatcccggaggagtctggataatggcataaatagttccctggtcttcattagggataaatccacctggaagaactttgttgattacaaaaattccggcgcagaaagcaatcagaattccccatgtcaccacttttcggctgacaatttttctgaggaatgaagcgtattttcctgttactttgtcaaaaccgctgttaaaagaatctaaagctttagtgaaaatatttacctttttaggttttccatgatggtttttcaataacattgccgccaaaacaggagtcagcgtaagggctactaccgcagaaattactatagaacttgccatggtaatagaaaactgacgatagaaagttcctacaggacctgtcataaacgagatcggaatgaatacggctaccatcacggctgtaatggcaataatagctccggcaatttcacccattacttcttttaccgctttgtaaggtgaaatattactgtcttccattttggcgtgaacagcttctatcaccacaatagcgttgtcaaccacaataccgatggccaataccaatgcaaaaagggtaacaagattgatggttaatccaaaaaactgaatcacaaagaacgttccgatcagagaaacaggtacggcaataataggaatcagggtagagcgccagtcaccaaggaaaatgaaaaccacgatggcaacaaggatgaatgcatctctcagcgtgtgcattacctgttcaatggaagcatccaggaattgggaaacgtcataactgattttataatcaactcccggagggaagttccctttcatttctgcaagttttgcctttacgtctctgattacatcattcgcattacttccgtagttttgttttagcacgatagaagcggaaggatgtccgtcaagattggaataaatatcaaagaattcacttcccaattctactttggcaatatctttcagctttacattctctccttcggcattggaacgcacaataatattttcatattcttccggtttgttgtattgccctttataagtcagtacatattccagtgactgtgcagcaataccggaactttgcccgattcttcccggacgcccgataatactttgttctccaatagctttcatcacctcatctaccgagatatcataagcacgcatacggtcggggttcagccagatacgcatggcatatctccggcttcccaggatctgagattttgcaatcccgtggatacggttaatttccgggatgatattcaccatagagtagttgtacaggaacttttcatccatacttttattcgtactgtaaagattcacgtacatcagcatactcggctggatagggtttaccacaaccccttctttctgtaccagttccggtaataaaggcattacctggtccactctggtttttaccagaactactgcctcattcggatcagttccgggatcaaaaacaacgtttacagtagcttctccggcactggtggcatcggttgtgatgtagcgcattccctgaactccgttgatggcattttcaatcgtaatcaaagatgattttaccaatacatctgcacttgctccgggataggcaatggaaactgctactgtggttggggcaatcttgggaaactgctccgtaggaagctgcttcatggcaatccctcccataaacaggattacaaccgatatcacaatggcgaagaccggtcggtgtattacttttttaaacataatgctgctttggggttactcggcgtacagatccaggttagacattactttttcaggcttttgatattttgagctgatcttttggttttcctgaaccattctaagaccttccagaaggattctgtcatcctttccaagcccggaagcgactacataaatatgcggtaattcggcagcaacttttatttctctggcatgtactttaccatctttaccgatcacatagacatatttcttttccagctcttcgaaagtagccttctgaggaatcatcatagcattggcgtaaggtgacgtaatgacgatgtttccggtttctccgtatctcagcagtcctttcggattcgggaaagtagctctgtaagcgatatttccggtctcattgtcaaaatcagactctatggtctgtacaataccatcttgtgtaaactctttcccattggccattctaaggcgtacatgcatcggactgttatcctttttcgcatccatctggttaagatattcagcttccggaacattaaaatagacccacattttgctgttgtcggagagttccgttaccagttccccttcatccaccagactaccttttctgacgtgtaattttcctacaattccactaaaaggtgcacggatttcggtaaattttaaatgggtgttcattgaagccagttcagcctgggctttttcatattttgctttagccattgccatttcctggggagcaacgatgtctttgtcggagaggttcttggtattctgatattcaatttgtgcatatttagactctgctttggcacggtttacatcagattcataaagattaggcataattttgaacagcagctgccctttctgtacgaactggccttcatctacataaatagactgaatatatcccttttcctgagcacgaagctcaatatgattaatagaacggatttgagcaacataatctttgttaaccaaagtatcttttacaagcggacttgtaacattgaatgacgctgcttctgttttttcctttttttcagattggcagcctgccaacaggaaaataaggcacaagctgatatacatgagacttttcttgaccatgataagtattgtttttataataatttataattgaaaaaatagagttaccggctctcaaaataaattaagaaagctgataaggttttcggaaaaattactataaaatcacagtcggatgaccctgtactggatgtacagatcatcatgtaaaggctttaaaagttctgactgagaaagtgaaacagcgatttgtctgtcgtgaaatgtagtgacgaagcctgagatcagatgccagaaaccttctttgaaaagggcaagaagttctgtagaaccggttgattctacattatcatcattttcgttgtcattttcggaaagattcgctctgattttgttgtagtggggatggctgatattgtaagcatcattggtctcgtgatttttaagaaatgcaaacgattttttgatgctttttttctggtgaaccagaagatccgtagtaaagtgaagatcagtaggaatatctgttgagatatactgctggatttgcccatagtaccaacccaaaacggtaagcaatgcaaataacaaactgtacaaatattgataaaaccttttccgcatcccagagacaaaggtaattaaacttcaaaataagtacaaccgttatagattaaaaaagtgttaaaaagtgcccagtttattgaaaaaaataaagagaaaaatattattctggcattttccggaggggacatcggaatagattaaaaagaatctgaatgtaaagatcgtctgagaaatggttattagtgcataatttagtgtttttaacagaaaaattaatcttatttttgaaacggcattattctgcataatttttgctgtaacaagctacttttaacggttaagcataaccggtgttacaaaatcttccaatattatgatgaaaaaataccttatttatatatcacttttaggagcacccttattttggggacaaggtaaaatgactgaagcgtctgtataccagcataacctggctttatcagaacaggaaaacaaagcgatggcatttgatgctgatatcagcttatctgaggcggaacagactttggataaaaaaatatccgggatccgtaaacagctcctcagtgatacggaatcgaagaagatatctctatataacagttcttttaatgaattaaaaccattaatagaagacagcaatctgtttcagcttctccagacgatgccgaaaggaggtttgctacatacccacagcggagggataacagatgtgaagtggattatttccagagtgcgaaaatatcaggaaagctatgtttacgaccagaaagataatgatcagtttattttcgggcagctggctttttttgaaaagggaaaagttcccgcgggatttgtgagccttgataagaaactggcttcaagccctggttttgaaaaagagcttcaggatcttcttacgttgaaacgtgaccagctttgttcttatacagattattggattgaatttgaaaaacgctttaaacgcatcagcctgctgcttccgtaccgtcctttcttcaaggaatattatctgaaaggattccaggatctgataaaagataaagtacagcatgtggaaatcaggtatatttttgatgaactttacgatttccagcatggaaaatatcctttgaaaacttctatcacagatctgcaggatattcttaagcagatacaccaatcggatccgcagttcacgctgaagcttatctattcaagctttaaattcttagataatgaaagtattggaaaacaactggaaacggctttcataatgaagaaagaatttccggatatgatctcaggctttgatcttgtagcggatgaagcggcgggacatgatatccgtttttttgagaaaagctgggcaaaaatggatgaacttcacaaaaagtacggcgtggaactgcctcttttccttcatgcaggagaaagtaattctgccctgaatgaaaatgttctcgacgtagccttgttgaacaataagagaattggccatgggctgaatcttatctattttccaaaaaccatggagcagatcagaaagcagaacaagctggttgaggtaagccccatcagcaatcagattttaggatatgtaagcgatctgagaaaccatcctgccagggttttattaagcaacggaatacagtgttcaatcaatagtgatgatccttcagtgtatggatatacgggactgagttatgatttctggacaacactggtgtattgggaactggatgtaaaggcattgaaaaagctggtcttcaattccgttcagtattcttctttgaatgacaatgagaaaaagaaagccacagcctatctgaaccagcagtggaatgattttgtacaaaaagccaaccagcaattcaattaatcagaaaagatttttctgataaaataaatcgcattattgaaaccaatgatgcgatttgtcttttcaggggatcagtaaagattacctttttagctttaacctggacaattctttttttataacattacccagttttgaagggcttacttttgtcagaaccaaagattcacaaccattgaacacagcaaaacgttttaaggtttctgcaaaaggaataagccaaagttcaggggcgacggtgctgttttcaatatgtaaatgaataagctcaagctttttttcctttctgtgggctttacagtcgactcttccgataaactgatctccaaacaggatgggaagacagaaatagccatattgtcttttttccttcggcgtatagcattccagccggaagtcgaaatcaaagatctgtttcacacggtcccggtggataattgagttatcaaacggagacagcagccatactttggaatctgtcagatccaatgttttgttcagtatatcattcggtacaaaaacaagagttcctccttctgccttgatttttgatattctgtcttcttcgagcatacgttgtaacacttcattgacgtttttcttcagctcatttcctttgcggagatgagtgatctgttttactgttgtaaatccataggcgcggagattggttttgaccagatattctgcaaattcaagcggggtgggctctgtggtgttcacagaagaaggcagcactctttctgccagatcataagttttctgcattccggaacggccgctgatcatcaggtctccctgcatgaaaagtcgttcaagggctagtttggcaggtttccagttccaccagcttccggctttatggctctcattttcaaaatctcttgctcttttaggtccttcattacggatggtatctgtgacgtactccatcactttaggatccgcattataatagcgggattctccgcgtttgatggccagcatctggggcaaaacataccggaaatcctgcatgggaagataggaagcagcatgaaaccaatattcaaatactttacgttcttctaccagttcgtccagataattagcctgaaaatcggggattcttgtccagagcgtatgatggtgggcacgttccaccatagataaagtatcaatctgtatatatccgagatgctccaaagtgttaagaaccgcatctttcccggttccgaacggtgtgttttgcgttaagccctgactatccagcgttgtaagtttcagttgttctaatgccagcttcttttccatatccgaagaaaacagtttgtgatgttcttttcaaatatagtgatttaacggaatgccctgaacggtatctgttaattggacagggggcaaaaatcagttgttttgacggttatctcttttcagttccctttcaatttcatccacataaggaaggggagtaaggtaactttcttcaatatattgcctgatactttcatcagtctttttgttaattttcctgataaaaagctgattgctggtctttaaagattgaatataattaaatgtattctgagtattttgaaagaaggatttctcaagtattgctcttttatcatcattgatgataatatcactgaatgatgtattcataagaacagtttgaaaaaaagattctgcaggtaaaaaagtatgaagataataatcctcaaaatccattactgttttgttgttggttaaaaataagcaggtttccctcgtgaaaataaaccatttcccgcctatataaggtattacatttttcataaaagatcttttgtagatgaaagatgagatcatataagccaattctgtaaaatgattttgtattctttgcagagtatccggtctgtaaaatttctgatcataataaaagagataattcctgcctttattaatagtaagaaatttacggatgatattttgtgacttcagcggataatcttcaccactcagatttataaaataatcccattctttacttacattgagaagaaattccatagcgttcaattctgcctgaaccatgttgaagcctcccgaaacgatattcatactgtcaagaatatagacattgggaaactgaactatatagatttgtatttcttcaatgaaatccggtttcgcttttttatcaatatgaataagataaaactgatcccttgtatagattttctgaaacatgtttttaaatacttcaggtttatgatgtaccataatgaaataagcaattcttacatgaggacccgaacgggattctgatattctgggagaagggctggatatgggggaggaagtttgcatattttggagtttaaaatcatccgcataagcaaacaattcagttaatttgcagaaggtacgaataaatttttgataatcaattaattaaatgtaattgtctttgttttttttattgtaggtttgcagaacatttataaaaacaggtcactgcctttgctattctgtcatagtttaaaatcacattttttctttcagttttgctttttcagctaccaatttatagtcttttccttatggcaggaatatatgattataaagttctattgtagataagagcgacacgttattgccggttaatccgtaatatattcaaggatatttatgaaagctgaagcaagaaaaagatgagcagaaaagaattctcttttgtttatcattataatactccaattcaaattctgctccgcagatttgtttgtaaaataccggaatccggaatttataatgaattttaaaaatttaaatttaatcaatcctattatccgtgcagtgacagaagcaggatattccaggcctactgaaatacagtatactgtaattccgcatattttagcaggaagagacattataggatgtgcacagaaaggcgctggaaaaacaggagcttttgccttgcctattttacagttgctgaaaagacatgcgccggatcataaagaagtacgggctttaattcttactccaacaagagaattagcaatacagatagaagaaaatttaaaaatgtacagcaagtatctgccattatcccagctttccatttataaaggcgtttctattggcagccggcttgcagccctcagaaaaagggtagatattcttgtagcaacacccggagaactgcttgatgtagagaatcagagacatattgatttttccaaaattgaaatatttgttttggatgatgcggatagaatgcttgacatggggcttaccaatgacattaaaaaaatctcaaatcttatctctaacaaaagacaaaacctgtttttttcggcaataatgcccggaagtgtaaggcattttgcaaaaacgattctgaataatcctatagaaataattgtcagtcccgctttttcggaagtacagacaattaagcgccctgagattaagaatattcataaactgacaggagatgcaatgtctgtcagcctatttcataaataaaatctgtagcgtttacagattataatatacaattttaataacaattacaatgcaagaaggcaccgtaaaatttttcaatgaagcaaaaggcttcggttttattactccggcagacgggagtaaagatatatttgtacattcttcaggattaaatataagagtgatccgtgagaacgataaagtagtttttgatgtacaaaacagtgataaaggtttaaatgcagttaacgtgaggttggcataagcagaatatttattacaagtatgtaaaattgatattgtttgtcatatcaagtctcctatttttatatttttttacaaattcagattcatggaacttcagtatctggatatattgttttaaagaacattgatgtaatgtagattactttttatttttttattttcattatgttcattagcctcttacttcaggtaagaggtttttcaaggatttattgatatccggattgattgtctgaaaagtaaatgtacagacctggcctgcaattattacagtattgattatcatagctgtatctattttaattcccggaaaaatatgattattattaatagttttgatgaatataagtcccttgaagggcagatgatcggagattctgactggcataccatagaccaggcacagatagacagattcgcagatgctactttagatcatcagtggattcatattgatcaggaaaaagctcaaaaagaaggcccttttcactccaccattgctcatggttatttaacattatctctgattccctacctctggaaacagattgccgatgtgagaaatgtaaaaatggaaatcaattacggaatagaaaacctcaaattcggggcagccgttcttgtaaacagtgatgtaaagctgcaggcaactgtaagatcagttacggatctcagaggaactgtaaaagctgttgtagaggcaaagctgctgatcagagactgtacaaagcccgcatatacgggggatgtggtttttctttatcattttttgtaaacggcttaataaaagctttgtggcttttgtggtatgttttggcccacagatgccccagattttcgcagatgtttatatctgatactattctttattttaccacttaagaaaacatctaagatttttaaaaacttatgtgcacttattcttcggaaggatatcatcttcatctaagtgtttaaaagctttgtgacttttgtggtttgtttttagccccagctgttacagattttcacttacaaagtaggactgtaattgtatacgtgaaaatgcttatgtattacagtacaaatacttagcgttaaaattagagatttatactctacaattcgttcctttttcgccgttactttggtatgttcaaaagaagcttcataacctgaacaacggcagtatccgaaaagccatcaaaaagagtaggaacaataccaatattattaatcatgaaaaatcctgaaagtgttgctccttttgtagaagcctcacaaattatcacagaactgaaagacagagccaacgaaatcctgtcaagcgttttaagtacagacctgtctgctattaccattaacggaaaaggaaatttcccatattactggcaggacccttccaatctgaaatttaataagaaaacctatgactggatagcctgcaacctgaaagccgatactgagccggtgcagctggaccaggtgtttaccaattatttcattgatgttttctcgaaagtcaattattccttatctgaagaagatacagccgtactgaatgatgcccattcaagagctacagatcagcagatggctttacttactgcatgggtgggtgcctatggctcacttcctcctgctacagacaccatgcaaccaattgatatcattatggataggattgctacggaatgggccaaccctgccactactttatatcagattcagaaaagtgaaaaccttgatgctttactgaataaaacaccggcaagcggaaaacctattcttcctgtcttggccagttatctggatgctctgggggctaccatatctttacagaataatgtgacgatgaataatggttatctgtccagagttctgaagaatgtacagaatcctaaaaaagaaaacggaggactgcagctgaatgacgacagtattttaccagcttttgaggtgacaactccgctcgacaagattttaaacggccttaaaaatacttcacaggcagcccagatcgatatggaggtcagccgtgaatctgaaagccggttccgtgtttccgtacaggggaaaacgggtttttctattcctatctttgatttctttacgttgggaataggcggtaatgcaaattattttagtgaaaatattgccatcagcaaaaattctatcaaaatatccatgtcatttaccggggttaccctggtgacctttggtccgaaggattttaatattgccagcaatttgtactgggcatggtttgatcctatccgaaaagcgcagatcaacagcagagacaaacaggaagaaaaacatatttcaggatacaaattctctccggatccggcaacgaaattcgggcctgacggacctttcggtttgctgaacggagtggcaatttccaattatccaagtgttgagatcacagtaaccggtgaagattataaaagtattcagaaaacttttgagcagtctacttctgctacgctttctttcttaggaattcctctggcaagcgttaaggaatctacctattcttcttcttattctgtagaccattcaaaatctacgatcaagatcacactgacgcctcctccaagcctgatagctggtaataataaagattccatagcctgggtacttggtgctattgtagattatcctgcccagataggtgaaggtgttgaacttcttgatgatgaggaattagtggcgaaaggtgcttatcctaattatcaactgtataaagataataccggaactacttactgctcggtaaaaaaagtaaaatcccacgcagtgggcagcgaatggataagtgagtgtctggcagcccatccgggaacaagcccatccggaaaaccatggaccagccctcgacaatcaggggtaatctggccttaaaccaataacaaataagccataagaaaacagactgtctcaacgaggcagtctgttttttatatcaagatcttctaatatcggtatagtttagtctttttggccggaaaaaatactatttgacaagcagatagattccaacgccaatggcagcataggccgtcactgtaagaatatcagcaataggctgtgaaaaacgtctttccgcaatcttctcactgttgatctggttcttatggaatttcagattctttttagcattatgaaccggatgcactaccaggctgtcaccttcccatcggtcaacaatgactttgtagcttttgttatccacttcaattttaacgtttttaccggctgccagtttctcctgaacattaacaggagcaggcggttgctgaacattcaggttctgggaagcagggtcgtttttcggttgaggagcggtattattagcaagcttattgttggctgcaggatctgcaggcttttttacctgatacgtatagcagctggtaagggaacataatataatgatgaaataaagattctttcgcatgagccaaatttaagaattaaacggaatatttgggagtttgttttgaaagatcgtgtttttttggaaatctatgttttaagatgtacatcttttgatttgcagaattaatattatttctaaagtcaagagataaaaagtggcaaacatctgagattaaaaacaggtcttatagatatttttctattttgtaaactttttaaatattattaaattatatatagaaaatcatcataaataaaatcacaaataacttaaaataaactataaataaacaatatttatttagttgataatctgatatttaacataaaaaacaattcttgtatgattagagttatttaatatattagggttgagtttaaaataatcataacactaaaaaacatttaattatgaaaaaactaattttattagctgcttttggagcagctgggcttgcaagtgctaaagcaaatgatggaaaagcaatcaaaaatgacaacagtattgaggctaatactatgcaaaaaacagttgtttatcaagaatgtggcgttgttgttacttattggtctggtggtcaaatcgtaggacaggagactatagtttctgatcagccagatttacaaagttgtcaacaattccagaccggtgtaaaagttgctttatgggcggctggattttggctaagttaataaattgatttaattttaataaccctttcagtatttacagaaagggttataatattggaaatattctatgaaaaaaatacttctactgacattggtttttgtttcgggattatgtatttctcaacaagttcatgtaaaatatcaacgcgttttatctccttttacaacaacgcatgaggacttatatattaagaataatcaggtattatcagttcaggattcaataataattaataataagttaactgattcctggactttgggggtgaatttggataatggtaaaaagccttcaaaacaatattttgtttcagacttagataattctcctgaaagaaacttcttctttacatcaagtgttgataccaaagaattttttatatatgataaagttcctcagccgaaatggaatattgaagaaaaagaaaccaaaacaattgcaggttacaagtgtcacaaagcaacggctgatttccggggttcaaagatcatcgcttatttcaccaaatctttaccatattctgtcggtccatttaaattttatgggcttccgggattaatcttagatataagagttgaaaataaagattatgatatatggaaagccgaatctgttagtacagacgatcaaagtaaaatagtttataagcctcaatttctacgtaaagataaaataagttttaaagagtatgtagaagctaaagaagcacatatgaataaaatttttgcaaaagtttctgatgccctgcccaaaaacagcaaagttactgtcagaacaaatcaaagattttctgtagagcaaaaatatgaatgggaaaataattcggaagtaaaataatattttctgtaaaatagaaattatttatatagtattaataatcgaaatccaatccactacatgagattataactttacaaggttatatatagcatcgacaatttgggctataaatgtaattgaattttcaacatctacattctctatatcttgtatagaattagtgaataaatctatatctgcttcatgaactatctggtttctacgaattacaatatttcttaattcaattttgagattattttgatccatatttacataatctgcaattttttgccatttatgattttctggccatataagacttaaagcctgagctattttatctggatcttggaaagataagtgtttatggttttcaataattatattttctaaaatctgatttgcagttaattgtgaagtaggatttgccaaagtattgatatgaagcatgctaatagagaaagaattataagcgggagtattaattcttaagccattatatgattcaagtattccaatcttaacaatatcatgaataaatttgtctaaagctgaaaccatatatacaatttcacttcgtaacaaatcaactataaaatcagactggaaatgtagttcgttacttaaatgattgtataattcatgaattttatttattctttcacacgaattatcaaagtctattttagcgttcagcatattctttaatatgaattatttgtgctgcaaagtcattaaatatatcatcaaaaaattttctttttttctgcaactgtgctagtactggtccagtattatcaatttcggaatcagtaattgaaaatactggaacccccactaaatttgctttttgtagtaggctttgaaaatcaggaatttctgcaaggcaataattatctggtattttactatctataaaagaatcttttccaagtagcatattaaccttttttaaagatgggataagtgactttgtcacttcgtcaataatctcattcatattatttctaaatggagtattaggtttaccatttctgatgttaaatcgctgtattagtaaacctcctagcttaggatgtctcgatggaaatggatatgatgattgtgcaaacattgtttgcatcatttgagattgttgcacccatcgtggtaatacatgagagagtgttttaatcgccatcaaagagaaaggatcaggattagtaggaataataaacaaatcagaaatagagaaaaggttttgatttattgcacctaaacctgggttaacatcgaatataacatattctatagcatatttttctaccaatagatcaataagtgcattaaatgctccaggcaaattttgcattgtactaaaagcgttattagatgtttgtgcaaaacttaattgaggctcaatttcagtaagattagggtgtcctggtaataaaaataaattttcatttcgtggagtttggaaacaatcgaatgccataattgcttctggtttactttcaaaggctgggcttactgcatcttttaaattattgtttttagtattatcattaatataatattcttcaaaattatcttggagtattagacccgtcaaattacattgtgggtctgcgtcaactagaagaacttttttcccttgttcagctaatttccagcctaagttgaaagtagtagtagttttgctgactccacctttatgattgaaaaatattattctcatggtatttaatttagtatatgattgccaaatatagaaaagattgttctcaattatttacggttttccgtaaacatgtctgagcatagaaaaaatccttgaaaaaattcaaggttgctcacgaagagattctgtttaaataatctctttcttttaatttctgactacccttttttttgggttgatctaaccaaagattgacatcttatttatgactctgtttgtaatagagtgagttgaaaagggagtaaaagttatctggatgtctaatatgacctctggcttactgcctcattcatccaaactaaaagagagactatctcagtctctcttttattattttaaaacctgctggtcataaagaatattatcgtcttcatcaaagcttatgatgagtactttaaattgctttgcactgtcattattgaagaacttgattcttggcggaacgtaatcgctgtcgaagagatttggattccagtacagggtttcgcgcgtgtcgttttcaattttttcaggggcgttatcatcaatcatttcaatagggaattctgaaggtttatcatatcctttgatgatggctgagttgttctttttcgcttctttttcgttgcttttaggtttcatattgcctctcatcgtatagacggccacggcatcgcctactaaccctgctcctttaataatttttaccatcgcaatgttgtcaacgggaagattggcaatcatggaagcatcggtaggtatttcatctaaataaagcttagcctgctgcccccggatgtaaggtacattgacgcctgtactatttctctgaaatgtaaggccggcagctcttccctgcagccagtcgaggatattgactgatcctgaagcatgctggtcttcattcacaaagtcaaatatagtagcattggcagaagtgaacatgccgctggacagctgtttatccagttctgccttcggatctttcttttttcctaccaaagcaacttcctgaatctgtatgtcattactctctttctttttaatgtttttttgagtattgatggctcttgaaattgttggaggaagcgttttatttttatcagcttttaccagtgtatattttgtgggcgggaaattacctttgaatgttgtaggcgtcactaacggttctgcggtcacaaacagatcttcatttcctgattctttattttctgcattgacgaatgctgaaatttccagaggttcactaatgttgaggttatttaaataaatatatccgttctgatctgttttaaactggctgaatgccggctggccctgacctgactttgataataagttaaccgtcgtgttgatcatcagggcattattcttaacaggtttcaaccggtaagaaagatattgctgagactgggttttaatggtgggggcagctccgctcagtacggaattccagtcaaatcttttccagttttcagagataagcagggcatccagcgcttcagtgttggcatttttagaaaaatactgtgccgggctgtctattcttgttgtaaaatctcccgtcagccaaagtccgcttaaaagattttcttcctcaggagcctgggttccgttatcttcacttacgacaaccgtataatttttaaaatacgattccggagaaagatcgatgctgttgaaagctcttggtattgttttcaggctttggcctacaatttcagccttttcaatttttaaattaccgggttttataaaacaaagtctctgtgcagcaatattgtcctgctcatcaaaaatcaccaattgtaaaaccccgttagctccgttactgattttggtagggataagacttgatacatcattggtcagatgattgatgttggctctgtaagcaagatgattattgataagcccgacaattttatacccctgaagctgttgtttcaggttaacacctttcaaggtatatttaatcccttctttggagcttgaaacctgtatattcaagccgctctctgctaccggtggcaggtctattgtctggctttttcccgtattgtcccggatgatagcctggtatttctttcctgcagccggagttattgtaaaagaggctacatttttatcaaaagatgtaaaagtggtaaccggagtgtttgggttctggctgtcgattacttttccggtccagctttcaggcagagaagaattacttgataatcttaccgcaaattttaccggcataccgctaatgaaagttccgccttccggaaaggctttggcagaccagtccgggcttttggcaactaccaatgattctgcagagtttgggttataaaccggaatggttttaacaatctgaaaatcttcactaaagttggtcatataaggcgtatatgcccttacaaaataaacctgttccggaagatcttctttcagctgaaaatctccgctgccttcaccattggtaaggagtacggttttccagtcaattaattttttatcagaattataaagctcaacaaaaagggtagtagataatggcgagcggttatatccgtcgaatacaaaacttttgaaccatattttgtcacccgcagcatattggggtttatcagtgagtaaatatactttttcctgttcgtaattattctcaagattggtgatggctttttccagtttggtttgtgccagtacaggctgtaccatagaaagaagcgctacacagaatatatttttcatagaaatctcggcgcattttaattctgtgctaatgtagttaattaaacgtttcggaaattgatatttacaggttatttcacaggaaatcataaagaggaaaataacaggcctgtaaaaagagacagctattgaacagctgtctcttaaagtcgttatcttttaaagtaaaccttatcgtttctattcaaaaaggtttttaattcttacggttcaagctctgggcctccacatgagctatacggaacgcatgttaacttatcattgacaaaacacattcttacacattctgatcctccggcaattgtctttaattcttctttgttaagcttttttaaatttttcatatgaatatattttatgttcataacaaatctctacataattatcttacgatagatgacattaacaaactttaacgctaacattgcctgtgactttgaccatatttttttctatatttagaaagaagtatatgagtagacttatatcaggaaatgacttgtttttgtattttgtacgctggtattcctgtccatataatttaaaagaaaacaatgccgataaacccaatacctccggacggaggcctgttatataaagaaacagatatgactcagtttttccctgagccgttaaatgcaattactgctgtattatttttagccatagccattttctggaccgttcaattgaagggacgttttaaagaatatccttttttaacctactgcctggtcttattatatattggagccataggaggtactgtttaccattcattcaggcaatggccggtatttattatgatggattggctgcccattatgttactctgcctgtctgccgggttttattttatagcgcaaagcaccaaatggtactttgctgctgtaatggttctgggatatgcaatactgatgttcgctttaaggaactggattctggcagataacccttctctttttatcaacgtcaattatgcaattatggcctcgtttgtagttttctcggtaataaggtatctgatgtatacccagtggaaagccggaaaatgggtaggctttgctgtattatcatttgtttttgcactgaccttccgtatcgctgataaatgggaatggttcagcttcgggacccactttttatggcatacgtttggagctgtggcgacgttttgtatgtttaagtatattagcctgacacatgagtcaagtttaaaaattaaacggaatacttagtgttttcttttaaaagatgctgcttttattgctaaatgaaataatctccaaagtttctatacttcggagatctgaaataatataagttataaatatttaaaattattgattagaaatacgttttaatatttcttctaaagaaaaatctgggggtaatggcttaaattctttacttgtattgatagatgattttactctttgaaaatttcttagcttttggatatcaatttgtccaacaagaatagtatcattgagtcctccttttaattttaataaatctttagtggctgtctctttaggttgtgtcaatctggtgtcaccatacttacttgtattgacttgagcaacaaaacaatgtaaatctctcgaagtagattcaactatattcgaaaagtatggtgtatctttattccattctactccgattaataaatctatttttgattttaatttttctctatgacttatatttgctaattcaaagcaatagcaaactgaaaaataaatatttctgtaattaataatttcatagcgggaaggttttggtttagggactgccaagtaatgtttattaattaaatgttcctctccaggagaataattattttttaatctaaaaataatagtagcatcattaattccatttattttttgtgggagaattgagattacgaagttaaaagatgtattttttagagtcaaatgttcaattccagaaactatcataatttggttatcagtagaaaatctacctaatgccgaaattaaacgcattggcataaagttttcaggaaatagcaatagctgagcatcagactttcttgctttagataaaattttagataatttatttattcgttcatttgatagaataggtgaatctaaaatacttgcttctatattttcctctaaaacatcagtatttgcaaatgcaattcttggatttagtaatttctcgtctttatttactgtaaacttgttcactaaaaagtcttcttccgatccataaatcttttgtaatgtataaaactgatttttaagattttgatttaattcatgattcggtttatgtttggagttacccagacaatatagatcaaacgcaacgtctaaataatcttttttattataggcaattctttttttcaactcattattttcttcatcataaatttcctcttcatactcttccataatatcatataagatattagtttctatgacttcagaccgatttgaattttctgggttaaatttttgaaattcttcaaatgctgatgctatgcaacattcccagaattttataggtcggggggaattttttaataatgtgcgatcaagtttgtaattttttatatgaagatttttgtcaattaaatttaagtcaccattttttccgtcttctgtataatttaatagaggtatagaaacataatgatgtctaatcatatttgcttctctaattctaaaacctactttttttcgtgatttataaggatttataaaagaaaattcggcaaatagcaaagcgaaattttctcgactagttttattcgattgaaattcaaaattcttatttacatcataattttttaagaattttaaattcaacgaaatgctcatttcaaatgcaaaaaataaatattgtgttaatgcatcatgtacttgtattgcaatttctctagttaagctatattcgttgttagttttgtcattatctttgacattgattttttcaatttgttctagacagtgaaataaaaactcagtaaaggcggtaggatcatcattaactacaaataatgttaatatcttttcccaaagcttatagaaagtcaaacagttttctcccttaaaaaactttaaaattttttctttttcatattctgatattttttctctttttcttaatcctaaattgattttgtgtgaaagataaacagataaaccaaatcgatcttctttataatctttcaaagttcttattttaccatctgtaccatcatatgataaatgataagcattttcttcaaactctattaaattatcttcatcattaggcatatctcggaattcactagatttatcttcgatttccttctttagtttgtctataacaacacttgattcgtttttatcaaaataataaattaaggttttatcactttgacaatataaagaagaatatccgtttattttgaaaattcgattctctggtttattaaattctttctcaatggaaaacggggaattaataacatctattaagggataaaagttttttaatatatatagttcaatatctgttaaatcttttaaattaaaatttctgtttttatcgaatgatgattctttgtaattttcaaaaaaagtataatatttatctaatgctttattatccttattgtctgttgtattaggttctgatattacaattaaaatgtcgtccacatatctaccataatatgctggtttatatttttcaagtataattttatcaaaatcttttagatattcatttgctattattaaagaggattgaagacctattggaataataaatttattaattctatcgttttctataacttcacttttaaaatcatatggaatttttaattgtagaaccttttgagtaaaaattctatgtaatttttccattaaggtattaaggttatcatatatttccttagctccatcagtataacgaaaataggtttcagatattcttgccgaatagtaatagtctttaatatctaaatttaagaaaagtgtgtttttattattatttaataattgttgtgcagtattaacagcattgtctctccattgttgatattgagaaaaatatggtttatataaagctgaaccaaaaagaatttttgatttgtcttttgttaataacagtctatttcctacacactcatctactaaatctgcatctttttttatcccatccttaattgtccataggacagctataatatgaatttcaattggtgcatgaatgaatgctgtaactttatctagaatatattttgttttaattcttttattagaaataatagagtgaatggaattattttgtgtaaatttttttggatatactgttacagatatttcttctagaagttcatcaaaaaattccgaatctttattgtaattatttattttctctgttaaaatttcaaatttgtcttgtaaggttatttcttgtaaaaaagatgggaaatctaacttgttcttatccttatctttaaccttaaaatatctatttgtaagttcaaaatcagaaaaaatgaaattattttttgagtaattagtttcaaattcaacaatctgttctcttagtaataaatcaccagaatcataaaatatagttgtttttaatttatcatacgcattttcaatatcttcaattgaaaatcttctcatttgttttgatgtcatgaattttagttataattatttgttttgtgtgttattcgaatgtattgtttgtgttttgatgttaaagtggaattgaaatttttaaggttttatttctttatactatagaaatttagcaagttgagtaaaaagaataactctataagtattcctttcttcactaatatgcttgttattaaactttttgaaaactctaaaatactaaaggtatttaatatatgattaaaatggatacggtttcccgtaaccgccaaaaaaaatcccaactttcgtcaggatttatcaattatattgttttcgtaacctatattccaaccattttaaaaaagctagcaagggttaaatttctggcatggcagatccgcattatcgtgagaagagcaatttgataatctttgtcgtcttttattcttcgaacggtcttttcatcaatattatgatcaactgcaaatttgctgttattgttcatagggataacccattcatcccttataaattcaacaatttttctatttgcttctgtcatagaaacaaataaattacttattcttataaaaatctcggactcaaatccgaatatttgcaatttttccttacatttataaaaaataaaccaataagaagattgaaggagaataaagcatttcgcttacaaaatagctttagctatgtcttaacgattcttcatcccttaaaaactcttaatggttaagaaaaatttcaacaataaaaaatacaaacaatgaaaaaaagcaaaacaaactttgataaccggtttcgggcagataaaaagtactccgggttgcagctggtagaaactttctttcagttcaatgagctggatgtttccaaagaaaggctcagcaacattatgaattatgcggtaaagcgaaatagctggatctatgaagatccggcggtgatcttccagttttatcagtcgatgagatcattgatccgggcaggatttctcatgatgctgaaggacagaaaatggacggttgatacacgaccggaaaaaatttccccgtgggttcttggcctgctttcggagaaggaataccggaatcctctgctggtttttaaaacagcgttcagcgcgtacaccatcaaagaatttgattactttatgtccggaattgtctatttctcaatgggcgtctatgaaaatctgccggaaaggaatatcgtgatgccttacatccacacggtgaaaatgctggatgcggcacaccttattcttcagagaaggagagaagcaagagggtttgagagcaggagggtttgaggggtgtgcagtgggcttgagaataatgactgattatagttttggtgttgctgtcattctgaatatagcgcagcgaagtgaagaatctccataatccgctgtactgtttaaaaaaagatggcaggcactactttagaataggggacaagtgcaaaacataggaaataacatattacctgtagcatttaaaccattaaggaaaatgaagaggataagataagttaagattcatctttgatgaatgaagaagaccgctttatcaatatctttagctatatcttaactgttctaaacagcttaaaaaatcttaatggttcaaagaattataagaaattaaacttcgcccgtttaaataaaacgaaattaataatagaaactttgcgttcatcttttaaatcaggaataatttaaaatacaaactgatgatatttttttcagacgcaaagatttcattttttaactgttgattgtaagggagaaaagaaaagaatcaacttagttgattcgttgaagcttatggataagcatgccgcttcatcagcgacaaagtcgcattgctttgcttacttaaaacaaaacggaattataaatagaaactttgcgttcatctttttaatcaggaata

SEQ ID NO: 17 - DNA, 339328 bp, Chryseobacterium sp.
aagcatgccgcttcatcagcgacaaagtcgcattgctttgcttacttaaaacaaaacggaattataaatagaaactttgcgttcatctttttaatcaggaataatttaaaatacaaactgatgatatttttttcagacgcaaagatttcattttttaactgttgattgtaagggagaaaagaaaagaatcaacttcgttgattcgttgaagcttatggataagcatgccgcttcatcagcgacaaagtcgcattgctttgcttacttaaaacaaaacggaattataaatagaaactttgcgttcatctttttaatcaggaataatttaaaatacaaactgatgatatgttttcagacgcaaagatttcatttttttaactgttgattgtaagggagcaaagaaaagaatcaacgaagttgattcgttgaagcttatgaataagcatgccgcttcatcagcgacaaagtcgcattgctttgcttacttaaaacaaaacggaataataaatagaaactttgcgttcatctttttaatcaggaataatttaaaatacaaactgatgatatttttttcagacgcaaagatttcattttttaactgttgattgtaagggagcaaatgaaagaatcaacttcgttgattcgttgaagcttatggataagcatgccgcttcatcagcgacaaagtcgcattgctttgcctgcttaaataaaacggaattataaagtgtattaaggtgtttaaaaaataaaattttgtgacctttgtgatttaatgaaaaatttaaatcattttttgtgaaattcacagtctggttcttttaattttgaaagaaagatgatttacttatatttgttccgcaaagtaaaattaaatgtttaaaaaagtaagcactgtatttatccttggattttatacggttttttgttctgcccagcaggtccggcctttaaaatcatctgaaatttaccgcgacctcaaaacccttaaacatcttcctaaagtcttataccttgcggcacatcctgatgatgaaaatacaggattgctctcctggttaatcaacgatcagaatgttgaaacaggctatctgtctttaaccagaggggatggcggacagaatttattgggcacagagcaaggggcagccctggggttaatcagaacgcatgagcttttggaggcaagaaaattagatggtgctcagcagttttttacccgtgcaattgatttcggattttccaaaaatacaacggatacttttaaacaatggaatgcagacagcattacggcagatgtagtctgggtaattcgtcaattccgtccggatgttattatttgccgttttcctcctactgcggcggcgggtcacggacagcatgcggcttcggcggtggtggcggaaaaagcttttaagctggcaggcgataaaaacgctttcccggatcagctgaaatatgtgaatgtatggcaaccaaaacgtgtattatggaataccttccgctttggcggagtcaatacaactgctgaaaatcaattgaaggttaccgttgggcaatatgatgcgcagctgggaatgggatatggtgaactggccggattaagcagaagcttacataaaagccagggtgcgggaacgcagtctgtagccggcatcagaactgaatatttttcacatgttgttggcgagcctgcaaaaaatacactttttgacggagtcactaaaacctggacttcacagggaaatgctgatattgaccaggcactggatcaaattattaccgctttcaattttaatactcctgaacagagcctgcctgcattacttgctttgcgaaaaaagataatgatgctgaaggattcagacctgaaaaaagataaaattaaatctcttgaccatattattttaagctgtgccggattcatgggtgaggtagttaccaatcaggctgaagcggttgccggggatcattataatttccggttaaatctgatttcaaggtcagcagatcctgtcgttttagagaatgttaaatggttaaatcaatcagaaagcttcaacagatcgttatcaaaagattctctgattaccattcagcatgacattcagattcctacggatgcagcccttacagaaccttactggctggcaaaacctcctgcgaatgcggcaactttctctgttccggatgaaacactgatcggtttgcctgaagcagaatcaccactgaatgttttggttggtttaaaaatcggtccggaaaagtttcaggttaagcttccattatctttcaagaaattagacccggtgcgcggtgatgtggtggaagccttgcgtattgttcctgctgtggaactgaaattcacgcaaccgctttatctcgttaaagaaaatgaagatttacatttgagcttacatcttaaggttaattctgataaacagttgggtaaaggtaacttaaaccttatgtacaacggagaaaagttaggtggagctgaggtaaattctttcaaaggaaaagattttaccgttgactacgttatcccgaaaactaagcttgcgtcaataaactcatcccgtttgcaattggatgccagttttgttgcagatggagtaacttataataaaaagcaggtattaatccagtatccgcatttgccttccttacaatattttgcccctgcaacgataaccgtaatgaaaggggatattcaggcaaagattaaaaaagtgggttacatagaaggtgcaggcgattttattcctgagttcctgcgcattgcaggcgttcaggtagatgtgttgaaagacggagacttttatggcaatacagatgcatccggcagcagccaaaacaaactgtcacaatatgacgccattgtgcttggtgttcgtgccaataacacagagaagaagctgggccgctggatgccttttttatattcttatgtgaaggaaggaggtaatctggtgatgcagtacaacaccaaccaggatacaaccgttgaccaattgggaatgtataatttcagtattgccaataagcgtgttaccgaagaaaatgcaacggttacatttttaaatcccaatcataaattactgaacttcccgaacaaaattactgctgatgattttaaaggctgggtacaggagcgtggcgcctatttccctgctcaatgggatgcagcgtatgaaccgctttttgaaatgcacgatacagatgaagagccgctgaaaggttctactttatatgcccaatacggaaagggtaattttatctatacaccgctggcgtttttcaggcagctgcctgcgggaaatgttggtgcagcacgtttattttttaactttttatctgcacagaaaaactgatgaacaggaaacttaaaaactggaatatctggtatatactattaacagttgttttagtattgcagatcgcattttattattggtttactaaattctgggcatgagtactatagattggaccgttcttattgttacacttgttgcagtggtggtttacggcgtattcatcggccgtggccagaaaagcaacgaatcttacctgaaagcagacaataaaatgccgtggtatattgtacttatcgggattatggcgacgcaggcaagtgccattacatttctttcggcaccgggccaggcttatacagacggtatgcgtttcgtacagtattactttggtctgcctctggcgatgattgtgatctgtattactttcatcccgatttttcagcgcttgaatgtctacacggcttatgagtatctggaaaaccgttttgataagaaaacaagggtactcacttcactgcttttccttttttcgagaggcttgtcaacaggaatcagcatttatgctccgagtatcattttatcaagcgttttaaactggaatatttatgtaaccaatgttctaaccggaggtatcctgttgatttatacctatgttggcggagcaaaagcaattgcgcatacccagaaattacagtttctcattatcctgggaaccatggcttttgcaggatatctgcttattcagaatatgccggatggaattggctttaatgatgcgctgtatctggcgggaaaatccgggaagctcaatgtcatcaccacagaattcgactggaaagataaatacaatatctggagcggattgattggcggtttttttctggcactttcttactttggtacggaccagagccaggtgggaagatatatcactgcgaaagataataccaacgcaaaaatgggcctgctgctgaacgggctggttaaaattccgatgcagtttgctattcttctgatcggtgctttgcttttcgccttcttttctctaaaacctgctccgatttattttaatgaacgctcttatcagtatttaaaagaaagacagcctgagcaggccgcagtttttgaaaaagaacatcgcgatttacaaataaaatttaatgaagaatcgaaagaaattctaaagctgaaggaaaataactctcctcaactcaaacaggccattcaggattttaaaaatacacaaacgcaggtaaaagcattgcatggcagagtagaggaagcgatcaataattcaaactataatgccgagaaaaccgacacgaattacattttcctgtatttcgtaaaaaataccttgcctgcagggatgatcggtttactgtttgccgtcattttcctggccagctggggttccatttcggcagcgctgaattcccttgctgcctgctcattaaaagacgttcatttgatattcagcaaagaaatttctgatgagaaaaccgaattaaaatatagccgtcttcacactttagcctggggtattttctcaattggtgtagcgatgtttgctactcagatgggttcccttattgaagcggttaatgtattgggctcccttttctacggtccgatattggggatttttctggtcgcattctattacaaaaagatcaacggtgcgaatgtatttattgctgccattttatcagaaattgcggttattgccgtgtatcagttcgatatcgtttcttttctctggcttaacgtaatcggggcagcagcggtcattatattttctgcaattggattgctgttttataagcagaaaacagtaaattcgtaaacaaacaatcacaaaaacaaacaaataaaaatattatgaaaacgattcttaaatctgcaactgtacttgttgctacgatgacgatctcaatgaatgcctttgcacaggacactaaaaaacctgccagccctccggctactgctacgggaaaaattaaagatgccactattacaataaactacagcagcccttctgtaaaaggacgtaccatctggggaggtttggaagcttatgataaagtttggcgagcgggagccaatgaagcaactaccttcgaaacggataaagatattaccgttcagggtaaaaaacttcctgccggaaaatacagttttttcttaatccctaaacaaagcggaacctggacagcaattttcaacaaagagccaaaacaatggggagcttataaatacgaacaggctaaagatgctttacgcgttgatgtaaaaacaaaagctttaccggcaacacaggaaactttagtttataaaataaacagtaatggattcacaatggattgggacaaaatctcagttcctgtagagatcaaataaattgatattcaaaaaattaaaatcccggtttatccgggattttttgttgaaagttagatcatcaacaacaaaaaaaaattgaaacagtcaaacgataatataagaacaatttcgcaattttgcttctatgaaaactttcaatgatttagccagctataataaatatctcaatctcacagctcctctgcatccattgatggacagcagggtttgcaagcaggctatcccgaactttccgcaggtgagcggtgaaattcaggttaatctgttcaagatttctttaaagaaaaactttaccggagacatcaattacggaaacaataaatattataccgagaacggattgatgcttttcagcgagcccggacaggtagtttcctgggacagtcttactttctgggatgggtatgcgtttgtttttcatcctgatctcatcaaacaaaatccggttgctgctaaaatccttcagtataaatattttagctatgaaatcaatgatgcattgtttatgactgcggaggaggaagagactataacatggctttttacaaaaattcacatggaattggtagaaaataaagctaatgccaacacctctattattttgtcgctgttaaatgtcgtgctttcatacgcagattttttttatgaaaggcagtttaaagataaagcaataaaagctgtttcagtttcttcaaaattaaaaagcttactgcaaaatcattataaagatttatccaaacccgtttcgaattttcctaccgtctcgtctgttgccgaagaacttaatatgtcttccaattaccttacggaccttctccgtgcagaaaccgggaaaagtaccatcagctatattcatgaatttctgattgaacaagccgaaattttattgctccagacagatatgaatatcagcgatgtggcttatcaattaggttttacaaacgttccttatttttcaagattttttaaaaagattaaaggcatttctccaaccaaaatcagaaatcagagaaaagtataagatattccccgatttgtgttaaaaatccagcatttgtgcaattaattttgaacagacaaaaaaatatgtcttaaagatttacatcaattaaaattattactatgatttttacaacacaaaaaataagcgaaagctactggaaagtgatcatcaataatcctccggtaaatgtattcgacccagaattttcagttcagctgagaataacgatggaagagttgtaggctaatgaaaatctgaaagttgtagttttcgaaagcggcaacccggatttctatgttgctcatgctgaattggttaatatttttgatttcccgaagggaacaggagaaacaggactttctatttcctggcctgatgttgcaaaacgtctggagcaggcagcatttgtaagcattgcttctatccgaggaggagccagaggcttgggtagtgaatttattcaggctttcgatatgcgttttgcgagcagggaaaaagctgtttttgcccagcctgaaatcggaatcggctcttttcccggcggaggcgggctggagcgtcttcatttgttaacaggaaaagcaagcgctttggaaattatcttaagcggtgacgattatgatgcggaaacagcagcgaattacggctggatcaacagagctttccctgataatgaactggacactttcgttgaaaatctggcagataggattgcatcatttgacaaaaaaatcattacaacgataaaatccattatgaatgaaagggtaattattccaaaaaatgagcatattatggaaacccaaacccgtttctttgcatcattaactgaaccggaagcaagaacaagaatcaaaaaactactggatcagggattgcagacctatggagatgtagagcttaatcttggtaaatatttatagtactatgaaagcaatcatattaaaatctcccggagatgttgatcaattggaatatacagagcttccgattcctgaaacccgtccggatgaagttctgataaaagtaaaagcaattagcattaatcccgtagacacaaaaaccagaaaaggagaaggcatgtatggtctgatgaaaaaagaccatccacttattttgggatgggatatttcaggtgttgtggaaaaaagtaaaagttcggattttaaggttggggatgaagtttttggaatgctcaattttcccggaaatggtaatgcatatgccgaatatgttgttgcacctgcttctcaattagccattaagcctaaaaatatttcctttgaagaggctgctgcttcaactttggcggcattaacgtcttggcaggcgctggttgttaatgggaaagttcagaaaggacaaaatgtattgattcatgctgcttccggaggagtaggacatttcgcagtacaacttgcaaaatatctgggagcaacagttaccggaacatcatctgcaaaaaataaagactttgtattgagtctgggagtagatcattacattgattatcatacgtatgactggccaaaacaaaaatctgaatatgattttgttctggatactgttggtggaaataatatcaataattctattgaggttgcgaaatcaggtggaactattataagtattcctaccggtctgaatgaagagataactgaaaaagctaaatcaaaaggtatcaatagctattttattttagtaaaatcaaacggtgaacatatgaaggagattgcatctcttttggaaaataaaactattaaaccacatatctctacagtattttcttttgacgagataaaaaaagcacaccttcaactggagtcgggcaggacggttggtaaagtggttgtggtttaaacaaattgtttctttatataaaaaaaatcgccaactgcatttagttggcgatttttagtttagtgtgaccaggacgagcgtatcttcaaatacctttattgcaataatggattatattacgacaagttctgtcgtaagagtattatagctttgtataaggaagtggaaccagttataattgttttgttaactagtattattatattgtgtatattggttatttttcattaaatgggtgtaaataatgttgtattttttggtttgttaattgattgtttaatcgacaatcttaaaatttattaaaaaattaaaataaaaatattgtttactattgtcattttattagctttgcaaacttaaaataatatgatgaaaattataaattaatttatttcctgttaataaaatttgacatgttttaaattaatacttctaaaactaataccattttatgaaaaattcatttacgttattatttgttttcataagtctttttttgttttctcaaacgacaatgtttggacctgtttccggacttgcttttagaaaaaatagtgtgaaacagcaggttttgcaaacagatactttgcaaaatcgtcttatgaattatcatcttatcaaagataatccttctgtaattttttttaaaaagcttaatacaagcttaaatcaacctacattgtttatggttgggaataaatttggaggcacagaaaataaagtgtatgccaaaataggaagttcaattataagtactcttggaattgctgattttcccgattctttaaaaattacgaatcaggaaataaacgcgaaaatattaacatttactaaaaaagatgttaataaaaggattaatcctattgttttttttaataagagaacggatgaaaaagtactgatccctgaggttttagtttttgataaaaatttatcagatgtggaagcccaaaaaattgaaacttatttagctataaagtatggaattatgatcaatgatgtgtctgaaaaaaattatatttcttcggatgatcatatagtatgggattctaaaaaaaataaaaattataatttcagaatcacggggattggaagggatgatgcttttgaattgtatcaaaaacagtctataaactctaatggtggtaatgtagctgtggctattgacagtttaaaactgaccaacaattttaacaacggaaccattgaaaatggtaattttttattgtggggagataataaccaaaatttagtatttaaagatgcagatttgctttcgcagcaccctaaaagagatatgttaagagtgtggaaagttcaaaataagaccatcgacaataaaattattaaagccaatatatatgctgtattaccggttcagcctcccggaaatttcattaaactaagattatttcaaaacgaaacagattatcagaatgatttatcaactgatattacaggaaaaaaaataaatgatacactttatgtttttaaagacatattatgggacatcaataaagatggtaatgactattttacatttagtttagatgatatccaaagtaatattaatattcaaatgataagtacttgtgaagatttaggaaataatctgatcaaaatttctgtaccgggaagtattttacctttcgaatattctttggaaagcctcactacaaatcagatgattgctaataatttgcagggaacgaacagtcaaataatatttaataatcttaatcctgatcactataagcttatccttaagaaacaaggttataatgatattattagaacttttgacctacaaggtattgttaaccagaatattgatacaaattatctttggcagggcacaccaattgagttggatttgaataccagttccttccagtatgtgttaacaaatccaaatggtcagaatacaactgcagcaccttattttctaaacggagtaggaaattacgaactcaaaataaaaaataaacttggatgtgagataatcaaaaatttgtcagttcttaatgctgcagattatgatgctcttcagaataattcattatttaagaaaattcaggtttctcctaacccttctagagatggcaatattattattaaagtggagttaaaatctgctaaaccattagctgttaaaatatttaacggtttgggtattctggttaaacaaggagaatattcttctgcttcagagtttactattccaatgtctatagcgcctgttgctggatattacagtattaaaatatttattcctgaagaaggaaaaagtgtcaatttcattatctattaaaaaaactaacaacctctatactcatcatgagaaaaagatctttcttcaatattaagaatattgatttgttaccagtttgtatacccattattctttctttatgtagctggactctttatgaagtttcgcataaggatgataaaatcagaattatagcaaatcaaaatttcagtccattcaaaataaattgtgattttcttaaacctttttctggtgggaaaaaaacaaattatttggattctggaaatggactttcagattcatcatccgttgcattaaataaaaatagtagcataaataaagattttttatttccaccgcagaaaaatattttttacaataaaacttctataaattcagaatatattggtgaaattgggaataaggatacaaagtcttgggatgccgatccttctgataatatttttaatgttaagttgtctgatattaaaaaaaatacttcttacacacttacatatgaagtagatgggtattcagacattaattctgttactagaagtattaatgggagttttgcggttggtggatatatcaaagtgaaacaatccggatggactgaaattaaggaaaatattgatccaactcttttaaaaacagggaataattttattctttttaatactctcaataaaggagattattataaaataaaaaatgtaagaatctcggaaaatggtatagcggatcaaaaaccatatcaggttatatctcaaatttatcaagataaaactctttacattcgtgggtttgtaaatccaacctcatcaattgatgctgttgaaattgccaataaaagaattgagctgcatggaaatgaatttgaatatttatcattaactgaaaataatgaaccttctataaatgttaagtttattgggaaaaacaattccttacatgcagaaacaatctttaaagataacaagaatatagtttctacgattgatatatataaagagtccggtagaaacgtaatcttcagcaatgaatcaggtgttgtatttggacttaggaatattgatcttccaccagtagatcaatcaatttcgaatgtaagtgcagattattatggattccgctttaaaaataatagtttgaaagaaactattatacatcttccatatgacgaatctaaacttccgaatggttatcatgaaaatgatataacaacatttacttttgattatacacataaaaaatggatgccagtttctgtggatagtataaatagtgaaaaaaaatatgttgtttttaaagctttagccagtggtgcagcggattatatcaatggggttgttaaacagccggaaagccctgaatcaaatgcctccgcttcgacaagttttaataatgctcctgtagcaaatccggcctctaaaataaatctgatatctccgccttcagccaatcaacaagggtcggctgtagtgcaatatccaattgaaattcctaaaggaaccagtgggcttcaacccagtgtagtaatcacgtataacagtgacaataaatcaggatgggcgggaacaggatgggatattcctgtagagactattgatattgatacccgttggggaattccggcttttgatcctttgaaagaaagtgagatttatacaattggaggtgaacaattagtgttcaaagatgattatttgcctaataaagttcagtttcaggaaaacagaagtgcaggagataggaaattttattatagaacaggcgttacggaaggtctgttaataacaagaaaaggatctacaccatcatcatatacctgggagatattggataaggagggtgtaagaaaagaatataatgaatttttaacagataatacttcttccaattcttcaggaaacagaataagctggtatctaactaaagtaacagaccgctatggaaacaccattgtttataactataccgattcttttgaaggtggaggcaaaggcaaatatttgtcatcaattacatacagtaataacacagttatcagttttgataacgaatcaggagtaagacaggacagagcttttacatataaatttggagttaaacttacagaggctaaaattctaaacaaaattacagtatcccgggccaatacgaagataagagaatatcagctttcaaatacaactataggacaattcggtaaaagacttttaacggaaattatacagaaagatggtaatggcaatgaatttaacagacataagttttcctatagtacagcaagaatttttgaagacccacctaaaacatataatacaggaaacgatatcggaaatgttggtccgtttaatggtggaaatgcatctgctattagcggagatttcagtgataatatcaataagatccgtgggtctcttacttttggaagtggatcaggctgcttttttatagggttcaacaaaaagaatacttttgggattaatgcttcttacagtgaaaataaaacgtatggtaaaggtcaattgatggatattgatggtgacggtttacctgataaagttttttatggaggaaatggaaaactatggttcagaaaaaacagcatgtcaggtttcggaagtgtttctagctcggtaaactggcctgcagggactccgttatccaaaacaagctcttatataggttctgcagggttagaatttgtttacaaacattacgctgctggtgtaaatgttaactggaccaataataatacaccggtatatttttcagatgtcaatggagatggtcttccggatttgattagttatggagatgtgtatttcagtagaatcaggaatggtgttccggagtttgagccacaacaagatggcggaccgaatgtcacagaaactacacctaatgtaatcttaagcggagtaccagctgtacaggttatagagcctgggcaaaccggaccgcagcttcttggtaatattgtaagaatgtgggaggctcctgttgatggcaaaataagagtgactaccaatgcacaattagaacaaaattctaccgatggagtagacgtttggatggaattgggaggaatgacaaaggattatgaagataatcctgcatatgtaccacctcattcaacaatgattggatcaaaagttacattaacaagtcccggtcaaccaatttcgatcagtgaaacagtagatgtaaaaaagggtcaaaggatttttgttgtagcaagcgccaaagaaaatccaattaaagataggatagtaactaatactgagatcagttatttttcaagtaacccaacagtaattccaaaagatgccaatgggaattattattacggttttaattcgtcagaaagctatttggcttcaagtaaaaaagggaatcctgtcgcagataaagctacggttaagatttcctggggtggtttaaccaatcaggtatttacggatgatgttaattttaagatttataagattgttgttcccaaaacggatacaaccggatttattcagccttcgacttctaatttgatttatcattataaattgcccaaaggagcaactcttaataccttaacaacaacaagtaacctggtttcaggagttgatttatcgaatatattggtaaatcaggttgtttctgattctaccgttacatttttcaattttgatgtttctgcagatactaatgtttcctgggaaaaaatcaaatggaagccgcagattgaagtcacaacagccactgatgtcttgctttcaaatgcattggtgcaatataacccttatggagaaagactgacgaataacctcccaaaggattttactcaatacgctatattttctgaatgcagattcttactttatccaaaatttacaagtgatgttagccagccacttaccataaatcttcctacactgcataatactacggttactttctcgctgaaacttaaaaatgcaggtggagatattcctttttttgccaaaaatacagtcaatgtagtaaataatgtgatggaaattccaaagcttaatttctgtgatatttttggtgtgaatggggttcctggaatgccgtatgatcaattgtggcaacatttattctactttgaaattacttcacctgattatgaagttgcaaaaaaactggcacagctgaatcctaatatatataactcatggtttgaacaaccgccacagccttcttcacttgctgatacagggcataaagcagattattttgcctatagagccaataacattcattataacattagtacaggtttagtttatcagggatggggaggcttttcatataatggttccaaatataaaaatgaaaccataagagaaagcgagtttaactcaagtatggccggctttaatgttaatatgcagaatccttctattccttgttcaggagatcctacttcacaggcatatcaggattgtgtgatggattacatcactcagatgatgaatagcaggtatttcacccctattgatttgaaaattgatgcggaaacatactcatctccactagagtctgccgagctagatcaatatcatttacagcctgctttgttaggaacatttacagagccggatacagagtctcaatatccaggctattcagttccgaatccaaggggtattattaagtattcaaaagggacaggagttaatatgtatggaagtgcctttattattggcggtaatgctggtttctccaaagattatactaaagatcattttattgattttaatggcgaccggtacccggatgttgtttcaggcaattcaattcagactactaacctgttgggacagttagggagtccgggaaatacatttgaaagagaaatgtacaatacaactacaaactttggtctgagcctgggtgtccctgttcctaccaaatttagtaatactttaaatggaggatttaaatcaggaggagaaaaaggaactcatactacaacttcagcaaatgcagttggaattgggctaaatgtgcagttaggacaggcaaaatcaaaaagcaaagcagtttggtttgacattaatggagatggcttgctggattttgtatcggatggtacgttatacattaataatggaaaaacttttataaatgaagcccataactggaatgtctctgatctttccaataacaactcctcctctttatctggaggtggaggatttagctggccaaatggaagtttatctattggtgtaggattggctcagtcaagatctactaccaatactgcatttatcgatctcaacggggatggaatggaagataagattgtaaggtcgggaagtacttatgaaatgctcattaatacaggaacgacatttacaaatgatatgatgagccaggatttcgaactggaaaacaagcaaaattcatcaggatttaatctatatggaacattatgtttttgcttagggataaaagtttgtctgggacttggatataataaagataaatctgtaagtaaacaaaccgtagatttaagagattttgatgccgatggtcttcccgatttgctgatttctgatgatgaatcaaatctaaaagtatatcacaacagtttaggaaaggcaaacttattgattggaattaccaatcctctcaaagggacaatggcacttgaatatgatctgtataatacaaaaaataattttggaagccttataggaggtacgtatcagatgcctttttcaaaattagcattaacaaaggtaacgatttcggatttagcatctaaaaataccattgctcagggaatcccaagaataattcctaaatctcaggtgacatttgagtatgaaaaaggaattcaggacagaagagaaagagagtttttaggatttggtattgtaaaaacaaaaacatatggaggagcagaggggcaggcttttactcttcatcagactcatgttacagagtatgaaaccaattttaattccagtgatttctttgtaaattacaatgatacaaaagtaagacagtatttttataaaaaaggactggtaagatcttcctatcttttagatgctaatggcaaaaaacgttctgaaactaattttacatacagatactttgatcagctatccaatactggatatcaattgtcagaagggcaggctgaaccgcagtataaagatatcggcaggattattcctttactctataaaactgaaaccataacaacggaagttgttggcagtaccagccatagtaaaactttaatttctacaatagatcagtatgataaatatggaaatgtaacctcatatacagatagaggaacgacgctggcgacagtgtcggatgatatctcagttaaaacagaatatcatgatcccggtgcgaaaaatattgtaggtgttcctagtaagaatactgttaccgcaggaagcattacaagggtaactacttctaaagtagatgccaaccgcaatgtaataaatgtttctaaaacaataaatgggcagcctgctgagtttgatatggaatatgatgcttatggtaatctactgaaagtaacagaaccaatttctgccaataaccaaagattttctaaaacatttgaatatgatcctacctatcatgcttatatgattaaggtgacggattcttataatctatcaagttcaactcaatatgatgcaaattatctgttgggagtaccaactgttattacagatgccaatggagtaagttctaattataactatgattcatttggaagggttactcaatataaatccccggttgataatgactggacgattaagttctattattatcctaatgaaattgttcctgtagctattaccgaaagaaaagctcccgtagtgaatgatgttactcctgctctgaattatttcagcagtttgttcaccacagtatggggagaagaattagctgtcaagaaattatttaagaactccggaactcagttttcttatgccaataatgtttttcagcttaaagataatctgggaagacctgtaaaaacaattcttagggataaagtgaccacaagtacaaatgcaagtacgattattccttctttgaagacctatgatgattatacgaactccgaagatcttgtagcaaaaatatttgtgtcaacgacttatgacaacatggatcgtccgctgagggttacccagaataacgttcagaccaataatggactggaaaatctggctactgaatataaatacggattcggacccgatagggatggagtgactcagtttatgagcacaacaataagtcctttaggaaatacctctgtagtttatacggatgaaagaggacgtaccacctcatctaagcaaacagatggaactcagaatttatgggtaagtaataaatatgatattctgagccagctggttcaggtaaaggatcaaaataatgatattacgacctatcagtatgacaattggggaagaaaaaccaaagtaatacagccagatgccggtgaaatgaattatagctatgacaggacaggaaaactgaccagttcagacaatgctttacttcttgcagcaggacaaagcgtgacctattcttacgactataacaggcttatgcggattgattttgctcccaatgattttgtgaggtacgaatatggtatagcaggagcgtccgacttttcggccggccgtttggtaagccagcttgataaaacaggattccagacatttaaatatacagctttagggcaggtcagagaaaatacaagagtaattgtagcacctaataatacccctaaattattcaaaacgtcttttgtatatgatgtatataacagaattaataaaataacgtatccggatgctgaagaagtattctataattataatgaagcgggattattaaaaaatatatacagtaaaagcccggtaaaccaaccgctggttcctattgtaagcgctattacatatgataacagggatcagatggtttcatttgccgccggaaatactacacaaagtaattataattatgacgcctggggaaggcttgcggaattatccttgttttataacaacaccggagcacagatacgcagaaatcagtacacctttgataaaaacgggaatgtcttgaatgtttcaggtactacaccaatgtcggggagtttcccggcaagcatgatgactgcagccagccagaagtcttatcagtatgatacatttggaagactaaaatcttcaaaaattacagctaccgggaaagattatacccagtactatgaattggatatgacgtataatgcggtaggaaatattgatgctaaaaactatagattaaaatcttatcagaataatattgcgtgccagaatcctggaaacctggggaaagatgcaaaatactattataatattacaggacatcctaatgcggtctccagaattgaatataaaaggaattatccttttgacagtcctatggattgcggtcccggaaatatatttccatcggacggagcagaagagtttacttatgatgttaacggaaatctgaataagttatataatattgttggaggaaaagcagagttgcacagacatttattctggtctgaaagcaataatctgaaagcagttggtgaaagaggagtgttaagtcattatgtatatgatgcaggaggagaacgtgtcctgaaaagtgatggcgtttccaagaagatgtatgttaatggaaacgatcctgaaaaaactacccagatggggagttatacttattatccgagtgggtttatggtacttggagagaaatcaatgagcaagcattactacattggcggacagagaattgcaacaagagtaagtgctatgccttcccatagatttaaaattgaagagaatggtacctattccggcttgcgtcatgtattggaagaagaagttaaaggtattgctgttcaggctcagtatccgcagattgtctgggttcctaccgcagatacacagggaacctatactcctccgtctaataccttagttaatgagccggattgcgcttatgttattgagcagctgattattaatttttctcaggataatgataaagaattatgctacaaaaatttcttggacaaatataatgaagtattgaacaacggtggaagcttctgtgcgttattggatgaaatcaccaatagtaatcctgatgggtgcttaacaggggagacaattccggaaatcctgagttctgaaatgtattggatacatccggaccatttagggagttcttcagtattgacaaatagcatatctaaaattaccaactggtacgagtacatgccgttcggagaatccttgatggaattatccaataatgaatatggtaatccttataagtacaacggcaaagaatttgattctcaaacaggatggtattattatggagcacgatattatgatccgcaaagaagcttttggctatcggtagatccattggtagaaatcaccatgtcaccatatgcctatacatggaatgatcctgtcaactatacagatcctacaggaatgatgggggaaaggataggggagcctgggggaccgaacactaataaagtatatgatggcggtgttatagaagagatcgtgcttaaaggcaaaaaattgaattggctgcaaagagttggtagatttttgggcttcggaaattcaccctccagaaatgcaacggcaggggaaataaaaagcagtaacaaattaccatggtatcttaataatagtaaatatggagggaagccagttttgacattaggggctcataatattgaatttccgtatattgaacgagaagaatatggaaataatatctttgaaaatggagatgcatttttaaagaatactgctggtgcaatgtacaatggtcttgcttctacatggaatgatggaatggcaggaaaagaagggtgtagttttatgtatgagggagatagtgatattgagtctactgttaggcatatttctagaggaaatataaatgcaatagaaatggaaggtatagcagctgcagttatttttcataaggtaggagaatttggagagttaagaggttcgggcccagtacctggagtattagaagttagtgatagagtaaagtccgtaggtcaatttaaaaattattttccaaaagaaggtacaatgatagagtttgtatttgatgctgattcaaatacttttgtagtaggaaagcctcatggtagagaagcgggggcttccccccatcaaaggctagttctttcattaaataaaaaagggaattatgtgggaggaatgtttaaaagacaaggaaacacaataattacagatgaatattctggacattatggacataaatggaatgatcaaatcagaaagcaatttgtaaactatatggaacagaaaacaggtctaaaagttaatcatacaatatggaaatgagaataatatatatatcagagattaattatgagtgttatttttacgatagttgttggaaagtagtttacgaaggtaaaaccataaatattaatataaataatttctatggttatcctttttatataatttttgaaaatatagaaacggtgagtaaacagttaacaatgctaatcaataaaaagaatatattgctttccgatatttttccaatagaactaatcttgaaagatattattgatcatgaccaaggttactggttaaatttatgtttatattttattattaaaatggaatgcttagacagtaatattatacagcttttgattaaaactcaaaataataaaaaattgagtcaagaattaaggcataaaataaggaaagttatacttcttaataattaagtataatgtgcttgtttttaatgacttaaaaaaagtattgataaaagaaaaaatacattgatggaaggaagttccatcaatgtttattacgataaggaaacaaataaatacgtttttccagatttgattgatgttgaagaattatgagtattataaataataaagatgtacgttgggaatataaaagcctgtaatatgtagattgtgtcggtagataagaataatccaccgcaattgcagtggattattttgttttttatactttagaatatttctgcctggtttactttaagtggtttttgaagatgtaatgtaaatgaatttgcaactgaacctacctaggcgagaaaatatggatatcattttaactcatttaaagatggagcagctaatttttagtctacagctgtaatctgtggaaaacatcaataatggaaacaacaagaaaatttaaacaattatcagttcaaattactttaaaaagtatagataaagaacaaagtgattggattacgtttaatgacaaaattcatactaagataataggagatgattattgtaggtcaggtataatgctcttggtaaatgaactgcctattatggaatgtgatcttaaaaattcttactttttaattacaacagaccggattatatctgtaatagatggtttttacgatgaagtattttttattgaaatgaacaatgtatcaaatgaatacaatactgaaaattttaaacaaattaacgggaagtatccaaaaacaaatataattgctgttaaaaaaaatgataatacaaccttgatagcaaaaatagattcttattatcctgcttattttgctaaaatgttgatatataatatcttttcttataaaaagcttgggaaatggtatgttaatccaaagtaatcactccataataagaaatacgattaaaataattaaaaaacagaatatgcagattttatctattgggataatttaaatacatagtaaataataatatacttatttctaatgaagcaaaaacatgtaccagttaacaactcttaaaaatatgtcattccattttactgagtatcatcaaaaagtttaaataatattatgaaaattaaagatgtattacaagcaaaacctgatagcgaatttttatacgaaaagttagtagagttaaatgaaggtggagtttttacacattaaaaaattgaatcgaattttaaaaaaatatttctgcagataacttaaagtattcgttaaaagaaacaatattggttgacttttattacaaataaaaaatctttttatggattatatgtcatggaattacagaggaatttccttttttaaagaagaagttattcatcttaatggtgaggataataaagaatttccatcaataaaagactttcaacaaaatggagtttatacatcagaagttagaaagaaattgtgtaagtatttagagaattgtccagcaattgtttccacttcttacagacgactgaatgcttacacgcttgagccgatattttctttaacatattttacagatggagaatttattttcactaatttgttgcaggaatatatctgctatgataattttgttttacctcaaaaatggtatgaattgattaaaatccgaaactatatcaatgacaattttgaattaaactatgaaaaaatttcatcgggagaaattgatgtatttgataattttgagaaaagttttgatgataatagtattatttgtgatgttatactataaaggctaaacacaacctaataagatagatacctggtttaagaatattggataaaaagtaatggataaatttataatattaaagtcaagctggggaattgctatatcttatgagataattgaaattataaaccataatcaaaatgatgaaaatgagaatgaagtaagccctccggtctttgttaggctaaaagagaattcattagacaatagttctttagagtgtttaacaaaaggaataaaaagtataacacaatttatcaaaatatttccagtttgtttttctatagaaaaattagaatataatgtctgtgactatcagcccgagggaatgtattacatgtttaggaaatggttctttgaaaaccataacatggagcttccccccattaatgtttattatgataaggaaacaaataaatacgtttttccagatttgattaatgttgaagagttataagtgttatatgtactcatacacattatgaaatgaaaaaaatcattttcttttataatgtattctatttgtaagaatataattagatattcgtaattaaattgtaaagtaaaaagtaatgattctaagtaaataaaaatggcgcctactataaaaagttggcgccattttactttcagtgacctcgacaggattcaaacctgtaaccttctgagccgtaatcagatgcgctattcagttgcgccacgaggccatttgttaacttgttgtttaacggttgcaaatataccacttttttccgttctttgaaacatgaaacagaaaattttacttttatttacggtcttctcgctaattgcctgtaaaagagaatcaaaaatttcgtccgcagactggacaaatatctccgctcgtacccagtttaaggagcatgatggtatcctggagctaaaatcgggtaattttacttacaattttaagcaaaatcaaacacctttcaggaaaataatgctgttgaatgcaagtatggcaggttatatttcggagcttggggcagaaaatttaatcataggtgtttccagtccggagtatatttattcagataaaattcagaatctgattaaagaaggaaaaatacagaatgtaggaagtgaacagaaatatgatgtggaaaagatcatctctatgaaaccggatgctatttttaccaatcacattgccagttttgacaatacctatgaacttttgaaaaataatggtattcaggtgatatttctggatgaatacatggaacagaaacctttggaaaaaacagcctatattaaacttttcggagaatttttaggaaaagagaaagaggctgaagttaaatatcaggaagtagagaaaaactataacgatctgaagcagcttgcgtcaaaggcaaaagaaaaacctgttgtacttgccaatgagatgtatggagatgtttggtatcttccgggaggaaatacttccgtagcacattatatttcagatgccaatgccaattatatcatgaaagataataaagacgaaaaagcattgacaatgagttttgaggaagtttatgcaaaagccggaaacgttcagtattgggtaaatgcaggaagccacacctcaaaaaaagagatgttgggcatgaatcctttctatgggaaactggatgtattcaataaagggaaaatttataccattgccggaaaagaaaaactgaaggcaaatgatttctttgaaagcggtgtggtaagagcagatttgattctcaaagactatattaagatctttcatcctgaacttttaccggattatcagcttacttatatgaaagaattgcagtaactcgcagtatttgcttatttttgcctttcctttttatcaagttatgtggaaaaaaattaaacagcttatcttcatcattcttgtactgaatgtagtttttatcatctggggcagattcttcaatccaccaattacccttacccagataggaggactttttgaatacggaaaactgcacagagattatatatcctatgacgaaatgggaaacaatgtgaaaaaggcggtaattgcatctgaagatcagaaattctttgatcatgacggtttcgattataaggcaatcgaaaaggctatgaaatataatgagaaaggcaaaaaaataagaggaggaagtactatttcccagcagacggcaaaaaatgtatttctatggcagggcagaagctgggtgagaaaagggcttgaggctgtttatactttcatcatcgaaaaagtatggactaaagacatcatccttgaaagatacctgaattctattgaaatggggcagggcgtattcggagtagaagcagccgctcaatattatttcggaaaatcttccaaagatttaagtgtctcagatgcagcatggattgctgctgtattgcctaatccaaagaagtatgatcctaaaaatccatcgccgtatttaagaaagaaacacaattggatcatgagacagatgaggaatgtgagtttgaaatagtatctttgtactaatgaaattctttaattccagcacaaattttgagtcagttcttaaaaaatacttttcttttaagaacgaaactctttctttagagccttttgcagagtttttagaaaccataaaagaggcggactttactgatgtgctcaattttttcagaagtaatcccaactttgctgagaactttaaatattatattcacaatatttttataggaaggccttttaacctttctctgacagaagctaatattctttcagaaaatgccttttttccggaacttaaaaaaagaattctgaacaaggttctgccacctgttgaaaatgagaaaacggtgtggtacatgattgataacgtcagcctgcggccgaaaaaagatctgaaatacctgcataatcttcctgagaatgagattaatgaatttttaaaaattttaggagcttcggactttattatccgtcctaatgtgaaaaaagagctcattttctctatgaatatcctttcctggagggttacaggaatggctatggaagtagaggtagtaagaatggctccacagtacagaaatcttgataatccgtttcttgccctccagaatgaactggagacattagccgaggatctggcaaaagatccctatgtacagctgcactccaaagacagcagatataagcagatcaaaatttatacagagcagtgccttgagtttgttaatattgcttttaagaattctgccaaatacggaatttcagggaagattaaccaatcccttctgaaaatccgccagcagaccgaaagaatttatgagatcgtacaattactggtgatcgatactgatgaagatgttcttataaaatctaaacagcttgtttttaatattctgaactataaatctcataaaaataatatttcagatctgatcaatgacagcacgagactgatctcccatcttattaccaatcatactgcagaaaccggaacacactatatcacttctacccgtaaagaatatatgacgatgttctataaagcaagtggtggaggaattattgtaggagcactgtgtgttctgaaaatgctttacggatatatcccgggaagtgatttttcgcatgcttttctgtactctatgaattatgcgatgggattcgtgatgatttatctgatgggctttacgctcgcaacaaaacagcctgcgatgacggctgctactatgacaaaagtactttctgaagaagggaatgcccaaagaaataatacagaatttgcccatttggtttctaaattattccgaagtcagtttattgcctttgtaggaaatgtattgctagcgtttcccatagcacttgccatcatttacggactggatgtatttttctctcagaatcttgctgtagaaaggtctgataaattgctaaaagatcttgatccatttaaatccaaagcgattttacatgccagcattgccggattttatctttttatttccgggattatttcaggaaatatcggaaacaattccgtgttttatcagattccggaaaggattgctaaaaatctgtctatcagaagctttttcgggaagaaatttgcaaaaggattgtcaaaatattacgccaaaaactggccgggtattgtctctaatttctggtttggtgtattcctgggtgctacagcgccagtcggaatgtttttcgggctggatcttgatatcaggcatattacctttgctgccggcaattttgcattagggttgtatggaaaggatttttcggtagattcctacaccttctggatatctttcctaacggtatttttaataggtttcttcaacttcctggtaagcttcagtttatcgatgttcctggcattccgatcaagaaaaatgaatttcggacaggtaagtgagatctataaagaaatcttcagatattttattaaacatccgttaaagtttttcctgccattgagttcagggctcgataaaaaagcggatgatctgatgagcagtacgatttccaataaatcagaagaacattgatcataataaataaaaaatgctgccttagggggcagcatttttctatagttatagctatttaaggcaaataggaagtcatcaaagaagtttatagaatctgcaaatccctaaatttctctgccccaaatttatcctgaaactttttcagataaaagcttttacgcattttaaaatcatgtttcaataaaggagaatcaatcttaatcacaatacattcattttctatattaacgctttttatttctttgaaaagactttcgtctagatattcttcaaggaaatctttgatgtcaaaagcaataagtttatgttcaaaaccatacattctggcaaaagattttaccagttcggaggattgatattcacgttttttcttcttcattttcggagtgcgtggttcgtgggagtgagttacgtggtccgtggtccgcgatttatttttttattgcagattatttttattccaattttctatgacccattttttataaaagttaatttttccacctaatatattatattcattttttaatgtttcaaatgtcgtggagacatcaggatatagtatgataattttctctaaatgattaatggtttcatcattacttgcatggctgtaaatgaggaagcgaatgtaatcatttttataaaaggatcttccataaccttcaacaatatttgtaattattgaatctgaagatcgccttaattggctgcctaattcaaatagttcatatttaggaagaagatgagaggctttatgggtctttaaaaataagtcaaaagccattttgtaaatttcaagatttctataactcatatcatttatgtttaggatattaagttaagataaaaccaaaaataatattcaaattttttatccaaagttttcaaccttgtacttcaaattctctaactcgaatcacgtaacccgcatcccgtatctcagcactaaacctcaaaaattatactttcctcattgatcttttttactacactttctgtacgttctctgtgagtatctgtgatgaaaatctggccaaaactttcacgattaaccagttctatcaattgggaaaccctgatatcatcaagtttatcaaagatatcatcaagcagtagaataggagtctttttcgtgagctcttttacaagactcatctgagcaagctttaaagaaataagaaaagatttctgctgtccctgagatccgattttcttaattaaaacatgatccatttcgaaaagaaggtcatccttatgaattcccttcgaagtataggttagcatacggtctttttcaaggctttcctttaaaagattttcaaaagaatcttccagcaaatgagattcatatatgacagatacggtttcttttccaccggaaataatcttgtagaaattctgaacaataggattaagctgttctacgaaatcctttcttttattgaatattttcgttccgaatctgataatcggatcatcatagatttcaagcgaatctttatcccaggttctgttcttggcaaaatacttgagcagcgcatttcgctgctgaatggtcttctgatactgaataaggtcaaaaagatacccggaatctgtctgggaaatcatagagtccagaaacttacgtctgctttccccggaatccgaaataagattggaatcataaggagaaatcataacgctcggaagatagccgatatgatccgcaagcctgtcatagcttttatcgtttttcttaattacctttttggcttccttaggctgggtaattctgatgatgtcttcactatcctcattctgaatttcagcatcaatggtgaaaaaatcttcctctttttttatattgttgagatctgtattgcctaaaaagctttttcctacagataaataatgcagggcatctaaaatattggtctttcccacaccattattacccacaaagcaattgatctgtggggagaattcaaattttttctcagtatggtttttgaaattgtagagggaaagcttcttgataatcattcgtcaaaaatacttcattattagtaaaaataaaaaaggaagtgcagaacaagtttccaccccgaatgaaaaataagcgtcatcccttttattttcagagaaataaataagaatataagttgcaataccagccataaaaaaagctatggcatattgtaattcaagaaagaagataccaattatattactgatgaaaacgagtgcataggcaatatatttggtattttgtacccctatcagcataggaaaggtttttactatatcactattcatatcccggatatcaaagggaaggacaagtgccgtaataaagaaaaaactgatcaggaaaataggaatactgaattccggaagcgtaagccagcagttgacaagtgcccagaccaatcctacgtaaaaaaccttcagtaaaggaattttacggatataaacatcaagaaaaaagctgttataaagcaatcccaacacaacaatgatgaaccatttcaaaagccttatttcattatgattttggatgattaaaaaagcacaaataattccagctacagcattcagaatcagtattttgaaaaaatgtctggtatattgatatttggtataaaggtaaccgctgaaataagtgatgaaaataagcagaacggtagggaaacggaatgtgttttgctctttcataaaaaatactgcaaaaagagttcccataagggagacataaatctggctgtctatgacagtttttttcagtacttttaagatgttcatttatcaaaattaatatatatgaaaagattttccaagatttttctgcttttgcttgtaatgctgagcttttcaatggtatccgcacaaaagtattacgatacccaatggaaaaaaattgctgaaaacagtacaaaaggagcgtataaatctaatcttcccattattttagacatacaaaaacaagccatgaaagaaaataatgccattgagctgatccgttctctgaaagcggaattcagtattgtaaaccaaacggtggatgatgatcagaatgatgctgcttcccaatttttcaaaaaacttaaggataccgaaggaaagctgagcggtgaaggtaaattggtatacaaagtcctgctgaacggtttcttcatggattattacaatcagaatctatggaaaataaacggaagaactaatatcaattctcaggatgtttcgcagatagaaacctggagtaagcttgattacaaaaattatcttaccaaaagctttcaggaacttgatcaggaaaaacctgaaatgaaaaagattttactggaaaaatataaggacatattttccggaacaaacgatatcacttattttccgacactgtctgattggtatgcacttaaaaaagtagaatttttatccgaaaacaatattttcacaaaaaatgaactgactgccaaccgtacagcgatcaatgccatctatgacgagctgattgcacagaacaccgggaatgcaaagctgtattttatgaaagaaaagattacagagaactgtaatttcaaccattgcaaagacaggcttgagcagcttcagaatctcttaaaaactaatgtggaaggagattataaagtggtaatcatgggagatatcatggatgaacttgttaacaggaagaaacctaaagaagcacttgcaatagctgccaaggcaaaaagtgaatatccgaaatctccttttattgaaaatatcaaaagtaaggaagcacagattgtgaatccgtacctgacgatcaaatatgaatcccagacccagaataacctgtcgattcattttgtggcgcaatatcagaatgtatcagaatttaccctgaatatttatgaagtaaaagatgatttcacttcaatgcttcagtatgttcagaatccttactccgatactttcggaaagctgaaaaagaatcttgtaagaaaagaaatattccagcttccggatcctaaggattatcagacccataaaacttcactggaagttaagccgcttccgtcagggttgtatgttgcagagtttacagttgcagtttctgatatgaaagaaacagactcaagagagaacttttatttcctggtttccggaaataggattatttatcagaataaaacggacagaaatcctctttctgatgagcttaagctggtaaacagtgaaaatggaaagccggtaaccaatgaaggactgaagttttatgaatttgtttccaataaaactttaaataaaatagatggaacgaccaatgcaaacggagtatttaagtttccttccacagaaagcaaagactattacagaactttccttattcaacagcctaagaccaatgattttcagatcatgcaggtgtacggaaacagaggctatgatgacgattataaccctaataaacaaacccgatcaactgctcagatctttatcgatagagggatttaccgtccggggcagaccgtttatttcaaggtcattaatacaaggcagaataaagaagtggaagctgttatttccggattaaaacaaaaaataactttactgaataccaataatgaggaagtttcttcccaggaattcatgaccaatgagtttggctcctatcatggaagttttatccttccgaaaggaaagctgaatggtaatttttacctgaggattgaaggagaaagccagggatacaaaaatttcagggtagaagaatataaaagaccaaagtttgaagtaacgtttgaacctgtaaaagaagagtataaatatggccagaccatagaattgaaaggaaaagcagtgatgttttccggagttccgctgagtaatacgaccgtaaactatgaaatcaaaaaacagaatatcagatggaggtatttcagctggtatccgcagaatgatgataatgaaaactcgattctgggcgaagcaaaaaccaatgaaaagggagaatttacgattcgtttagaacttaaaaaagatgaaaaactggaaggaatacaaattgataattataccatcaatgcatctgtaacagatatcaatggtgaaactcagaccgcggatacccaattgaaagtagcatcagtttcacattatatccaggcagaaaatatcagtaatacttttgcggatgaaaatgtaaaagtaaaggtagaaaccaaaaattataatgatcagaatctaaagaaaccttatcaggttaagttgtcaaaactcactgctccggacagaattttcagggataattttaaatctgaggtacagaatcttccgaaatattcaaaagaagagttcatcagtaaattccctcacgatctttttgataaaaatgatgagatcaaaaactggaaaacagaaaaagtattatttgaaaaacaacagcagccatctgcagataatacccagcttgatttagggaaactggaagcaggagattatcagctggaacttttcaatatcgaaggaaaagacaccatcaaaagtgctcagaactttagtgtttgggacaaaaaagctttaaaaccaagccaaaagatattccttacggttatcgctccaaaagaagaattatcaagaggagaaaaagcaaaagtgtatgtttactcagctgttcctgatgcgatggtgaatgtttttgtgcaggatggatccggaaaaaccgtttccgaagttcatcagatgaaaaagggaatattagaatacacggctgaaattcctaaagataaaagtgtctcttcactgaatcttcagtttcagctggtagcatttaatgatgtgaatacggaatctgtttctttaaaaataaaagacacagaaaaagctttgaaaatcgaaaccgttactttcagagataaactggagcctaatgttaaagaaaaatggacggtaaaagtaaccggaaatgacaaggaaaagatcaatgctgaggtattggcgaatatgtatgatatgtctctggatcagtttgctgccaacagctttacttggagaaaactgtatacaccatttgtgatcgttacttcatatggtatcaacaattacctgcagcagcaaaattaccagaaaagattaagatatttcgaagacagatatataactgttcctcagtttaattggtttgatggtgatttttcatatatattacaaggagaagttgcaggacttcaaaatagagaaggagtaaaagctccggcttatgcgctaccgccttcaccaattgctgggcaagcaaaaggtataagaagaaaagctattgctgaagataaaatagcagtagcacagaatgtgttacctgaagcaatggaatctgatgcagacggtattttagatcatgatgatgtagagaaagggcttgataaagtagctgtccgtcagaacctgaacgaaacggcatttttctatccggatctgaaaaccgatgtcgaaggaaatgtcaacttcgagttcatctctccggaagcattgaccaaatggaagctgatgttccttgcccatactaaagacgcaagagctgctaccctggaaaaagaagtggtaacacagaaagaattctcagtgactccaaattatccaagatttctaagagaaggtgatgaactgaacctgcaatcaaaactttcaaatcttaccgataaaaaactgaatggttctgctgaattgcaaattttagatgcctttaccaatgaaaatatttcttcaaaattcggaatgagttcaggggtacaaaatttcagcttaactgaaaacggaagcagcgcattgacatggaaattaaaagttccggacaatgtttcctccgttattttcaaagtggtagccaaagcaggtcagtattcagacggagagcagcaggctattgctgtgttaccaaacagaatgctggtgacggatgcagttccggttttcgtgaaggaaggagaaaccaaaacatttgtattggataatcttaaaaataatacatcaacaacggcttccaatgtttccaatacgttggaactgacaaccaatccgatctgggagattatgtttgcgcttccaagtctgaaaaatgatcagaataattctgtagacgtaatctttaacaaatggtttgctgatgtactggcttcggaaatattcaaagccaatccgaaaatgaaaacggtttttgaagaatatcagaataaaggattattacaatcaaatcttgaaaaaaatcaggaactgaaacagctgctgctggaagaaaccccttgggtgctggaaagtaaaaatgagggcgagcagatgcagaagctggcattattatttgatgttaatacaatgaaaaattcgatcaatcaggattgggaggatttcaaaaaactgcaaaatccggatggtggattctcatggtatcctgggtatccaagttcttacggaacatcgttgtacatccttaaaaacttaggaaaaatcaattcctggctaaaagataacgtgaaagattatcaaagtgctgatcagaaagctcttgttgctaaactgattcagtatgtagacaatgaagttaataagtattttgatgtgaaaaaaggaaatgtctggaacaactgggcaatagactatcttgataccagaaactattgggaaaagcaatatcctttaaaaggaaaaggagctaccctgaaaacgatggtaaaacaaaaagccaagaccgctaagatcacagattttacattcttcgggcttcaccgtgcggcattattaatgaacgattatggtctgaaagaggtgtctgataaattaatgacttatcttaaagaaacttccacagataccaaaacacaaggtgtatactggaaacaaaaccttaacgattggggatggtttggttctaaagtggtcaaccatgccggagcgctggaagctttcaatttgttgaaagctaatgatcaatcttttattgaagatatgaagatctggctggtaacccaaaaagaagtcaactcatggggaagctcaagagaaacagcagaggtgatctttaccattttgaattcaggaaaatcatggactggagctgaaagtgataaagctactatcgtttggggaggaaaagaattaaatcctcagacacaggcaacaggttatgtaaaatcaactttgaagccagaagctatagataaaagcttagcctcagtaaccgttaccaaacctggtcccggaattgttcagggaggattgttctggcagtattacgaagacctggataaaatcaaatcttctgaaaattatatttctgtaacgaaagagctttataaaaaagtaaaaacggtaaacggagaagagcttcagaaaatatcttctgaaaccccgttgaaagtaggagataaagtaacggtaagaatgattctgaatactgacagagcaatggaatttattcatattaaagatatgcgtgcagcaggatttgaacctgtagatgtattatccggatatcagtggaagaataatcttggatattaccagtcgaccaaagatgcttctaccaatttttatatccaatacatgccgaaaggaaaatatgtatttgaatacgatgtagtggccaacgcatccggtaaattctccaacggaattacaacgatgcagaattattacgcaccacagatgaatgcacacaccaaaggaagtaacgtaacaatttcagagtagctgataagcataaaactgtagtaatttttactgcagttttttgtttaaagatttggaacagaatagaattaaatcgaaaaatcaaacaaatgtttagttttggaatggtttttgaaattagatgagtacaaattaaaaaaattataaagatgaaatttactaaaactttaattacaggattggtattgatggctggggtaaatgctttcgctcaaaagaaagcagaaaagtttgaaaaactacagattgaaatgttcccaaaggcaaaagaaggatataagcaggtatatattcagcttcccatagcaaaaaacgaaaaagatttaaaagtagaactttttgttggggctgaaaaaatgttagactgtaacaattacttcctgatgggagaaatgaaaacccaggatcttcagggttggggatacaactattatgaagtagagtccaatggagaaacaggaggaacaatgatggcttgtctggataaaaaactgactaaaaagtttgtgaccttaaagcctgaaatcgtaagatacaacagtaaacttccgttggtattctatgtaccgaaagatatcgaagtccgctacagaattttacgtccggatgctgcgatgaaaaaagcagttcagaaataaatcagggtattataatgatacagaaaaactcctcacagtgatgtggggagttttcgttttctttgaagtatgtattcgtgtaaattcaacgttatttctgtcattccccaggagtccagcttccaatattcagagtcaacataaatgatagtgttttctgttaccaatgattttagctaaagccaaattgaagttttgtttttttattaaacgggctcccttcgactatgctcaggataataacccattcctattgaatatcaaattttactgattttatagattaagtaattattatacaagcctattcatccagtttgtcatttcgaagaaatctaaattcagaatgttttttttccagaatgttcttttttcctttttgtttcctacaaaaaatgtcgtaaaaacaatactgaaaaagtagagttaaaattttttttcaggttttctagtatttaattaacatttaaacgactccgacaaaactttattttataaggttttaaacttaaacatattttaaacttactttaaattcactacattgtagaattatctttaagtatttaacctttttttgcattatatttgttgtaaacataaaccatgaaaaacaatttattgatttttacgtttagtttttttgctttccccgcttttggctgggcacagtctgcgccggattttaaagaacttctggatagtgctatggttcgtgattcgaaccttaaaatgcagattacccaaaacaaacttaccgatctggatgaacataaattgaaagatatctttcttccaacactggaacttagtggtcaggccggttatctcaacggaacagcaagacttacgtcaccggaatttaatctcgcaccctttatcaatattccggaagggactttcaacaataatttcaatgtatcaggattttcaggtattgctaaggcagatgccaaaatgcttctctattcaggaggaaaggttaaatacatgaaaaaagcggttgaagaaaagaaaaaatctgaagatatacttctggagaaaacaaaagatgaagtgattgccactatttccagagcgtatgatcagctggccctgattcatcagtctaaaaaagtgctggatgaaagtaaaaaaagactggatatcaacaggaaaacagcagataaagcgctgggttatggtctgattactccttacgatcataagaaaattgagctggcacaggctacgttgaatgctaaaatggtagaatatgaaggtaaaaaagaattacttcttacccagctttatgttttaaccggaatcaacaaggaaagactcagaatgattgatccggtattatctccggtggaactgcttgctgcagaaaaaggaatagaacagagagcagaaatccgtgccttggaacatggcatcagtgctgctgattataagataaaagccgaaagaacatggatgattcctaaggtccagctaatggcttctgcttattatatcggtttgtacggaaacagaataaaatcctcagaaaatgtgattcctgcagttccattgcttggatatgaaggaaaaaaactggactggaggcccaataatattaatgtatttccattgattacagcaggagtaggttttaaatgggagatctttgacggaaaagagggaaaacatgctgaagaaacagccaaagtcggaaaagaggtattacaaaaccagaaagaagatgcgctaaaaaaattaacactgaatctggccaataaccaaaccaattatgatattgcttccgcacagattaccctgaaagccaaagaaaaggagctggcaaaaaatgcacttgtacaggcagaaaaagaattcagatatgggatgagcaaatcttcacagctcattgatgcagaaaacgatcttgaagctgccgaactggaatatcagaatgctgttttcaaccagagaagagcgggaatagaactgatgaggtctacccaggagctggatatcactaaattttatttaattccttaaccatttaaatcatgcataaaaatatatctatactcttcgcggctctgattttgttggggagctgtgacaaaaaaaacgaaaagatcaaagaaccggaagggaaaaccaaaaaagaggtgatctcttttgcccctaaagtcaccggaaggattttaaaaatatatgtttccgaagggcagactgtgaagaaaggggataccctggcacagcttgatgtacctgaagtctctgcaaaaatagcgcaggcacaaggcgcagtaagtgctgctaccgcccaggagcaaatggctaaaaacggtgcaacagcagatcagctcaagcagcttcaggccaaatataaaggtttgaaagaacaatatgaatttgcccagaaatcatataaaagggcgaataatatgttccgtgacagcctgatgtctccgcaggctcatgacgaaatctacgcaaaattacagggagcaaaagctcagtatgatgctgtagtggcagagctggatgatgtaaaaaggggaacccgcgtcgaaaaagtggagatggcagcaggacaggcatcacaggctaaaggtgctttacaggaggccaatgtcgcctattcagagagatatatcattgcgaccaacgatatggaaattgagaccatcagcttaaacaccggtgagcttgcaacagcaggatttgcattatttaacggatatattccggaaagtacttatttcaggtttaccattccggaaagtgctatttcaaaatataaaaaagggcaggaggtgacgatgcaggtggtgtacaataaagaaaacctgacaggaactattgtgtatatcaaacagctgacaaagtatgcagatattactactgcgtatccggattatcagctgcaggacgcgatctacgaaatcaaagtaaaacctaaggatatgaataaggctaaaaatattctggtaaatgccaatgtaatccttaaataaatgatacagaacggatagagcttcagcgaaattccattacgtttttcaacctataaaaatatacagatgaaagaatttttccgtcttttaaaacgtgagttcaaactttttatcggcaattctaccttgagaacggtgttctttctggcaccggtattctatgcaaccttgctggggtttgtctacaaaagcggaaaagttgaaaatacacctgtattggttgtcgacagagataacacgcctttgtccaatcaattgacagaaatgctcgaagacaataaaagtattaaggttttcagatacctgcaggagcctttgagcatcaaagatgaggtgatcagacatgaagctgcagctgtagttattatcccttccaggtttgaaggagatatgctgcagaaaaagtatcctgaacttaatgtttatatcaataccgggaatgttttaacagccaattttgcttccaaagcccttcagctgaccatcggaacattctcggccggagcttccatcaaagcccttcaaaaggcgggaatgccagctgcaaaggctgctacccagtatgaaccttttaaagccaactacattacccttttcaatacaacggggaactatcttattttcatgtggccggcgatgcttgccgtagttttacagcaggtaattctgttggctatggctgtaagttttgctgctgaatttgaaagaggatctttcataaaagaatatcaaaaaatgaaaagatgggctttcccgaccatgctgattaaggtaatacctatctgggtgttctctgttcttattgtaggcatttattactttatgcatatgatcttcagagttccgatgccggaagggatattcaattttattcttctgacagcgttttttgtaggagccgtttcatttctgggagtctttgtaagtattctgatcccggatgcattgaaagcaacgcagatccttatggttatcgcttcaccggcgttcattatcagtggttttacctggcctctgaatgcgatgcctgcctttgttcagtttatcgcgaatattattccgctcactccctttctgcaggcctttaagattcttttgattcaaaaaggatcggtagaacttacctttccttacctgaagcatttaagtattcttttagtaatatatgctgtcataggctggattgctttaaagatcaaactttggtttatattcaaaaaagccgctccgcaagaaattgctgtggaaaataattctccggaggatagtgagtagtttctgatttctggttttggctgattggttactgttgcaggttgtattagtttattgttaagaatatttatattaaattattcaaaatcaaatcccgaaacccagcaatttattactttgtatcccggaactccagaattcgcaactcagaactcgtaaccaggaataaataacgcacaatatcctaacacgaatcccgaaaccacgcccaattttttcaaccgactacaaaatcaaacaaaaaaactgatatatttgtctgtagtaaaatagaaattatatggaaaatgtatttgatgcaaaagatgctcaaaactatatagatagaatcaacaggctggtggaagatacccatggtttatgggggaaaatgacggtggatcagatgctggcacactgctgtataacctacgaaatggtgtacgaaccggaaaaacacaaaaaacctggagctattgcaaaatttatattgaagacttttgtaaaacctaaagtggtaggagaaaaagcctatccgagagattcgcctacagcacctcagttcttgattaccaccaggaagaattttcatgaagaaaaaacaagactgataggttttattcagaagacacagcaattgggagcagatgcttttgacgggaaagagtctttctcttttgggaaattaaatgcacaggaatggaataatatgtttgcgaagcatctgaaccatcacctggcacaatttggagtataaacacaaccttacatgaaaaaacttttattactttttgttctggctgccaattttgtattgggccagatgccggatatttccaatacatggctgaataacagtaaaccttatataggaactatcggaaacaagggacaggaactgaaactaaagatcaatatctctgaacagaataaaaaaaatgatcaggaatatttcgtttcaggatactctcttgtagataccaattattcaaaattcgaaggtaaaattaccatttcaaaatataaagattccagaaaacagggaactgtatatggcgaatatgaactggcagaagagaataaaggaaaacattccggacttttcaaaggaaaattcacctataattttaaatggaacaagaaaacagagaaaattgaaggacagtacatcgagcttacaggagactggaaaagctatgacggaactcttgaattcaagactcatttgaaaaatcagtaacacctcatcattttataccggacctaaaatatctcagacctcgggtcttatctaaaactcattaatactatgaaactaggcgcattttcaatcagcttaagcgtaaaagatcttcagaaatccaaagatttttatgagaagctgggttttacaacaatggcaggaactgaagaacaaaattacctgatcatgaaaaacggatctacactgatcgggctttttcaggcaatgttcgacggaaatatgcttacttttaacccgggatgggatgaaaatgcacaaaatcttgagtcttttgatgatgtgcgtgaaattcagagaagattaaaagaaagcggagtggaaatcggaagggaagctgatgaaacaacttcaggacctgaacatatctacctgaaagatcctgacggtaatatgattcttatagatcagcacagatagatcaggatcattatataaagatgacttaaaacaaacttaacttataaaaaaacaatcatggcaacagtaaacgtttatttaacattcaacggtaattgcagagaagcatttgatttctacaaatcagtgttcggaggagaatatccttacattggaacttttggagaaatgcctccaatggaaggaaaagaaacccctgaagaagacaaaaacaagatcatgcacgttgcacttccgatctcaaaagaaactattttgatgggaagtgatacaggaggagagtggtcttccaactttaaggcaggaaataacttctctatttctgtgaatgctgaatctaaagaagaagcagataaattattcggtggtctttctgcaggagggcaggtgacaatgcctatggcagatacattctggggagcttatttcggaatgtttactgataaattcggaatcaactggatggtaaactatgatgatcctgcaaaaatgcagcagcatccgtaaattcatatttcatttcaaaataataaaaaaaaccgacagctatttgtcggtttttttatttactgtaagctatttgcaggaaatagtttttagttcttcttgatgattttatagcttgctgtttctgttttgatgagatagattccttcaggcagctcggtaatgtcaaacgtattttcatcatttgtcacttccgcagattttatgagctttccggactggtcatataaagagattgtatcattttttttcagatgatcaatatggaagatgccggtagttggattaggataaatattctctttttctttcatggtgctttctgaagttcccaaagttgaaatttttgtccatgtaaatgcatcaaggcacatatagacataggatccggtggattgcagctggatctcatcaattacagtattgctgttattctgattattcagagtggcaaggtcaatcagggtaaacccattgctggtacctgtcgttcctgtagttgcattaaatgttgtattaaagccggatgttttggtggtggtaaattttggaattcctcctaatttccctgtgataataagcgttcctgatgaggttgactggtttaaagccgtattgcttaaaaatacccaaaattttgagactgtaaatggagaactgctcttaagactgaatgaaggagaaatgatattcgttgttcctgtattgtcaatgtagacattatcattagctgttccgttccagccggtgtttggataattgccctgaattctgaaagttccggcctgtgaaacaatattaaaagtatatccattactgataaaactggtactgccgccagatgcattttcaaaagttacagttgttgtctgtgcattgatcaatgctatcgtgcttaagaaaacaaaaatggcaaaagagataatttttttcatgatacagatttttagtagttgaagaaagtgataccacaaagtaacaatgaaacctaaagccgttacagcgtattaaatgccggatttaaaaacacgtagaaatacgcaatgttgtttattgctatagttataattttgaaaaatgaatattatgttaatgaaaatgaatttatttcacagtatggttagttttttcataacttgtagtgtgcaattgcaggaactttattttaaacctattatataatttaaaacaagaacaactatggaattacctaagcatgcagtatcattggatgatgctaaaacatggatcagcaactggcagaatagaaatgatattgacgggatgtcaataagagcacatattattcctgtacaagatgtaaatgatattttcaacaaggataaaggctttgagcaatatcgcggatacaatgcgatcacagatcagggagagtttaaatttttaatggtaggagtggatgcttatgggaacgatattgtcaattatgaagacggattttatgtctatgatatgactacaccctgtccaagcgtatgttctgccgagaaatggtggaatctgtaacctgaaaaccggagatcttggatcattggattgaaatattgtcattaattggaaaaggcattctgctgattaatctggcagtatacggtataggcttttacggttccggaagagcctatacatttttcatcggttatctggcgtggatattaatttgtgaaatcgtattctatgtattgaattcccagaagattaataatctgtttttctcacattattatctgatcggtcagtttttgctgctgggattgttttttcatgagattttaacggagaagtatcagaaaaaaacagcacgtattcttttagttactatccctgtcattctcatcatacagtatatgatagatccggaaaaatattatgtttttaatctgtttgaaatttttgtcacgtcttattctattataatcctggcattatttcatttatataatatattggatactcagaagaaatacaattatataagtctgggacttttgctgtatctcataagcagtacagttatatttttgtccggaaatctgtatacggtaatgaacaggaagctgcataaagagatatgggtgttcaatgttgttatgtttattgtgtaccagatttttattctggctgaatatctttcttcccgtagaaaaaatgtataattactgttatgattttacaaaatgaatgaaaatacaattatttccactatcgtttatacctttctggcatttactttactggccgttacgctgatcatattttattatttttcaaacaagaaaataaccagaaatcttattcagaaaaaagaactggaactcaggtatgagaaagatcttacccatgctattatcagtgcacaggaaaaagaaagactgagaattgctcaggatctgcatgatgacatcagttcaaaactgagtgtggtttctttaaatatccatcttttggattttgataatctgcccagggaagattacaatgacctgaaaaataaaatcatacatctggtcaacaagactgccgaaagtgcaaggcagatttctcatgatctgctgcctcctattttagaaaaatttggactgcatgctgccatagatgcattgtgttcagaaattaacctgtccaaaaacctgcaggttacctactccagcagtttatactttgcaaaagcagaagatgaaaaaaatttacatatctttagaatacttcaggagcttatcaataattccatcaaacatggcgaaagtactcatattgatatagaatttctgggaaaaaacgggaaaaatacctgtatttataaagatgatggaaaaggatttaatcttgatgaaaatactttgaaaggaggactcggcttacgaaatatcagaagccgggttgaactgatcaatggaacactgaaaattgaaagtgaaaacaataaagggactactgtagaatttacattttaaatagttataagatggaaaagaataccattcgtgtaataactgtagacgatgaagcgctgtttcgccagggaatttcattgctgatacagagagagaatgatattgaactggtaagcgatttcagtaatggaaaagagctgcttgatgaactcatcaacttacaggaactgccggatattatcctgatggacctcaatatgccggaaattaacggagtagaagctaccaaacagatccatatcagatatcctcagatcaaaattattgcattgaccagctataatacaaaagcatttattgttaatatgatacagtcgggagcctgttcctttcttaaaaaaaactcaagccccactgagttgcttaccgcaatccgggaagtctatagtaaaggtttcttttataataatgaagtaatggaagcattacatcaaaatcttacagaacctaaaaagaagatctctagtatttttgatgccaatcatatttccaaaagagaaaaagaagtattggagttaatctgtaaacaatacaacacagcagaaattgcagacctgctttttataagttccagaaccgttgaaggacaccgcaacagccttttactgaaaactggggccaaaaatactgcaggattggtggtatatgccattgaaagtaaaattgcagatatgaactacttaaaagaccgtttcgaataagcattcatagaatcatttcgctaaaaaatcaacatcattttatatttttcgattcattcagttttatgtttttataatctggaaacatacattacaacagtccgaaaaatgcaaaaggatgaaatcccatattgagaacattctcatagtcagtctgatattctggcagaaattccatctgctttttatataaaatcaaatacaaaagaaagtccctttctgtcgtgctattaaatattgtttgttattattgatttaaaatattaattttgttaaaaacgatagataatagtaattgacaaatatgagaaaggtttttacgaagttggcattcacagtattaagtttggggtccatatgggtatgtgctcaaaagagtgatctgggagcatggtatatgtatttcggaaataataagatcagcaagaagctgaactggcataacgaaattcagtaccgtaatttcgatgctgttggagatctcgaacaattacttatccgtacaggaatcgggtatgatcttacagaaaataacaataatgttttattgggatatggtttcattctcagccagccctatgtaaacggcgagaaaaaggagaatattgaacacaggatttttcagcagtatattaccaagcaaaaattcgggcgtttcaatcttcagcaccgctaccgtttggaggaacgttttcttgaggatgatttcagaatgagattccgctatatgattggattgaatatcccgattactcaaaaggaaatgctgccaaaaacactatatgcatcgatatataacgagattttcctgcatttcaatagtcccgttttcgacagaaacagagtgtatggagcgttaggatatgtcatcaacaaaaatatgaggattgaagcagggtatatgaatcagattcaggagaacagaaaccggggacagattcagattggtttttataacaatattccgtttactaagaactaatgaagcaactgctgaatgccctgatgaaaaccattatctaaaataaaaattaaacacaaaaaataaacacttatgcattcaggaaaaagatttggagcccgggagttcattatctggaccagacggagtatttacgctctgattatattatctgcaatccctacagtcctgtactttctgggttggacgtttctctccgttccatggcagccgattgccattatgggaacagcggttgcctttatcgttggatttaaaaacaatgccagctacagcaggctctgggaagctagacaaatttacggagccattattaatgacagccgtagctttgggtatatcctgagagatgcgctgctttctaaagatccgggcaaggtcaaagaaatgtttcttcgtcattatgcatggcttactgcattgagatttcagcttcgtgaatccagagcatgggaaaatatgggtacagatcagtttgatgaatatgctaaaaagtatgatattccggaaagactctccaggctggatgaggaactgaaaaaatacctttctgagcccgaacttcagtatattttgagcaaaaaaaacagagcgactcaactgatggcaatgcaaagtagagctttgtcagaagcttatgaaaaaggggaaatcaatgattttcaatggactcagattaatcagcaactggtaaaattcaccgataatcagggaaaagctgaaagaattaagaactttccatatcccagaaatttctcttctataaccacttatctgttgcttttattcattgtttttgtgcctttcgggttactaaaggaattagataaactgggtgacggaactatggtagaaggatggacgttatggtttaatattccattctctttgctcgtgacatggtgttttcataccctggacagtgtgggagaagcttcagttaatccctttgaaggtagtcccaatgatgttccgataactcagatcagccgtaccatcgaaatcgatatgcgggatatgctggatgaatctgatcttccggcagccatcacaccaaagaataatattgtgctttaatttttttggtggtaaagaaaaagtctaaacttcggattaaattaaacctataaggtttgggtaataataaatattgataacccaaaataaaaaataacacttaaaaaaactaaattaaaatgattcacagctatgttataatatccattgcagtactgctgtctgtgatgatattggtaatgatcggccagaaattaaaagtcgcttatccgatttttcttgtcattgcaggattgctgataagctttgtgccgggaatgccacgtattgaaatagaacctgatcttgttttcctgatcttcctgccgcctattttgtttgaagccgcctggtttacctcatggcaggactttcataaatggagaaaacagatattttcgatggctttcggattggtatttttaacctcaatagtggtcgcttatctttcgtcttccatcattccggggcttaccgtagccatggggttcctgctgggaggagtgaattcaccgccggatgctgttgccgcaacttcggttcttaagcatatgaagattccaaagaaaatcaccaatattctggaaggagagagtcttatcaatgatgcatccagtttaattgtttttaaatttgctttggcagctgttatttccggacagtttatctggagagatgccgttcaggatttctttacgatggccatcgggggaattgcagtgggagtagcggtaggtttcctgtttggggcattactaaaagttatcccaaccaattccaatatagataccattatcacccttattgtaccttacattatgtatgtgggagcagagcatttccatttttcaggggtgctttctgtagttgcaggaggattactgatgtcttataactcgcactgttatttaagccatacctcaaggattcagtccggtaacgtatggagtgtattgatattcctgatgaatacaattatctttattttgattggccttgagcttcctattgtagtggaaggaatgaaagagtataccatttctgaaggtattttctatagtgtagtcattggaggcgcaattatcggaacaagaattctgtacagttatgcactgatgtactttccaagaatctgctccaaagaattaagattaaaagttcctaaaccggattggcgggaaccgttcattatcagttttgctgcaatgaggggagtggtttcactggcagcagctttgtcaattcctgcttttctgccaaatggagaggcattccctcacagaaatattattctatttgtaactttcgttattatattgattaccctggtaggacagggattattactaagtccgattttaaagctattgaatattcaggatgccggaagtgaattgccggaagaaaaacaggaagttattcttatgcgtaagctgaaggaaacagcattacacaaactggacaatgacttttctgaattaacggtaaccaacagcctggtacgtcaccagaagcataagctggaaaatgaaatgatgctgatggcagacaaagcccaatgtatggcttccacaggagattatgtatcggcaatcaatgaaaataaagatgtcttacggcagatcatccaggcacagagaaacgaactgcaccggatgaaaagagaaaagatatttgatgatcatgtgatgagaagtattgaaatgcagctggattttgatgaagccaagattaccggcttttcacatgggtaaaagataaaccacaaaagccaaaaagaatatagaatagaataagttcgaatggtggataggtcacaaaatgaaaatctctggattttcaagacataaggagacttttcaagagtaaaagcttacactttaaaacagctgaattatttaaaaacttttgtgacttttgtggttgaatattacaaaatgtgtacatttaaacatattaaatttataatatgagtacacccatcacagttcagtatacaataaatgctccggttgaaaaagtctggaaggcattaaccgataaaaatgaaatgaaatcctggtattttgatatccaggattttgttttggaagcaggtaggaaattcaacttctttgagcctggaggagccaataaatatcatcatcagggtgagattttagaggtgattcccaatcataaattaaagcattcctgggcttatcctgatttttcagagaagaaaacagtggtaacctgggagctgcagcctgatgatggccagactcttgtaaagctgactcatgaagatattgaaaactttaaagacttaggagaaggttttgcaagagaaaattttacagaaggctggaatacgattttgggacagggcttaaaagaatatttagaaaaataaaaaatggtcacattacacccttttacgatagaggatgctcctcttcttatttcaaagataaaagacgaaagaatgcttcttcagtttgccggacctgtttatcgttttcctcttacagcagaacagctggaaaaggatttgtctgatgaaaacagaactcttttcaaaattatagatcagagcggacaaataatcgggcatgcccagatatttttaaaagagaagacatttctgctgggaagaattctgatctgggatgagaacaacagaggaaaagggtatggcaaaaaagtaatgtatgaactattgagatatggcttcagccattttgatagagaaacagcagaacttaatgtctacgactggaataccggagctattgaatgttaccggaaagcaggctttacttttgatccggatgttaaaaatgaagcaaagattgatcatgaaacatggatttcactgaatatgaaaatccataaaaatacttttgaattacaggaatcatgacacagtttaccgcactaagacctgttttatggacagaaaatcttgacgaaaccataggattctatatgcgtgtcctcggatttacacttatggggagaaatgatgactggcaatgggcatctctccgtaaagatgaaatatacattatgctgtctcaacccaatcagcatgaagctgcttcttcaatcggtttttccggctcgttctatttcaatgtcaataatgtaaatgatctttgggaagagcttaaaacaaaaaccaaaatctgctatgagattgaaacgtttgaatggggaatgagggaatttgcgatctatgataacaacgggtatatattacaatttggtgaagcagcagataatattggcaatacggaataaaatttgctatttttggagaaatatttagaaattcaatgaaaaaaaatataatagcgggtttcgcagcgattttattattggcgtcttgtaataaggataaggagattcttaatacattaaacacttataatacttcaatggaagcgaagggataccatttcggagataaacttgagcttccgaaagaggtaacagaaaatgcagaaagcgtaaccatcagctttggagataaagaaacaacaaaccttactattgatcctaaatttttcacattaggtgataatgcagtaacgttcaatattaaaacaaaaggaggcgaagtcctgaatcaggatgccaccattaatgtatttgcaaaaaatcctgaaaaaaatattccttatcagattgtagcggaatatcctcacgatccaaagaactttgtacagggattccagattgaaggaaataccatctatgaaagtgacgggcagaacggatcttctcaaattttaaagtacacgttaggaacaacaactccgcttgcttccacaaaacaggctcaggaagatttttctgaaggaagtactattgtgggggataaagtatatcagctgacgtggcagagtaaaaaaggatatatctatgataaaagttctttaaagctgctttctgaatttgcttatccaaatgtgctgggcgaaggctgggggttgacatacgacgggaaaaaccttattgcttctgatgggagtaaacttttatatttccttgatgctaatgatccttctaaattaatcaagtatatcgctgtggccggaagctcgcaggcatatgatcagttgaacgaactggaatatcacaacggctttatctatgcgaatgtctggcagaagcccattattttgaaaatcaatccggcaaacggagaagtggtgggaacttttgatttcacagagattgcaaaacagaacaccaaaggaagtgatgatgtcctgaacggaatcgctttcaaaggagataatatgctggtgactggtaagaattggccaaagatttacgaagttcagatcaagtaatctgattctattgataaaaacaaaaatagcgttcccttgggaacgttattttcgttttagggattaaattttagtatttttggcaaatgattaaaaatttcatgaagcgaaatatcctgaccgggctggttgctgtattcttgttgatctcctgtaataataaccaaaaaatgcttgattctctggctgattataacaatgcaaaggaggcaaaagggtatcattttggagataaatttgatcttcccaaagaagtgacggaaaatgcagaaagcataaccatcagctttggagataaagaaacaacagatttgactattagtccgaagttttttacactgggagataatgatgtagtcttcaagattaaaacaaaaaatggagaagtactcaatcaggatgctaccattaatgtatttacaaaaacccctgaacagaatattccatataagatagttgcagattatcctcatgaccccaataatttcattgaaggttttctggttgaaggaaatacagtatatgaaagtgatggaatgaagaatgcttctcagcttataaaatatgctttaggagcatccactccgacaattgtaaaaaaacaacctgctgaaattttctctgaaggttgtaccatagttggaaataagatttatcagttgacatatcaaaataaaataggttttatttacgataaaaatacatttgaggaactttcaaaatttcccctgcctaatataattggagagggatggggattgacttatgacggaaaagatctgattgcaaccgatggctctaaaaacctttatttcttggatattaatgacccttcaaaagtagtgaaaactatggctgttggtggaaattctgaggtttacaatcagctcaatgagctggagtattacaatgattttatatatgccaacgtatggcataaacctgttatcctgaaaattaatcccaaaaacggagaggtagtcgggaaatttgatttcagccagctcactaaagaaaacgatcagggagacagtgaacatgttttaaatggaattgcatttaaaggcgataatatgctggtgacagggaaaaactgggcgaaaatttatgaagttagctttaaataaatacgatgaagattttattagatttagtcattctggatgaaattatttttcagtaaattaccacattaaaaaaacggagtgaagtttttaaacatattattttttttccttttctgtacggcttcggcgcagaatattcttcctttggatactttgaaattaaaggaagcaaaggatctgcttgccgatgactatggaaatctgtatatctataaaaacaaagatttcagttttaccaaatatgactctttaggaaagcagatcggaaaaatgatgcttaccgttccgtacaaagtgcagaccgtacaaaacccactgaatgtgcctttgttttctgaaaatgcccaggaaatgaaatttgtggaccagaatatgaatgagattcaacggttggattttaaacagaaattcgggttcatcagaatggcttatgccgaagatctgcagcagctgtggcttctggatgacagtacaaagcgtttgatacagtacaatttcaggaatgataccaccattaattcttatccttttgatatcagctttgaagatctgatggatatgctggtctatgaaaataaggtctatattttaacgagaaagcatatccggatttacagccttaagtttgaaaaacttttcgaagcccctttagaaaacggaaaacgctttcggagagagaatgatcttatcatggttgtcgccggtaatttcatctcacaatacgttcctgaaaaaggaatgacgactatcttcgaagacccggatgcacaaattgtggataaaaacatactctcttattttgcaatcaaagggaacaaactctatctttacagccttgaaaaagtaaagaaagccaaacagcaaaaacagctggaagctcagccggaatctctgcagcagcctacggaaaaacctgtagaaaagacagatggaaatacggcagagaagccttcggacaataccttacagaaattgattgaagaaacttccgaagttcagactgaggctatcgaaaaacttatcaattaatcagtaaatacaaggaaaaagaatattatgcatattgcagttacaggaaacatcggagcaggaaaaacaactttgacaacgatgctttccaagcattacggatgggatgcacaatttgaagatgtagatcataatccttatctggaagatttttattcagatatgagcaagtggagttttgcattgcaggtgtatttcctgggaagcagattccgtcaggtgaaagagatcagagaaagtggtaaaaacattattcaggaccgtacgatctatgaagatgcccatatttttgctgaaaacctgaatgatatgaatcttctttcagacagggacttcaacaactattcatcggtttttgatctcatgaagtcttttgtatcagctccggatcttttgatctatttaaagtcagatgttcccaacctggttaaaaaaatctacaaaagaggccgtgaatatgaagcgtctatcagtattgaatacctttcaaagctgaatcagaaatatgaaaaatggatttccaattacacagaaggaaaactccttatcgttgaggtggatgatcttgatttcgttgaaaaaccggaagatttcggattcattctggagaaaattgaggcagaattacacgggttgttttaacatatttttatcagtacattaagagagagtcagtgtaattctttttaaatttgtttggatcaagtcaacttttttgaataattatatcatggtagttaaggttttacataacggaaactgttcaaagtcaaatgctgtattagagtatcttgatgaaaacggagtacctttcgagatcatcaatattattgaagatcctttaagtgtgcttgaaattaaaacagtactgaaaaagcttaatcaaagtgtttttcatatcatccgtaaaacagataagctgtatattgaaaactatgctgataaaaattattcggaagaagaatggataaagattctttctgaaaatccatctctcatacagaggcccattctggtaaaaggttcagtagcaatgctgggaaggcctattgaaaatgtaaagttctttatagaaaaataagtcaatttaataaataaaaaatccgttcttttaaagagcggattttttatttattggcgtctcttctcaggcccgtttatcacattatataaagcttctaactcttttggagggtgcccggaatcaaagtctgaggaagtatattcttttccatcagaagtaatgataatagatgctatcattgcctgatcagaatgtctgcctgtagtaggagatttcagttctgctatcttaggtaagtcaatagttctagccagttgggaaatagttttccattccgcaggagctatcttggtattagtaatctcttcgttgatattggattcttttgaagaaggagtaacgataatgcttttgctgaaccctcttgttctttctactaattgaatcttttcaatcttttcaatcttttgctgttgcacggtagtggtaatattttttgtattgttttcgctgttgtttctgtgaatgcagcttgttgcggatgttcctaaaataacagtaaacaggatcagttggatattcatcatatattgttttttgctttaagtaataaaaaaaccgcttcattactataatgaaacggtcttgtttttttacaatagaataacgccttctatttttgctacttctttataaatattcacaacctgattggcatccaaaacaaatgcattaatgttgcaggctgtgtattttccatttttgctttcgcggtttcccagtgtaaatttaatgccatcaaaaactctgtaaatttcagtaagttttgcctggtcagtaggaatgataaatttaaataaataatcctccggaaaatcatgatgatcctccagcttctccctcaaagacttataaaaatcctcagggcttgcgtgttgatttccttgtaatatatccatctgcaattgttaatataatataaatataacgaaaatttccctattttccaaatggcccaagcagcgatttggagttttggtgctcataatcttcgatgatattgaatagtccgtttaccagttgttcagaagcgagcttactcaatcctcctgaattcaccgtgttattatttccgcctaaaagactgcccagaaaattacttcctgataatgctgtattgatggtttttacaactccgtattcattcagtttttcatctactttaggggcaatggctgcaataagctgctgggatgttttttctttcagaatctgagtagcggtagtaccctgcataattctcgttacatcctgagcgtttagactgtttacagcatcctgcaaaataggttttgaagttgtaacagtatatgctgctgcctgagcaatataatctctttctttggctaccagggaaggggcaatcttctccagtgtagcattaatgtctctcaattctttaggaagagctttatctaccatattgttctgcagaaatgcttctttattactgtagattcccattcctttatcaataccattgagcagaattcttttaataatggaaagacccatatcggatgtagccagtgttgtgcatgattgaacactggtggtaataacagcaccggtcccgataataagagccgctgcaatgatatattttttcattctctttttattatctatttctaaatgcttttgtcaaaaagcgcaccaaaggtaattactattctctatttaacaaaatattaaattgagtgcatattttggtgaatattgtgtcaaaaatgttaaattgtcctttagagatatgttgaataaaggatagtaattttaaatataaaattataaaatttaagtatttgtctgtttttgtttaataaaacaggtcaatttttaaatgtttaagataatttaacagagttcgatattttttatatttttggctaatgtctttttttgagattttaaataactccacttagacaggtacgaaattgaatttatttgaataaaattgaaactatatgaaacaaagtaatttaaagtattcatgtctcattgctgctttatacttcggtatgaacgtcaatgctcagactactccaaaagacactgcagccaaagagcagaagattgaggaagtagttttgatcggatatggatctcagaaaaaagaaaacgttaccggaagcatcggaatggtttctgcaaaagatcttgctgataagccgaatgctaaccctataagctcaattcaaggaagacttgcgggagtaaatattacaaacacaggtactccgggaggttctccaagagtagacatcagaggagttggctcattaacagggaataccgtttttattgtagacggtatgattacaactgatatttcttatcttaattctcaggatattgaatccatgagtgttttgaaagacccttcgagtttggcaatttttggagctcaggcagcaaatggtgcaattattataaaaaccaaaaccggaaaaggaaaacctgtttttaatctaaattcatatttaggattcaaaacagtaactaatattcctaaaatggttaattctgatcagtatattgagttatacaacgaaaagttactgaatgataataatggaaaccctgcaggatcaatctccagagctgactttcccgcagatactgactggtttaaagaaattttccgtacaagtatcattaatgctaatgatttttctgcaacgggaagtataggaaaactgaattactatggaagcataggatatcttcaggatgaaggtaatcttgcagcaggccacggaattaactcaggaagtgggtttaacagatttaatacaaaactaaatcttagctacaaaattacggataatattaccatcggagataacttcagtttttcaaaaatgcgtactgatgtggcccaaaaccctcttttagatgcgtataatgcacctccgatattttcagtaatgaaccctgctacaggcaattatcagttttttaatggctattccataccaaatcccagagctaaactggatttgtatcgttctcaggtaagacaagagaggttgcttaataatatatggggagaattgaaatttttaaaggatttcacattcagaatcagctattctacggataattataatcctagccaatatgaatatacaccaacgcttacctatgttcctgtttctagtcaggtgaaatctacattgattacaaggaattttagaaatagtaattatgtctgggataatacaatcaattggaaaaagaaattaggtgatcataattttgatgtgcttgcaggtttttcaagaacaagaactaccttatcacaagattattggtctgcaagaagcgttaattatgatggaaccaatggctctttgaatattgccaatggaacagacattgttcatgtggagggtgtagatagggatgatgccgttgttactggtgttttccaggatcagcaaagaattgaatcattttttggaagattgaattatgattataaaggaaaatacttattaaatgcatctatacgtagagatgccagttcacagattagcgtagatagatcaagaacttttcctgcaattagtgtgggttgggtaatatctaaggaagactttatgagtggacagaatgtctttaatttattaaaactaagagcaagttatggtgaattaggaaatccgaatgttcagagaaagtttaatgcaaatacaactattattggtggaggtgcatattttggcaacacgggttatcctgctcagacaattgataagtttgttgatccaaatattggttgggaaactacaactggaaaggatataggattggagatggccttgtttaataataagctgaaaatagatgctgcctattatgataaagattccaaagatgtggtttatgctataactcagggaactgtatccggtgccagcaactggaaagacttttataccaatgcttattctttcaataataaaggttttgaattatctgtaaattataatactaaaatcaatgataacatcaattttggtatttatgggaacttcacctcacttaaaaatgaaattacatcagtttacggaggttcatacctggaaacgggagccagcttatttggaaactctattgtaaggctacaggctggacaggctgttggtgcttattatgggtatcaggtagcgggtgttttccagactgatgcggaagcagctgcatccgggcaaagtggtgcaaaagccggatggtttaaatttgtagaccaggatggaaacggtgttattgattcaagagataaaacgtatttaggaaacccgattccaaaaggaacctatggatttggagttaatctaaatgtttattcatttgatttcgctattgatttccagggagtatttggtaacaaaatatataattataacagagaacagcgttacggaaacgagacctgggatctagatatgtataataacagatggcatggagcaggtacatctaataccaattcaatgattacctctaaccaatctattattttaccaaatagtttttatgtagaggatggaagctatatcaggattagaaatattcaggttggatataacttaccaagagaatttgcaaaggctctttccattacaaaacttagattgtatgtaagtgcacagaatccttggactagtttcaaatatcatggtttttcaccggagataacgaatacggatagagtacaaatgggtatagataataatatttatccaatttctgcaatttatacggtaggaatgaatttaacattttaattaaaaagatcatgaaaaaaatatttttaacactttctatactttccttaattgtaagttgtaataatgactttgtagatatcaaggatgaaggacaaacagatgtaagcaacttcttcacaacgcaggaggatgctatgcaggcaacaagtgctatttatagctttttaagaagctgggaaaattctggttttcctgcacaatatgtatttggagtaactggagatgatgtagaaaagggatcaaatccgggagatgcatcattcattaatgcatatgataacttcacatttacagtaagtgatgaaggagtaagaggttattggattgggcaatggcaagctgttaacagagcaaaccaggttattacaaatgttccgaaaatagatatggatgccactcttaaaaatagactgatagctgaagccagaatgttaagagcctatttttattttaacttagtaagaatttatggaggcgttcctatatttgatggattaccagctgatggaaattatataaaaccgagaaattctgcagcagaggtttataactttattgtttctgatcttactgccgccgctgctgtcttacctcaaagttatcctgctgcagatctggggagagttacaaaaggcggagccttaggattactttcaaaagtatatttatatatgaaagattatcaaaaggcctatgagacttctaatcaggtcatttcgatgggatattcattagaccctgattttaaccatttattcagacctgcaggtgagtttggtccagagtctgtttttgaggttaactgtgattgttctgcagcatatggaggaagtcaatatgcggaggtccaaggtgtgaggaatcaattcggatggggttttttcaccccaacccaggaattggaaaatgcatttgagccaggagatatcagaaaagaactaactatcctaagagagggtgaaacaactcttgaaggagatttgattcacaaaggagatcctcaggcaggtaatatgtggaaccagaaagtttatgtaccatcatctttgaacaataaagcatgtggatacggttctattcagaatataagaattttaagatttgctgatatccttttaatcaatgcagaagctgccaatgaattagggaatacttctgcagcaataactaatcttaataaagtaagaacaagagcccatcttgccaatactacagcatctactcaaactgctcttagaatggctatttggcaggaaagaagagtcgagttggctatggaaaatgatagattcccagatttagtaagaacaggacaggcagctacttatttaggacctaaaggattcaagactggtaaaaatgagcttttcccgattcctttggacgcaatgaatcaaagtaatggagtctttgttcaaaaccccggctattaaatttaatcaataaactttagaggagaatgaaagttctcctcttcttttagttagaaaccctataaaaagagatctcatgaaaaggaacgtattatcaatggctattacctctttattttttgtgtattcctgtaagaacactcctgtcgctaagcaggaagctggaaaacctgaggtcgtaaaaagcaatatcacggatgaacaactgatggatagagtacagaaagatgctttaaagtatttctgggactacgcagaacctaactcgatgctgggaagagagcgttaccatgaagacaatatttatccggataacgataagcatgtaatcactacaggaggctcaggatttgggttggcaactattctggtaggagtggaaagaggatttgttccaagaaaggaagcagtgaaaaggcttactcacatcatggatttcctggctaaagcagaccgtcataaaggagcatggtctcattggatcaatggggaaaccggaaaaacagttcctttcgggaaaaaagataatggtggtgatcttgtggaaacagctttccttacttcaggaatactgatggtccgtgaatattttaaaaacggaaacgcagaagaaaaagcccttgcagcaaaatgtgacgaactgtggaaaggaatccaatggaactggtataccaaaggagggcagaaagttctttactggcactggtcaccggattaccaatgggaaatgaactttcctcttgaaggatataatgaatgtctgatcacgtatatcttagcagcatcttcacctacctattccattgatgccgaaacctattataaaggatggaccagaaacggaacttaccttacagataaaacaaaatacgggttacccctgtatgtaaaacataattatgccgaagaatatggcggcccgcttttctgggcacaatattcatatatcgggcttgatccgacaggattatctgataagctcgtgaaaaattactttgaagtcaataaaaatcaaacccttatcgactataaatactgtgttgaaaatccgaaacagtggaaaggctacgggcccaactattggggacttacagccggttacacaagaaatgaggatggaagtactggatacaccgctcatatgccaggtaatgataacggagtgataacgcctacagccgcattgagcagctttccgtacacccccaaagaatcaatggctttcctgagattcatttatactcaaaaatctgaattcattggatctgcaggaccttatgacgccacttctatccattacaacaattggtttaccccaagatatctggctattgatcagggaaccatagccccaatgatcgaaaattacagatcaggttttctttggaagctgtttatgaatgctcctgaaattcagcagggattgaaaaaattaagcttccagtcagccaaatatgggataaagtaaactcaatagaaacgggctttagcccgtttaaaaataaagattcaaatccatggttttagccaaaatctgataatatgaaattaaaactgaaacatctcccgcttttactgctgccgctttcattacagttgaatgcgcaggaaataaaaacggaattcaataaagaaattaaaagacaggaaaaaatgtcctacattctggattacccgcagaatgtaaaaggaaatgtaccgttaatagtcttcctacacggttcaggagagcgcggaactaatcttgatctggtaaaagcacacagcccgtttacctacaaaaatctgatcaaagaaccggtcgctattcttgctccccaatgtccggaaggaatgtggtgggataccgttacggtttataacctgatcaaagaaattcagaaaaaatataaaatagatgcttcccgtatctaccttaccgggctttcaatgggaggatggggaaccttgaagctggccatggagcatcctgaaatgtttgcagcagtagcttctgtctgtgctcctacagatcaggtgatgaccgccaatattcataggtttaaagatttgaatctgaaaatatttcatggaggtatggatgatattgtacttcctgccaatgcttttaatttttatcagaagctgcaccctgtaaatccaacggcagaattggttatcttcccgaatgataaccataattcatgggattcggcttactcaaatcctgctttgtatgaatggatgctgtccaaaaagaaagaaaagtaatccaagacaccaatgattgaaaaataaacccatcaaattaaagcaaaaaatataaaacaataatttaagaagatagatttatgaaaaagttaattgtaatcgccactttagcattggctcctgtaatttctgcgcaggaaatggtaacaaagcctgttcagtcttatcagacggctcagtatcaggccaaaaagaaagcttttgtagacaatcttttatctaaaatgacattggatgaaaagatcggtcagatgaatctgccgacttccggagatttcactacaggccaggcgcaaagctctgatatcgggaagaaagtagagcagggattagtaggaggattattcaatataaaaggagcggataagatcaaagctgttcagaaagtagctgtcgaaaaaagccgtcttaagatccctatgatctttggaatggatgttattcacggttatgaaaccacttttcccattcctttaggtttggcggcttcatgggatatgaatcttatccagcagtctgcaagagtagctgcgagagaagctgcttctgacggaatcaactggacattctctccaatggtagatatctccagagaaccaagatggggaagagtatcggaaggttccggtgaagacccttacctaggaagtgaaatttccaaaaatatggtatatggatatcaggggaaagatctggcaaatgggagtaatatcttagcttgtgtaaagcactttgcgttatacggtgccggagaagcgggaagagattacaatactgttgatatgagccatgtgagaatgttcaacgaatatttccctccttataaagctgctgtagatgcaggggttgcttcggtaatggcttctttcaatgaagtggatggagtaccggcgacaggaaacagatggcttcagacagaagtattgagaaatcaatggaaattcaaaggattcgtagtaacagattacactggtatcaatgaaatggtagaccatggtatgggcgatcttcagcaggtttctgctttagctttaaaggcaggagttgatatggatatggtgggagaaggttttttaacaacattaaaaaagtccctggcagaaggaaaagttacacaagctgaaattgatatggcggcaagaagaattcttgaagcaaaatatgaccttggcttatttgataacccatataaacatggtgatgcaaaactggcggcaaaggaagtctataatatggaaaatcgtaatatagcgagaagcaccgctactcaatccatggttttgctgaaaaacgataatcaggtattgcctttgaaaaaatcaggaacagttgcggttatcggaccattggtgaataactcaatgaatatggccggaacatggagtgttgctacaaaacatgcttcttcagtttctttaatgcagggattacaatcaaactacggaaaagaagttaagtttttatctgcaaaaggagccaatatagattatgatgctaaattagaagaaatctatgctgcgcacggtaaaaaaacagacagagacaaccgttccaaagaagagttattaaaagaagctgtggaggtggcaaacaaagctgacgttattgttctggcaatcggagaatctgctgaaatgagcggagaatcttcttcacgaactgaaatcaccattcctcagtctcaggttgacttactgaacgaattaaagaagactggaaaaccaatcgcaatggttcttttcacaggtcgtcctttagctttaaccaatgtaaaagacacaccggatgctattctgaacgcttggtttgcaggttctgaagcaggaaatgcaattgcagatgttctgttcggaaaagtaaatccttccggaaaacttccgatgactttcccaagaagccttggacaggttcctatctactataacgctaagaatacaggccgtccgctaagtcaggataaagtggacaaatgtacgtatgaaagattccgttcaaactatatggatgaatgtaatacaccattatatgcctttggatacggtttgagctatacgaaattcaactattccgatatgacagtttccaataccagcccgaaaggaaatcagactgtacaggcatctgttacagtaaccaatgcaggaaactatgatggagctgaagtcgttcagctgtacatcagagatatggtgggaagcattaccagaccggtaaaagaattaaaaggcttccagaaagtatttcttaaaaaaggagaatctaaaaaaataactttcgatattactcctgaaaatctcaagttctataacggagaattgaaatatgactgggaaccaggcgaattcgacatcatgatcggaacaagttctgatcatgttcagcactcaaaaattaactgggacaaataatataaaaaagttactcacagaattgtgtattatgtcttttttggcatgatttttaataatacctcggtaattactattatatgcaaattgacatgaaaaaaacaattttattgagcacaatgttccttggttctttggtattcgcacaacaaactcaaataaaagggggcgacagagatgcgcacggctgtattggctctgcagggtatacttactctcagattaaaaaagactgtataagaacttttgaacagaaaatcaagttaacagaagtagctccaaaagatagctatacttctatagctgcagttattttcagcaaggacatgaaaaaagctgaagtttttgttaaagatgccgagactggaagtattatccttaccaaagcgggtaaagccaaagcatggaaaaaggatggctatacattggttccttacaagaagaacggttaccagcttaaaaaagataatatcgtgatctatcagtaagatcagatttaaagatgaaaaccactcgcaggagtggtttttttcgtaccttagatagaaattaattaatatcacatttttgggatattttaaaccaatcagaaaacaaaaatttaacctatgaaaaaaataattttattcagtgccttgtcccttggttccttagtttttgcacagaaaagtactcctgttttaggaggtgacagagatgttcatggctgtatcggttctgcaggatatacctactcacaactcagaaataattgtataagaacttttgatcagaaaataaagttaaaagaattaaataccgataaaagttatacttcaatgactgcgattatttttaataaaagtatgactaaagctgaagtgtttattccggatggagctgcaaaaagcattattttggataaacagggaaaagaaaagatctggaaaagcggttctcacattaaagacagctatgttctgacaccttacaaaaaaagttaccagatcaaaaaaaatgatgttgtcatctatcagtagatcagattaaaatagaaagccactcggaagagtggttttttattatattagaagtttcaaatagacctaataatattgattggatatgccaaaattaataatcgttcctaaaaataaggaagctgaaatagctttatattatgataaagtagagtcagaacacattatagaatggaatgtgtccaatgaagaattcaaaagattatggattgaaggtgttttttctttgatcaataaagtattcagggactaatatagatgaccatgaagatgagcatctcactgatctaaatataatatcttattcaatgtctgagttgaagaagaaacagtatagtttcagaaagataattgaaatgtttgagctgacaatttattataaaaccagtattcatttttatttttaaagtttaatacattataagttctaagtttaaggatttttatatttttgacttcaattttgaactgatcagataaactatgttatcactcgattttcatcttcttccaaaacatatgggtagatttttgtttcatacattaatcattttctgtataaattttttatattttttactagtatattataatgtttttaaactggacagatttattaacgtatctaaagttaaaaatagtgttactgtgatggagaacatgatgatcattgtatatcttattcctgtttcgctttcttatatgtactatgttatttttatttatcggagagaaaacttattttttaagcttagtttttttgtgttggcatttgcattatctcaacagccgtattcttactggataaaaattatattaggtaaataattaatcaatgaaaagaggattaaaaatattacagtttatttgtattattagtaccttatttttcggattatatttattaattgcacttagtagcagtcacaatatcccctttcagacttatttagggataggaatttcaatattgttgtccattgtattctatttcttgattgaatttattaaaagaagaaaaggattttaatcgcctcgcttctgcacaaagcctttcgtgtggcaagtaaatgaataaaaaccactgttattggagtggtttttatatgtataaactggttaataattataatgctccatccaatataattatctaaatttaccgggtaagattactcaaaactccaaagtaacggattatatttacagagcagatggagtgaaggtaagaaaggttttcggaacagaaacaaccgattatctggatggcttccagtatacagattctgtattaaaattcttcccaacagcagaaggatattttaatgttgagaccggaaagtatgtgtataattacactgaccatcttggaaatacaagattaagttatgctaagaatggagcaggaacagagatcattgaagaaagtaattattacccgtttggattgaagcatgaagggtataatgtgttgacaggaaatcctgcatataagtacaaataccaagggcaggaattgcaggaaagtggttggtatagttttaagtggagaaattatatgtctgatttaggacgatttttcaattttgatccgctttcagagaaatttcaatacaattctatttatgcgtttcaggaaaataaaatgggtttaggtaaagaattagaaggagctgagctattgcaggaaagaggtttaataacatcaataggtatgacagaatatgatgtatatacaaaagagcaattacaagattatatgtcttatttaaattataaaccttctactcctgatccagaattaatgacagctgaagagtatccaacaaattcggtggcaaaaggagcagagaattcatcttcatttaaaggagttataggtattctagaattatataacgttgtaaataaaggaatcgaaggagtgaaagggatggttgctaccgataaaaatgtaaaagcagttaattatatggataaattaacaggagagtttaaggatatgaaaaccgcattaagtgtggtcaataaagctgatttaaaactagataataaaactataacagaaattactaattatatatttgatggttctttaccaaaagatatcaataaaagaaataattccgtagttagtttacaatcaaaaactaatattgtcaatactgcaaacactattatgagaaaaaatggtattatagttcgcaatggtccggaagttaaaaaaaggactgagttaaatgaagctgcaagacaacaaaaagaaaaattaaaaaaggtgggacaatgagaatgtggttattaataatattgtttagtgttatatcaacatcttgcaataataatactttggctgaaaggaaaataaaaaaaacagtaatcacttttttagatgctgttgaaaaaaaggatggaaataaatataaatcattaatttatgaaagtgaggtttatcctggagttatatcaatggaaaagaaatttttctataaaaattacaaaaaaatcaattctgatgtaaatttaaaggaaaatataaaaataaaagatactattttcaatggagccaaaaggaaatatgttcaatatcgtattaagaacaataatgcagattattttcaaaaaccattaattattacttttatattttatgatcagataggatatgataagatttataaccatagtatttttgataatatgttggattgggagtaaaatcccccgctggcacgagcgtctcactcatgtccacaaataaaacaaagcctctgcaatagcggaggttttttatgttataaactgcttcagtcgattatactttcaaccaaaataattatctaaatttaccaggaaagattacccaaaattccaagataactgattacatttacagagcagacggagtgaaggtaagaaaggttttcggaacagaaacaaccgattatctggatggcttccaatatactaattcagtattgaagtttttcccaacagcagaaggatattttaatgttgaaaccggaaagtatgtgtataattatacggaccaccttggaaataccagattaagttatgctaaaagtggagcaggaacagagatcattgaagagagtaattattatccgttcggattgaaacatgagggatataatgtattaacaggaaatccagcatataagtacaagtacaatggcaaggagcttcaggagacgggaatgtatgattatggagcgaggatgtatatgccggatattgggagatggggtgttgtagatccgctagcggagaaacatcctgagttaaatcctatgatgtatgcagctaataaccctatgatgtttattgatccagatggtagggattggactattactgaaagttatgataaaaaaacaaatacaactcattatcaactatcttttactggagccgtgttaaatagttcttcaaataaaaagattgatatgaaaaaatttgcaaaggctattcaatcacaaacagaagagatattcaataaattggggacaaacccatatattacagtatcagctaatatagatataagagctattgatagcaaagatgatttaaaaaataatgatacattaattgaaatcaaagattctaccgctccagagttcgatgcttttaaaaatgggaaaaaagcaaatgcatatacattaaatggaaaagaaatatctgtaaatgctgattatgcttcagacgctattgacggaaaaaatattaaatttattccacatgaaattgggcactcagcaggtttgcatcatcctatagcagaagctaaagctagtaatggaggttttcttgatctaaattattattatcctgcatgggatgtacctaaaaataattttatgtttcaaggtaatatgaaagtatctggtcttacagttaatcaactgcgaagaatgaatagattatataaagcaggtaagctaaataaaaaaacaattaatccagcatatgaaaaatgagaatattaattttttatatttcactactactcatatttttttcttgtgaaaagaagaatgacattatatttgaggaaaaaacaattaaatcttcaactttggttttaccgaaagaacggatgtatgtagaattaattgattattatcccgcagtgagtaagaatcaatctaatttctatattgttaaaaatatacataataatgatacaattttcgttgtagatataaataatttaccagtttatgattttattaaaaattatgaaggggtaaataattctacaattactttggaaaaaggaaattatgttaataagaaaaaggaatatataatcagaattcctgtaaaatacaataaaataaatagtaagaaaacttatctcggtgaacttatcaatttagttgactaagtatgacaataccgctggcggaaatgtatagaagatattcccccccataaataaaacaaaacctctgtagaagcggaggttttttatcttccttgttttaagaaactatattgaataatgatgatcatcaaaagttaataaaaaaaatatcattgtaaattgtataaaatgaacaagttacgtttttatatttaaaaaatctgtatattgtattaccaaattaaagcgtaatccgaaaagcatacagagtaggaaaaaaatcaaaaaaatgttactatgaaaaacttaagaaaactttcaaaaagagaattaaaaactgttcagggaggtatcccgatgtgtcttgcaggatacttttggtgttcattggaaaaaaaatgtatccctgtcggagcaccttgcggacttattatcgattaactaattaaaaatagtaaaagcaagctgtctcagaaatgggatagcttttttatgtgctctccatcaatcgacttaggaatcagtagcgtcaagaaaatttgattgtaatccgttaaaaaatttccactgtctgagcatgggacttgttcagaaccgaagcagaaccgaatgatccatgcgagtttggaaattttaggagtacattccaatttttagcggatgattcccgtcttgaacttttgcatacttttgtttgactacgtcgaatcttcgatttcaagacaaaagtatagatgaaaatcttttatctgattcagaatatggttgaaaaatcataaaagcaggattttcaactctcactgaaaaaccgtatttttgtacatctaaaaagtaaaagaacgaatgaattcctacaaaaatccattggaagagcgctactccagtgaagaaatgttatttaacttctcacacaataacaaattccagaattggagaaagctttggatagctcttgctgaaatcgaaaaagaccttggacttgaaattacagacgagcagatcgctgagttaaaagctaatgctgaaaacatcgattatgtaaaagctgcagagtacgaaaaaaaattccgtcatgatgtaatggctcacgttcacgcttacggggatgtggcgccttcagcaaaaggaattatccaccttggagctacttcagcttttgtaggagacaatacagacttaattcagatccgtgacggacttttaatcttaaagaaaaagttgattaacgtcatgaagaacttagcagattttgctattcagtataaagaccttcccactttaggatttacacacttccagccggctcagttgacaacagttgggaaaagagctaccctttggttacagagtttggttcttgacattgaagaactggatttcttccttgaaaccttacgtttcagaggagtaaaaggaactacaggaacggctgcaagtttccttgaacttttcaacggagattattccaaagtaaaacacttagataaagaactttcaaaaagattcggtttcgataaagtgttcggagtttctggacagacttacgacagaaaaattgatgcgaaagtagttgctttattaggaaatattgcacaatctgcacacaaatttacaaacgatttacgtttacttcagaaccttaaggaaattgaagagccattcgagaaaaaccagatcggttcatcggcaatggcgtacaaacgtaacccaatgagaagcgaaagaatcggggcattggcaaaatacgtaatgtctctgacaacaagttctgccatggtagcttctacacaatggtttgaaagaacattggatgactctgccaacaagagattaaccattcctcaggcattcttagctgttgatgctattctgttaatctggaacaatatcctgaacggaatcgtagtatatccgaacagaatcaacaaacatattatggaagaacttcctttcatggcgacagaatacatcataatggaagaagtaaaagctggtggtgatcgtcaggaaatccacgaggtaatcagagttcattctatggaagcttccaaaaaagtgaaagaagaaggaaaagaaaacgaccttatagagagaatcttaaatgataactctttaaaactggacaaatcaaaactgaaagaagttttagatcctaaaaactttatcgggttcgcgccgattcagacggaggaattcatcaagaacgaggtacagccgattatagaccaaaacaaagacttaataggattggaagctgatcttaaagtataaaacaatatgcagtcttttcggctgcatattttatttccagcctcaactatgaaaaaactgtttttgaccattttattgatgccagtcatgtctttttctcaggaaaaagaggtgttaaaatattttatttccaaggacagtttggtgggggtgaaaaatcaaaaaggagagattattattccggcgcagtttattaatcttacaggaatgaaagacaacgaaattgttgagagtacaaataatactgttttttttgattcttctctggctaataaaagtaaaattgagaaaaattcctggggagttgtttttgacagaaaaggaaatctactttaccagccctattcttatgacaatggagcagattatttctctgaaggactgagaagattcgttaaaaacggaaaggtaggatttgtagacagaaatgcaaaaacagtgattgaagctgaacataatttcgttgctccgtttaattatggatacgcagcgttttgtgacggttgtgactgggagaaaaccggagatgagcatagagcaattgtaggtgggaaatggggagtgatgaatgtcaaagggcagactgttctgccactcgcaaaacctacggaaaatgatgttgaaataaacgggaaatattatcctaacccatttcaatataatgaaaaagagaaaaatatccttcagttttttaaaaagcagaagaaaaaactttcagatctttattatgtaaatttttatggcaaattatctgaaaaggaaaagaatctgttttttgaaatcgtagaaaggccaaaagaaaattttccgtattatcaggtgaatacttataatgacagaaagaaagatttggatatgctttaccacttcaagttcctggtttcagaagatggaaaaacattttatgccattgaggattttaatgaaaaaaaagttccttttgaacactggcttaaggaagaaataaaaaatgcagaagactttcagaaggagcatccggataaccccaataagtttatcaacaaataaaataaaattggaaattccagggttcaaagttgaagaaaatacgacttattcctttaaatttgtacggaataatggttggagggaaaatctctttcaaaaattttcaatataatgggtttaaagaaaaaactttaactcagaaaaagtaaaaagaaaaataaatctaatattaaaaatctgacatctaatgtctaataacaaaagaattttcgtagaaaaaagaggaattttcgatgttgaaagtccaaaaatttttgatgaagtaaaagcggtggttccggcagttcaaagtgtgaaagtatacaatgtatatgatattttcaatctgaatgacggagaatttgaaaaagtggtgaacaacactttcgtagaccctgttactgatattttacatacagaaaaccctgcaaagtctattcatttcggaatggaatttttaccgggacagtatgatcagagagcagactccgcgcagcagtgtatcgctttgcttacagaaaatgaaaaatcaaaagtaagaagtggaaaactgatcgaatttgaaggagtctctgaagcagatttggttaaaatcaaagaccttctgatcaacaaagtagaatctcaggaaaaagacttatccattctggatattcctgcagaagaaacgccgtcaaaagtaattattcacgaaaacttcattaatttcaatgatgcagaacttgaaagtttctacaataatcatggttttgcattaggattagatgacctgaaatttattcaggaatatttcaaaactgaagatagaaatcctacggaaacagaattaaaagtattagacacgtattggagcgaccactgtcgtcacactacttttgaaacacagttgtcagacattcagtttgaaggtcagttcaaacatacattggaaactattttcaatgattatatcgaaaaaagaaaattcttaggccgtgagctgaagccgatttccttaatggaccttgcgacagtatgcggtaaatatttccataaaacagggaatcttgaaaaccttgttatttctgatgagattaatgcatgtaccattcagatcgaagcagaatatgacggtaaaaaagaaccttggtatttattattcaaaaacgaaacgcataatcacccaacggaaattgagcctttcggaggtgcttctacttgtttaggaggtgcaatcagagatcctttatccggaagatccttcgttttccaggctatgagattaacgggagctgcagacgttttagaatctgttgacaaaacattaccgggcaaattaccccagaaaactattacgaagcaggctgccaacggctattcatcttacggtaaccagattggtcttgctactacgatggtttctgaaatttatgacgaaggatacaaagccaagagaatggaagttggtttcgttaccggagctgttcctgtagattgggtaagacgtgaaaaacctgccaatggtgattcaatcatcattttaggaggtgcaacaggccgtgatggtgtaggaggagcaagcggaagttcaaaagaacaggacgagacttctatccacacgatgagctcagaagttcagaaaggaaatgctgtagaagagcgtaaaatccagagattattcagaaatcctgaagtaacgaagctgatcaaaaaatcaaacgacttcggagcaggaggagtttctgtggcaattggtgaaattgcagactctttagaagtaaaccttgatgtattaccattaaaatatgaaggattaaacggaaccgagctggctatttccgaatctcaggaaagaatggcggttgtagtcgatcctcaggataaagaaaaattcattaaattctgtgaagctgaaaacattgttgcagtagaagtagcaaaagtgacagattccggaagaatgcagatgttctggaaaggagacaaaattgtagacctttcaagagcattccttgataccaacggatgttcaaaatctcaggaggtgaaaatcaaccaccttgaagaagtaaaaacagaaactaaggcatttaacgaagaaaacttcctgaataccttaaaagacaaaaacgtagcttcccagaaaggattgcttgaaatgtttgactcttcaatcggagctacaacagtagcaatgcctttaggaggaaaatatcagcagaccctgatggaaggaagtgtgcagacactaccaattttaggagcaaaagatattaaaaccgtttctttggcaagctggggattcgatgcggagatttcaaaacaaaactcactgttaggagcatcttatgccgtagtggagagcgttgcgaagattgtagcgatgggaggtgattataaaaacatcagactaagcttccaggaatacttcgagaaattagggcaaaatcctgaaaaatggggtaaacctttggcttcacttttaggagcttatgatgcccagatcaatttaggtcttgcagcaatcggaggtaaagactccatgagtggaacctaccaggatctgaatgttccgccaaccctgatttcttttgcatgtgctaacggagataaagaaaatatcatctctcctgaattgaaaaatgcaggaaacaaactatatttcttcaatcatatcgctcaggaaaacggacttccaaactataatgctttaaaagaagcttttgaattcattttcgaaaacattaaagcaggaaaaattgtttctgtaaaaacagtgaaagaaggaggtttggcagtagctttagcaaaaatgagcttcggtaacagattaggagctgaaatcaatgctgatgaagctgtgttattggcgaaaaatattggtagcctgatcattgaagctaaagaagaattaagctcagctgctcttcagttgatcggagaagtaaaagattcagggattttaaaaattaataatctcgaaacccgaatcacgaacctcgaagccgcatataccaatacattcgagaatctcttcccgacagtagaaaaagaaaagatcacggttgaaatcgatgaaaaatcaaactcaatccatccaagaaatatcatcatcaaaaaacacggaattgctcagccaaaagtatttgctccggtattccctggaacaaactgtgagtatgatacactgaatgcattccaaaaagaaggtgctgtagtaagcagtctgcctttgatcaatatcaatcaccagctattggatgaaagcattgatgcatgggtagaagagatcagaacttctcagattctggcattctcaggaggtttctctgctggagatgagccggatggttctgcaaaattcattgtcaacgttctgaaaaacgagaaaatgaaaaatgcagttcacgaattattagacagagatgggatgatcatcgggatctgtaacggattccaggcacttgtgaaatcaggattgttgccttacggaagaatcaaggatttggatgaaaactctccaacgttagctcacaatgcgatcagaagacatatttctcaaatggttactgtgaaagtagtgaatgacgaaagcccttggttaaaaggaatgaaaggtcaaactttcaccattccgatttcccacggagaaggacgtttcatggcttcagaagaagagattaagaaattgtatgaaaacgggcagattgccacccaatacatagatcttgacggaaacatcgcacacggaatgccgtttaacccgaataactcattattcggaatcgaaggaatcaccagtctatgtggaaaaatctacggaagaatgggacacccggaacgatttgctgaaggtctcatgaaaaatataccaaccgcgaattatcacaacatattcaaaaacggtgttgaatacttcaaataacaatacaagaaaaatgatcgtcatccatggcggtcatttttcgtctttagatggtttctacgaagaagcttcaagtgttctgatgaaagatgttgattggaaagttggaacactagatggttttgatgacattctctacggtggttttggagtattcgaaaataaagaagaaattgaaatcatctggaaagaatcgcagaagtcaaaagaagacttaggctttgctgctacccatgaattctatgaaaacaaaatcagacagggacaacctttcaacataaaattaattcagcagaaattaagtgaattagaggaaggaaaaggacagacactctttgatattctggtggaaattataggatcacatagcaatattacactgacattagaatgatgagtaatgagtaatgagtaatgagtaatgagtaatgagtggaaatttttaaatatttacattttccagctagcttcatcaaatcaacttgttgattctctctttgcttccttgaatcaagagaatagcgataatatctttgcgtcaaaaagcagaatacattttaaaccattaagaataataaagattgtaagaaaagttaagattcatcgcttatgaataaggcattcttcataatagctttagctgttgccttaataattcttcgtcccttcaaaaatcttaatggtgcaaataagtttattcaaccagggtacaaactggtctatagccaagtgaaacgcccttgcgatcgaaaacattgaattaatataaaaactttgcgtcttttgcgttaaaaaccatgaaagctaaaagatattaatagtttttcttcctatttttactgtaacaaaactggaaacaataaaagctgaatgaaaaagattacttacgggctgttcttcggtgacagcattacctatggagaatatgatggagtcttcggaggatgggtagatattctgaaaagatacgctttacagaaatttcatgaaggaaacggagatgaactgatccttttcaaccttggaataggtggagaaacaacagaaggcttactcaaaagaattcctcacgaactggaggccagaaattctgctgacgggaacattatttttttaagttatggtgccaacgaccttgctataaaagatggaaagcagtttgtagaacctgaaaaatttaaaaataatattacgacagctgtcaatcatgccagacagttttccaatgaaatttatcttgtgagtattctgcctttttccgaaagggtagacggagtagtggtaagttcagggaagttgagaaccaatgaagaagtgattgtctacaatcagattcttaaagatcttgctgcagagcattcgcttgggtatattgatttttattctgcttttctggaagataaggagattttattatctgcagacggagtacaccccaatgaaaaaggctatggaatgatggctgaagtagctataccaatcattgaaaaatatttataatgccttatttattctcttatggaaccttacaaaaagagcaggttcagatagaaacttttggaagactcttacaaggtgaaaaagacactttatcaggttacaaattagatatgcttgagatcacagatcccgaagtattaagaaaaagcgggcagaaataccatcccgtgctgcagttttcagggaatgttgacgatcagatagaaggtgtgctttttgaggtgaccgaagcggaaatccttcaggcagacgaatatgaagtagacgattataaaaggatcgaaactgtttttaaatccgggaaaaaaggatttatttacgttgggaaatagttcctcatctttaaaacatacccatactgtcattgcgagcaaagtgaaacaatctcaataacaattagaaatactaaatttaagtaatttttctttgataaatatcaacggttttttgtcattccgagcaaagcaaggaatctatactcacagattaatagtttatgaagttgagattccttgcggggtggacaaaggctatgggtagattgtttttatacaaaacttcccttttaaacacaaatattacgacaaatatcacaagtaatattcaataggagtgggctttagcccacttactttataaaacaaatccaccggcttcagccaaaacttaaaaataatatcccattcaatcaattttaaaaactactgacatacccttgtcaaaacctgttcctatctttgtcctacaacaaaatcaaaaaatgaataaagtaaaagtcgatccttttaatgtgatcggaatctcggtaagaacaaccaacgaaaatggacaggcaggaaaagatatccctttattatgggaaaaaatgatcagtgaagatgtcctccattcaattccgaacagagtagacaataccatctattctatttacacagattacgaaaaagaccataccagaccttatactacagttcttggatgtaaagtggaaaatcttgagaacatccctgaaggtatggctggctattcttttgatggtggagattatgtaaaatttactacaaaaggagatctttcaaaagacttagtgatcaatgagtggatgaaaatatggggaatggatctggacagactatttactgccgattttgaagtctatggagaaaaagcacaaaattcttcagacgcagaagtagatatcttcatcgctgtcaaataagtaaaaagcaaaaacttcttgccctcacaacctttgaactgaagacgtgaaattcccctccctcggagggtggcagaaattcaaagaatttttgacggggtggtttaaagcttcaagcttctttcttccagctcagctgaaaatatatttccaatacaccagaattccgacaattaccgctgcaatggctgtcagaactacagctccggcagcaatatccttgataaagcctattcttttatcaaaatcaggttggatgatatcacatatcttctcaacagcggtattaaagatttcagcactcaaaacagcaaaagagacgttgaaaaccaatgctgcatccgtattgttcagtctgaaatagaagataaagaaaaggttgatgaagaatataaaaagttcaacttggaaatttctctctgttttaatcatcatgaaaacacctctgaaagcattgagaaaacttttatggatgggaggtttttgcatgatcttcgaagttttttcacaaatataggttttgtatttgataaaaaaatgtatatccgcagaaatctaagtataatatcaaggctcaaaacaaattaaggatctttgttaaaaactcctccataatattcttttctttattgtatctatttattatatttgtagaaacttattttataaatctatgaaatttattatttcaagtggtgaactgcagaaggctttgcaaactgtaagtggcgtaatatcaagctctcaatcgagaccgattttagaaaactatctttttgaattagacggaaataatgttaccattacagcatctgacggcgagacaactcttgttacttccctggaagtaaagtctgatgacacaggtaaatttgctgttcctgctaaaatttttcaggattttatcaagacctatggtgaacagcctctgacatttgttgtaaaagacaatgccgaaggaaccggaagccagcttgagattttagatgaaaaagataatttcgcagtagcattagacaatgctgacgattatcctgaattaccggaattcgacgcttcacagagtgtaacgatgccggcaggagttctttctgaagctttgacaaacacactatttgctacaagtaacgattctcttcgtccggtaatgacaggagtactgttccagtttggagaaaatgaaaccaatttcgtttctacagactcccacagattggtggtatacaaaagagcagaccttatgaatgccgaaccgatggagtttatcatgcctaaaaagcctcttaacattttcaaaaatatcctggcaagttccaatgaagacgttaccatcgacttcaatgagaacatggctaagtttacttttggtaaacatatctggatctgtagactgatcgacggaaaatatccgaactatactgcggtaattccaaaggaaaatccaaacgtattgacaattaacagaaatcttttgttaggagcaatcaaaagggcgtctattatgtctaacaaatctaccaaccaggtaagattcaagctttcaggcaatattcttcaccttcatgcagaagatactgaatatgcaaacaaagcagacatgcagattccttgtgattacaacggagaagatatcaatatcggattcagttccaaattcttaactgaaatgctaaccatcttagggtctgacgatatcacgatgaaaatgtctcagccaaacagaccaggtatcattgaacctgttgacggtcttgaagaaaacgaaaacatattaatgttatcaatgccggtaatcggattgtaatagtaatataacaaataatagaaagccggaattttccggctttttttgtagcatgctctctcacctatagttataagtaaggggtaatgacctcggaagtaggagcgttaagaaaatttaaatgtaatccgttaaaaaatttccattgtctgagcatgaacgaaatttaaaaccaaagaagaatcgtagaacccatgcgagtttggaaattttaggaatacattcaaatttagtggattattccagtcttgaacttttgtatacttttgcttcaaggtaaagtataataaaaaaaaacagttaataaacatgaaaaaaataataactttaggattagtggcttgttcgctattgggctattctcagaaaaatgcaaaaatctattatgaacagaaaaatgatacgattgcatattatgctgataatacggaaatttatccgatttcaatcactttttctgaacagccgcaattagaaaatctgaaaagcccggaatcatttaaaatgatcagagtgcttccacctaaatcaatgaagaaaaggattgcttattttgttatcaatgataagaagaaaggttggaaagttaaaaaaatgccatactatacattggcgggtgatgcaacgataaaagaatttgatacttcttaccagtatgaccttccttttaaaaaggggaaatcttttaatgtgtatcagggatacaacggtgtattttctcatcagaatgaaaattctttagattttgtaatgcctgagggaacagaaatcactgcggcaagagaaggtaaagtgattgatgtaattcagaacaataatactggctgtcctacaataagttgtgctaacttagccaattatatttctattttacattcggatggtacaattgctcaatattttcacttaaaagaaagcggtgctaaagtaaaagtaggtgatgagattaaaaaaggtgagttaattggtttgagtggaaatacaggatggacaaatggacctcatttgcattttcagtgttttcttcctgacccttctaaacctaaacagaagaataccatcaaaacccttttcaaaaccggtaatggaactaaaagtgaatatttagtggagaaaaaaacatattcaaaagaatattaattattgctttgttgaatttttaagttggaaggaatccgctttaatccaaagaaggcaataagacaacctgatcagacattcttagcttaagtattgaaattaacgaaaatttattatcttaaaattgttcctaaatttctctatttctcaaaaaaacacgacatttgtagctcgaaaaattacacttgtgtaaggtgtggaatttcaagtaaaagtttcaaattgagaagatgaatccttatttcatctgaagaattaaataagtagatagattaacaaatgaaaatatcaaacaactggctgaaggactttgtaaaaacggaattaaaaactgaaagaatcggtgagttccttacagatataggtcttgaagttgaagggatagataaatttgaaagtgtaaaaggcagcctggaaggaattgttgtagggaaagtattaacctgcgaaaaacatcctaatgccgacaaactgaagaagacaacagtagatgtaggaaacggaaaagtgctgaacattgtttgcggagctcctaacgtagaagcagggcagactgttcctgtagcagttgtcggaactaaaatctatgacaaaacaggaaacttttttgaaatcaaagaagcaaaaatcagaggagaagtttctcagggtatgatctgtgctgaagatgaattaggtcttagcgatgatcacggaggaattatggtgctggacgaaacaaaatatgaagtaggaaaaaactttgcagattattttgagttgactaacgatgaggttttcgaaatcggattaacaccgaacagaacagacgccatgtctcattatggcgttgcaagagatctgcatgcttatctttctaccaaccaattgaaatctcaatttaataaagtcgcttccgaagctttgaatggtgagggaactcatgacttcaagctggaaattgaagatgcagaactgtgtccaagatatatcggagctgttattgaagatgtaaaagtagcagaatcaccatcatggttgaaagacaggctgaaagcgatcggattaagcccgatcaataatgttgtagatattacgaactatattcttcacgggtacggacagccgcttcacgcatttgatgcagataaaattgcagacaaaaaagtgaaagtaggcgttgtaaaaccgggaactaaatttactaccttagatggtgttgaaagaactttgaatggttctgaaatcatgatcaaagacggtaaagataacccaatgtgtatcgccggagtattcggtggtgaaaagtcaggagtatctgaaactacaaaaacaatattccttgaaagtgcttattttaacccgattgctgtaagaaaaggagctaaagcacacagcttgaatacagatgcttctttcagatttgaaagaggggtggacccgaatcttacaagaacagcaattactcatgcaatcaaaatgattcaggaaatagctgaagggaagttagtaggagagttactggaagaatatcctaaaaaaatagaagataactatgtgatcctgagattctctaaaattgagcagattttaggaacaaaaattcacagagaaaaagtaaaggaaatcttgaaagccttggaaattcaggttttaaatgaaatcccaaatggttttgaaatctctgttcctgcttacagagcagacgtaacaagagaaattgatgtgattgaagagatcttaagaatctacggatacaataaaattgatgctcctcaaaaaatttcatttacccctgttaagttaagtgcaaacgatcaggatgaactggaaaacagctgggcaagaactttacaaagccttggtttcaatgaagtgatgaataactcattaacttctgtaaaagatgaaactgatgccgtaaaactattgaatcctttaagcagtgatctggcattcatgagaaagtctttgctggaaggacttcttcagaatacagtatacaatatcaacagaaagaaccaggatatcaagttcttcgaattaggaaaaatttatcacaaaaaagataaatacgaagaaagaaaacagctggcattattggtttcaggaagagatgttgcagaaaactggcttcagcctaaatctgcagtaagtttctataaccttaaagcgtatgttaaagttttattggaaagacttgctgtaaattataaagaagtggcattaacggatgacagattctctgatgcactggtatatgaagcagatggtaaagcattggtacgaatcggaaaagtagcacctgctttattgaaagattttgatatcgatcaggattgtttctatgcagaaattgaactggaatatgctcaggaacttcgttctaaaaatgagctgagattcaaagacattccgaaattcaacaagatcagaagagacctggctttattgattgataaaacagttaactatcaggatttatatcagactgccaaaaagaataaatctccattcattaagagcattaacctgttcgatgtgtatgaagggaaaaatcttcctgaaggtaaaaagtcttacgccatgagcttcgagcttttaaacgaagagaaaacactggaagaaaaggaaattacagaagtaatggattccttaatcaaatctttccagaaagaattcaacgctgagttgagatcttaacatttgaaaatatatatttcgacatacattgaaacggactttttaaagttcgttttttgtttttaatcattttagaatatccggattaatatgttttggctgaagccattgaattcttggctttttaagtaaacgggctaaagcccgttcctattgaattgcatttgtgaatatttttcatggtcaatttctccgcatctttgtcattccgtagagtctcagtgctctttataaactaattgtagtagagactctttcggaatgacagagcactggagatttcatagtaaagcttttgaaatagccggaaattattcaaaataccaagtgttaaagaataataaaattcacggcagcccgtttaaataatataaattccgtaaatttgggttaattcaaaaagaaaaaaatgaaaaatctttttttaagtatatgtacagttgcagtactggcttcatgcggatcaatgacaagcccttctgcgtctaaagtaggaaaggctcagcctgctcttgccaacacaaaatggacattggcagaaacggtaaaaggtaaagttccgacattgaatattgaaggagagaaaatcacaggaaatgcaggttgcaacaactatttcggaactgccagcatagatccgtctacaggtagttttacagcagggcagatgggatctacaaaaatgatgtgcaataacatcggcgtagagcagaactttatggatatgatgggaaaagcaaacaaatatgtgatttccgggaacactttagaattgtataaagacaatcttttgctattgaaattcactaaatcagaataaaaaaacaaaaggaactcaattgagttccttttttatgtttagagtgttattaatcttcctcttcttcgtcgtacttagccaactcttcgtcgcaccatttgaacgctgcttctactactttagtcgcttcgtctgccatagtttcttcatcatcaccttcaagatcatctaaccactcaacttcttcttcctcaacgtttaagataaatcttggatattctgtgtgaactacgaatagatcctctggaaattccgaattatctgctaataaaaactttggtaatttcatttttttaatgttttaactttctcaaagataaataaaattattgacttaaaattacttcaaaaacatttttgaaactttttcagcttttttgctttcagaataatcgtagaaaccttcccctgattttacaccaagtttccctgccattaccatgtttaccaataatggattcggagcatacttaggatttttgaatccatcatacatgacgttaaggatagcaagacatacatcaagaccaataaaatctgcaagctgaagaggccccatcggatgagccattcccagtttcatcacagtgtcaatctcttctacaccagccactccgttataaagcgtttcgatagattcattgatcattggcattaaaattctgttagccacaaaaccagggtaatcatttacttctacaggaacttttcctaaagtcttactcatttcatagattgcatcaaaagtttctttagatgtagaatatcctttgatgatctctaccagtttcataattggaaccggattcataaagtgcataccgattaccttatcagctcttttggtagctgctgcaatttttgtgatagaaatagaagatgtattggtggcaagaatgcaattggcaggagccagttcatccatctgtccgaagatcttcagttttagatcctggttttccgtagcagcctctacaataagatcagcagctcccacagcgtcattcagtgctgtaaaggtagtgatgtttcctaacgtttcagctttttgctcttctgtaagatttccttttgcaatgattctgtcaagattcgtagtaatggtttttaaacctctgtccagagcttcctgagatacatctacaagatttactttaaaaccgctttgcgcgaaagtatgtgcaataccatttcccatggttcccgctccgataactacaatgtttttaatcatttttcctttattttttatagatagttaaattttttacgtttttaagatccgattgtgaaacaacagttgttgaatcaaagaaaacatttccgatgctttgacttttcttattgttgttctgattggaaacagcagccgttaatcctcttataagacggcttttttgattttttgtaagataatctgtaccaatatataatgtatattcaccctcttttcccataccttttcccatcaggatttccagacttctgatctgacttttatttttaaattcctttagaaaactgatgacaggtttatcagacggaggaccgcagcagacacttccatagctgatctctaggtaattctgattcttctgcgaataaaagaatgcaaatgtcaggagagcagttaatactaatatttttttcatgttaaaccgctttaaaaataagctttaaattttatttattaaaatattcccaaacctccttcgaaatatctgaaatcatcctgcagttcactgcatccgtttccattgaattactgacgaataaagctaatgcataatgtttcccgttgggtaaagtaacaattccgatttcattttctgcgcctgttaaaccagcattattcttcccggaagctcccgtttttcttgcgacaggtgtgtttttgggaagctgttccaccattttattcaatccggttgaagtagaaagcattactttcatcagatagtctgtggattttttggataataactttccgtcatacaactttttcaggacatcagcagcggattttgtagtactataattttcatactgaacattccagtcattgtgcatatcctcttcattgtatttgatctgaaaaccttttactcctctagaatccataaacttctgaacaacctgggtgccgcccaacagcttcagaagaatatcacagccattattatcacttttggcaactgtatattcaatcacttcgcttaacggaatttcaacatttcctgccggatatttatcacgaagcggcgaccatgtattttccagtaaattcgatgggtttagcataattttctgatccagagaaagtattccctgatctacagcattcaggactgctgctgcaatgtgaaatttaaacacactttgcatcgggagttttttatctccgtttttatcgtacttaaagccattttcaaacccaagaacagaaacaccaaccgtagcttttttgttcttaaggattgaattaattttttgctccaataaagaggtctgagccaatgaaaatgctgaaatcagaagaaaaagaagtgctgtttttttcataatacggaaattaaaaagctctcttctgaagatgagaagagagctgcaatttaagataattattactattttaattcaaaataattcagattggcaccatcactttcaaagaaaattctgattttgttttctcccttctgaagcggaacgttttttacagaaactattttccagttttcatttcctccgctggatggcagtgatacattagccaggacttttccggaagcggtctcaattcttatatgagaatcttttgctcccgaatatctgatatcaagtgtataatttttatctgcttttgactgaaccgtatactgtagccattctccggattccgttttccctacataatactgattcgtaatcttatcattacatttatagatgtccacaccatcatttctcaattgctgcccggaattccattctgatcttttggccggatcgcttacccaaagattaatgaaatccttatccagataagctgaacccattcttccaaggtcatattctgaagcaaatattcttcccggagcctgatgatctttaaatggctttgttgaagcatctgttgtctgtctgaacatggcatcaataacgtcttttttaacttccgtattgctcagcttgtaatgttcggcaatctgcatcaacgctttttgggcatattcttttgatggcttttcgccgccgtttttccagtaatccaataacttttcatattcaggggtaatttttacattcgcaattccggcaatattatcaatctttttcataggccagaatgcatatccgatattatgcttatccagaagctgtatcaattctgtaaaccagacattggaattctcaccggtctcacccagccagatcgggatattatgtttttccctgaggtccaacgcaaatttcaacgtctggtcatcattataattccagtatttatggaaactgaaagccatattgttgtcccaaagtgcaggaagtccgttataattgtttccccagccgttaccttcaatgaagatcatatgttttttatcaactgctctgattgcagcagtaatatctttctgcagcttccatagcggagcattggacatttcatcagttccattcggatttttgccggtgaaattaatattaggctcattgatcaggtcataccctccgatccatggatgattcttatatcgttctgccagttttttccataaagctattgtttttctttgattctcttcactttcccaaagtgaaggtttagacttatcattatccgaaatgttgacatcgtttccctgtccgccaggtgtggcatgaagatccaggatcaggtatattttattgtcggcacaccatttcagtaattcatctgtcattttaaaaccttcttccagccatgtatcttttccttttaccggctccttttcaatcggaagggtataaaggttgtaatgcatcggaagtcttatcgaattaaatccggattgggtcagaagatcaatatcctgtttggtaatgccgtttttcaggtaagctttgtaaaacgcattcatgccgtcttcaccgattaattctgcaattttttccttaatcttatactgcggaccggcaaaatcagcagttttcagcatataaccttcctgaagcatccagccgccaagaccaaggcctctcagttgaacattttcacctttatcattaacaattttttgtccggaagtcttcagtaattgtgatgtcccaaattgagacaataaaaatgcggataatagaatagctcttttcatagtggttttaatggtttaaaataatagggaagtattagaaatgatacggaatggtgatggaacgagatgaatctgtattcagctcatttattgtatcagatatccatatatgtaaaataaaatctttcaatattgtattgaattattctccaaatatattgtttttttattttgaaaaagattttttattggtaaatctgtaattattaatgaattgtttttcttttatatgagtttcttaaaaacaaattctgaattaatttaatatgcagcttcatcaaatcaattttaatggattcaatctttgtttacttaatataatccgtcgctgaaaatgaaactttgcgttttttcataataaaaaatgctatctaataatccattattctgattataagatagcatagtatatttaagaatcagtatgtttctaactgatcagtttcataatctccaaagctacttttaacgcttcagttccgtcctccagagaaacctcaacatttttatctcctgtgatagcatctgcaaaagagttcaattcatccaaaatcgcattattaggctgaatatttggatattcaaataagatctgattcttttctccttctgcattttcaataatcatatcaaatggagtaggattttcaggagcgtccttcattctgatcacttctgcctttttttcaaggaaatcaacagaaatatatgcgtctttctggaagaatctgctctttctcatcgccttcatagaaattctggaagttgtaagattagctacacatccgttttcaaactcaattcttgcattggcaatatccggagtcttgcttactacacaaacaccgcttgcatggatgtttttaaccttagatttagccatactcaacagaatatccagatcatggatcatcaggtccagtacaacagaaacatctgtaccgcgtggattgaattctgccagcctgtggatttcaatgaacatcggattactgatgtactccttagttgctataaaagcgggattatatctctcaacgtgtcctacctgtgcctttattcctttttcctggcataaacgtaaaatttcttctgcctgctcaagagtctgggttaccggtttttcaataaagaagtgaagacctttttcaatggcttttaatgcataatcataatgataaatcgtcggggtgacaatatccagcatatcaatctgctccagtaaatcatcaaaattttcaaaatatttatacccgaattcggcttctaatttctttccgttttcaacatctttatcatggaaccctacaaactcatatctatctgactgatttagaagttttaaatgtatttttcccaagtgtccggcacctaccaaacctgcttttaacatagctgtattaaatttttgtaaagatagtgaatgtacatttattaaaatacatgactttttacttggagatttttaagattaaacacctctgttcattaaagaaattgcagtaaattcaaagcttggaaaaataactatgaaaagaataatttcgattgtatttgcattcgaattacttactagcggatgtataggagatagtccatatgacccgcaggctaaatgtggaactcctgcaaatctgatatttgaaaaagtgaataaccagctttcctggaacatgatcagtcagggcgaaggatattatgaagtacagtatggagaacagggcttcactttaggaaagggaacaactgttgtcaccagtaagaattcctgcaatcttccgttgtataagaataataaatatgacctttatgtaagaaaaaactgcggagttgacaatggccggagcaactgggcaggacctgttaccgtattggcgactaatacaaccacctgtataaaaccagcgtatgcaacctattcaaaaacaacctcttctgttcattcttctgtttttgatgctacagtaacctgggaaaatgatggagtttctatatatgaaactgttttgacaaccagtcctgcaccaccggcaagcggagaacaggtgatttcaggtcaaaaagctgtttatatagggttaagtaaaacggtgaattataacttttttgtgagaaaaagatgtgcagataacaccttcagtgatttttacggaccttatccgataaaatggaattaaaagataaaagaaaagcagttaacagatgtttgctttgtttttgtggataattctttcaggcgatttctgaaatctaatttctaatttcttatttttgtcaaatgcaggattcgtttgtacataaaggaaaaagaaagattttagtagattaccttcgaaacagaattggaatttcagacgaaaatgtactttcggctatgagtgaagttccgagacacctttttatcgaaagtatttttgaagattttgcctatgaagacagggcatttcccattctggcacaccagaccatatcccatccttccacggtagcggagcagtctgagctgctgaaggtaaaacccggtgaaaaagtgttggagatcggtaccggatgtggttaccagaccgctgttttaatggcaatgaaggctcatgtttacacagtagaaagacagaaagatctttttgatttttctaaaaagaaactcagggagcttcatctgttcccaaaattccagagttttggagatggctttgccgggcttcccacctttgctccttttgacaagattatcgttacctgtggagcttctactttaccgacagaattattaaaacaactgaatgtcggaggaataatggtgattcctttaggtcccacagatgaacaggttttatacagatttaccaaggtaggtcctacagaatttgaaaaagaagaattcggggcgtataaatttgttcccatgcttggaagtaccaatcaataattgtatcacagatacggaattggcagacgaatgatctcaaataccagttccattgttaaaacaagataaaataagaacggactattgagtccgtttttttatgagtaaaattcaaaagttttaaaataaaattaaaatattttaactgatttcggaatgaaaattgaactcacctcaaaacccaatcactaaaatcttactattatggatacgaacagattcaaagcgtcacatgattttagtaatcttcagaaaaacctgcacaataacccgggatatagtgtagagagctattctcaacaggtaaaagattacatcagcgacatgaaaaagaggaatcaggaagctaccaagcagggatttatggcgcaggctcagaaatctgcaaaagaagtttgggctgagattcaggaaattgcttcggaagcctgggagaagaataaaaaccattcagatgaaaagaaataatttttaatattaaagttcagaaaccttactttttgcgagtgaggttttttcttgacaaccattaatccatcacaatgaaagtctttatcaataaaagaattcccgaagcaggaattaaaatgctggaagaagctggtcttgaaatagttttcccggaaaaagaaaatctgtcttatgaagaatggctgaattactgtaaaaataccgatactattttaagtattggcacagaatttaaatatgacaaaaatttctttgaagcctgcccggacgttaaagccattgctttatattctgtaggttttgaccatgtagatattaaagaagccacccttagaaatattccggtagggaataccccggatgtactgagccgggcgacttcggatgtcgctttcttactcatgcagtcggtagcaagaagagcaagctacaatttcgggaaagtaaaagagggaagctggggtgcatttgatcctttacatgctttggggcaggagctttatggaaaaacgctggggatttttgggctgggacgtatcggatatgaaatggcagaaaaatctaagaaagcctttggaatgaatatcatttatcacaacaggcatcataatgaagaagcagagcaggagctggatgccacgtacgtttcttttgaagacctgatcagaaactcagatgttttgagtgtgcatgccaactttactccggaacataaagaattattcaataagtccctgtttgagcagatgaagtcaaatgctattttcatcaataccgccagagggggctttcataatcaaaaggatttataccaggctttggttgatcagaaaatatggggcgctggtctggatgttaccaatcctgaacctatggctgcggatgatcccattctgcagctttcaagtgtttgtattcttccgcacatcggttcggctactgttgaggcccgaaacggaatggccagactggcagcaggaaatattattgctttttcagaaaacaaaaaaatgcccaattgtgccaaccctgaagtttattctagtcgtttatcctaacttggaattatttttgttctgattacagaaacctttaaatcgtaatattatggcaccagaaaacaatattaatgagcaaaacagaaagctggaacagatggattataaccccaacgaagatatattcaaaaaagaaaaacatattccgcttgacggagacggaaatcctgttttagatgaggattttgatgaagataaaattgataagggactggatattcccggtgcagaagaagatgatgagatggaagagataggggcggaagacgaagaaaataactattggagtctcagtgataatgaagatgaccatgaagaggaaaatgatgatgttctaacttaaatttttacgataaataaaccaaccttgctgaatttagtaaggttttttttatgttgaataacaaccaatatgggtaaggacaattcccctccttcggaggggtggattcaaaaattaaagaatttttgaagacggggtggttccataatgctgcacaataaagtcttccaattctttcattaccacgttcagattattctttacatcaaaatcacttattctgaaaaccaaaagccccaaagattcaagatattcctctcttatgccgtcataaacctgcttttcatcatgacttgatccatctatttctataattaatcccaatgtttttacataaaaatcaacaatataattacctattattctttgtcggtcaaaatcaatcttatgaaaattttttgcacggactttcttccagaatatcacttcacccaaaatccgggctttacgtttttcttttaataatgcttttaaatggggattgtagggaaggttttcaacaaaattcctgcggatcggaactccaatgataatggttatgatttctttcatgattgtgtttatttttaaccaccccgtcttccaaagttatcaactttggaatctacccctccaacggagggaaattgatgtgtatttattcaaatatagtatttaatatcaagtggtgaccggtttacaacttttataactttgcttaaaccttaaaccttaaaccttaaaccttaaaccttaaaccttaaaccttaaaccttaaaccttaaaccattcttcccttcaccccttgcctatatttcctaatttgaatatctttaaaacttcaaacattgtttaaaaacatagacctttaaatagtaatatgacatttcaagaacagatacagcaggggattcctgatcagctgccacaaccgaaaccatacgagaccaatatcaaccatgctccgaagcgtaaagaaattttaggggaagaagagaaaaaactggcattgaagaatgctttacgttatttcgatcctaaatttcatgcagaattaattcctgaatttaagcaggaactggaagattatggaagaatctatatgtaccgtttccgtccggattatgagatgaaggcaagaccgatcacagattatcccggaaaatctgagcaggcgaaagcaattatgctgatgattcagaataaccttgattatgctgtagcgcagcatcctcacgaattgattacctatggtggaaacggagccgtattttcaaactgggcgcagtatctgctgacaatgaaatatctgtctgaaatgagtgatgagcagacattggtaatgtattcaggccatccgatgggattgttcccttcccataaagatgcaccgagagtggtagttacaaacggaatgatgatcccgaactattcaaaaccggatgattgggagaaattcaatgcattaggcgttacccaatacggacaaatgacagctggaagttatatgtatattggcccgcagggaattgttcacgggacaacgattacggctttaaatgctttcagaaagatcaaaaaagaaccgaaaggaggacttttcgtaacttcaggattaggagggatgagtggagcccagccaaaagcaggtaatattgcaggctgtgtaacagtatgtgcagaagtgaatccgaaaattaccaaaatccgtcatgatcagaaatgggtgaatgagattcatgaagatcttgatgcattggtaaaaagagtaagagaggcacaggctaacaaagaaactgtttctctggcttaccttggaaatgtggttgatgtatgggagaaattcgatcaggaagatttgagaattgatatcggatcagatcagacttctcttcacaacccttgggcgggtggttactatcctgtaggacaaagttttgaagaatcaaacataatgatggctgaaaaccctgaattattcaaagaaaaagttcaggaaacgttgagaagacatgcagcagcgatcaataaacatacagcaaaaggaacttatttcttcgattatggaaatgcctttttactggaagcttccagagcaggagctgatgtaatggcagaaaacccaacattaggaagagagttcagatatccgagttatgttcaggatattatgggaccaatgtgttttgattacggtttcgggccgttccgttgggtatgtacaagcggaaatcctgaagacctgaaaaagactgatgacatagcgtgcgccgtattggaagaaatgattaagaactctcctgaagaaatccagcaacagatgaaagacaacatccagtggattaaaggagcacaggaaaataaactggtagtaggttcccaggcaagaattctttatgcagatgcagaaggaagaatgaagatagcagaagccttcaacaaagctattaaaaacggagagattggacctgtggtattaggtagagatcaccatgatgtgtcaggaacagattctccttacagagagacctccaatatctatgacggctcaaggtttactgcagatatggccattcataatgtgattggtgacagtttccgcggggctacctgggtttccattcataatggtggcggagtaggctggggagaagttattaacggtggtttcggaatgcttcttgacggaagtgacgatgccgacagaaggctgaaatctatgcttttctgggacgtaaacaacggaatctcaagaagaagctgggcaagaaacgagggtgctattttcgctatcaaaagagctatggaagcagaaccgaacctgaaagtaacccttccgaaccttgtagacgaaaacttactgtaatatataaattcaacattggcagtgatcaacaaaaaactgttttcacatctgaacgtagaggataatgatcctgtatgggaaaagtttgctgaggttgaattttcaaaaaaaacaatatttccggaccgcaaagcctatcttctggaagatgggcttgtccggaaatattacatcaacagcacatcggacattgataccgaaatctgtgcagaattttactttccgggagatatttttaccgttgaagaaaaagcctccgatgcggtttacgaatccatcagcagcggtctggcatgggaaattaccctggatgaagtgaaagatatgtttgctttaaatccgcactgccgttttgtacagaattattatctcagcaaaaaactgaatgcggccatgaaaagggaaatgcttctgctgaaaaatactccgcaggacctctatgaatatctactcaagaacaaaccgcattacattcagaatattcctttaaaatatctggcctcttacattggcattacgcctatctctttaagcagaatcagaaaaagaattatgtaagctggaagaggggagctggaagctggaagttactctcagtcttaagattttctgtaggtttaataattaaattgatctatcatttcaaataaaggagaggtatagttattctatcacctcaataacttccatcttccatcctccatcttccaacctcaaaataccctcatttattatcttttgtttattgtcttgccttccgtaagtttcttcctttgctgaaaaaaagaatatggaaatacaaaaattaaactgggcagggatcaaacttacttctcacaacaaaatgatcttaatagatgctgttgaagattactcttattataaacccgttttaggggatgcagtggagaatattatagcgttttcagatcatgtacaggcagattacattctgtttacacatatgcatctcgatcattttgataaaggagtgatccggaaatgtttaaagaaagacggaaagctcattgtatacaaagggcttgaaggtgtggtaagaaaaattttgaatgacgtggagatcatagttcttgatcttgatgaaaccttcacagaaaacaatatcactttcaaacctgtatttgcgatggatggcgtgggagagatacagtcttcatggatggtagatgatggagaaaccaagatctttcatggcggagataccatctggcacaaccagttctggaagctcggaaaagaaaatcccaatatagattacgctttcttgcccgtaaatggtgtggtggtcaattttgagatcatcggtttggaatacagccctgttcctgcttcacttaatctgaaagaggcctttgctgctgctcatttgcttcatgcaaaaaaactggtccctatacattatggtttgtttgtgcatgagaaattttatattcctcaggtgtttgatgatcaggatttgaaaaaggtttcggaagaagtagggcaggagtatatgattttgaaagatggagcgctactggtgtaatcttgattgatatttgtaaggaaaattgtcattctgaatgcaatgcaatggaatcaagaatctcaacatcaataggaacgggctttagcccgttttcttttgtgcgtaatatgaatggctttagccaaaatttaaaattaagttgaggctgtctcaaaaggtaaaccaacgcctgtgagaatttcttaaatgacaaaagttgtcagacaggagtccgaaagagggggacttttgagatagcctcttatatttatatttttatatcgggctttagcccgataccattgatgatttcatttgatttctgaactattgtcattcaagaatttaaaagttatcagaagattatagattccacgcttcactttgttccactttgaatgacaaactttgtgcatatttatatttttctcagatagcgcggagctttgtaacaaatactgaatttcagaagtttgtttatctgtaagttttgtttttaatttatacttatcccacttgttttcgaatgaaggtaaaaattttatttaaaatgggaaatcatcatctatttcaataaatgggtgtttacgtaaattattttcatcaataaaatctctaagctttcgatatgattctaaataggatggtctatttccccaattattgccttcatccattacgtctggatttaaaaagttacctctatcatttacaaaatgttttaaattaccattttcaatacaggattttgtatgttcccagtcccactcaaaaatagcttctgttgcgcttataaaattagaaacgagattctcaaatatttctatattgtatttttttattaaattttgatttttgacattggttgtagttctttttgcggtaattcttgataatgccaatatttcttctaatagctctcggtcatcacgtaacgcctcgtttacaaccttattttcttctagtattttagtaacctttacctctaatttaggccaccacatttcaaaaacatcatcaaaaactttgtcttctagtttgttttctgataagctattattgatggttttaactaattttttaaaatcaaccttattgaactgagatgtttgaaattgtgttaaaggacctttaaagtctgaattatctaatccaaataagattgggcaaacttttgaattgtctaatgttttactaattgcgccagcttcaaatagcatccattgactatctaaattatcttttgtgtaaataaaaatacctagtctgctatgttctaattctttagaaatgtcagcattccaacgactccctttttctatatcttttggtgtgaaatatggttttacattttgtaaaacagcagggagccaatcttttattgcttcaccaatttgtctgctaacttctccagaccaactaataaaaactttcatttatatttgatttttttttgtaattatatctaatattttagatttatgtaattgattttttttatagtgattttggatattgttgcgagtaattaaaatcctctactataagcctaattccattgatttcaaattaaataaattaatctgacctatttttttctcatgtatgacaattgttaattttgcaggatatgcaaatttcatttcactcaatctaaacgtccaaagcattatttttaataaatcttcatcaccaatatttttatgttcttttatacgagtaataccagaaccaaaaattggaacggatacatttttttgagcgtaaacacgattaactctatcccaaaaattaatcaaaaactcaatatattcaggcatcgttaaggttgctctattgtgttcatcaaattttgaaaatgcagtaattataaagtcttgataaacaaaaattgtacttaatttaaattttacattttttcctccgcttgctctacgatattggctatcaacgatgtccgaattatctgagttattaataagaaaattatcgagatcagctattttattttgaaaaaaacgatttataaaaattccattaagtgagctgttagatataattttatcatctactattgtatcgaagaattcattaaatggaatagttttaagaccaggttctgaaaataaatcaccacatttaatatttacagtacttccgtctatatctatatttatatcagtaagtttatttgctttacaccaaattattagatatattaatatcaagacaacaaataatatatatccagaatatcttaaataatctttgtattcatcatgaactatattaaaaagcaatatgaatgataaaatacctgaaattactgaaaaataaatccagaatttatttctaatatttttgtctaagaaatttactttcattgtatgaattataatttataaaaataatcaccattttttatttttgaccctacccttaaatcagtgtcatttaaagcctttctaatgatttctttatttaaaggaatatgtaatgcaggtattttaaattttgaatctctaaaaattggtaatttatcccataaagaaattactgtagaattcagttctgttttggaataatttagtacatcttctttatttttaaaatcagggtatattacaataatgggtaattctaagttgttaattccataatctatttcttcccttaatgctctagaattaatagtgttattacttaaatataagataatgtttttagaatttcttaatctttcacgaagccttggttttaatgttgattcccaatcactattatcgcgaacattatatgttgtatcatgagcattattgaatggaaatgtactgtcagcccctttccatgctttcaacatattgtaataacaaaaatctttggttgcgtgagctccaagtgatgattcattaaatggttcactaacataaaatgcacaataattatttgttttactcataactttatttaagattattaatattgtttggaatttattataaaaaactctataaaacttcattattaaaaacttaactgaagtagccaaatttaaaacaccgaatccatattagttacagtgtttttacgaaaagtagtgtcaaatataaactacatttcttgtaaaatattacggttttccgtaatctcaaaagcctcaacctcaaaacatcccatttacaatcttccaacccctatagaactctaaaacaatagcaaaacacccctcccaattcctccgtttattacaaataagtatgtttggaacttcccaagttcttagggagtctcctgcaagttgcgggaagcctcccaagatattgggaggtttgttgcaagtatgtttgtaacaaaacaactttttctatatttaattgttaatttattaaatcaaaaatttcaattattttgcgcctttgcattttccaacaaaacagctataacataaaaaaactcagcaaatcgctgagtttttatttttgaaccattaaagatttttaatagtaacttaaggaaatatcaaagatgttttctaggcgctgtgctttatcttaatattcttaatactttcaaatcttctaaatggtttattgattcttaagggcctttatttcttcctgcaacctttggttttcctttttcaggtgttctatatagtctctttggttttccagaaggaattcgggtatattgcagtaataatttccacttactgttccaatttcattgttgcttaaggttccaatattattactattggtattattctcaaaattattgatctgtttggcatcctcttcttcatagatatcttctacaggaacatccaggaaacgggcgattttttcccattcgtcttttcttatggaaacgtctccgctttcttttctgctgtaattagatacatctgttgcaatgatgtcggcgatctgttgttgtgtgatgccttttacttttcttgcattgcgtagtttttctttttgcatgacccgtattttctacaaatatgcaaaatttttgttggagaatcgcaaagacgcaagttttttatacctgatgtgttgttttaaggcgcaagagaattatagattttcagcaagtgaagcttcatcaattttatcggagataaaatccttgcgtcttaagacagtttattttaataacaatttgcgcccctgcgtttttccaacaaattatatttttttgacgcaaagttttcaattatcctatttttcagaaaggaaccaaagttttgtggctgcgccattgacgaagcggcatgtaaaacgttagcttcgtaaaatcaatcttgattgattctttctttgctcgcttgagtatagcatttttaattagatctttgcgttttcaaaagggttaaaaaaactcagcaaatcggcaggctttctacgttcttattgttattttccaggaatctatgcagtgaaagctttaaaaataagagtttagattcctatggaatgacaaggtgaacgcgtaggaagactataaacatttatttgttcagaacttaatagaaactatccgcttagattatccatacagtctgtcattccataggaatctaaacggaattaggtgatttaaaaataattatattttttacatagttaatgaaaaactccggcgatcgaagatgccggagtctatgtctatttcaaagtaaaagagtattacttcacagccgcaatagccgcctcataattcggttcctgggaaatatccggtacctgctcttcatagatgatctttcctgaagggtctatcaccacaactgctctgctcagaagccctttcattggagaatctaccagctccaccccatagttccacccgaagtcggaacggaaatctgaaagcattaccacatttttgattccttccgcaccacagaatcttttctgggcaaacggcaggtctttggaaatacaaagtactactgtattgggaagatttcccgcctcttcattgaaatgatgtacagatgcagaacacactccggtgtctacactcggaaagatattcagaataacaaattttcctttgtaggaatccagagtctgatcattcatattgacatccgtaagggtaaatttaggggctggcttattgagagccggcaatttggcataggtatgaacttcctttcctcccattaaaacagtattgatggctttggatttttgagcaaagcctacagcagaacagaataagagtgtactgaaaactaattttgaaaacatgaaattttatttttcagctaaattattcttttttcaggagctaagattaattttaattcaaatagatcgaatctattgtcagaatatttttttcaaaacaatttacttctacctttatattattattaaatctcctgaagaaggagaatcttatcacataaaaaaatagaaagatttatgagttcagaaaatacagcatcatttcatcacatttttaagggtgaaaacgaaattcctgaagaatataaagttccggtgatccatcagagaacttatcttttaaatggcgaactggtagagtggaacggtgatgtcaccgaaatctattcacccgtatgcattcctacagaaaacggattggaaaggaaacttctgggaagcattccgaatattggcccgaatgaagccatggaagttctggaagcctgtgtaaaagcctatgataatggtcttggtgaatggccgactatgtctgtggaagggcgtataaaatgcatgcagaaatttgtatatctgatgatccagcagagagacctgatcattaagttactcatgtgggaaatcggaaaaacgctggccgattctacaaaagaatttgaccgtactgtagattatatcaaccagaccattgatgcactgaaagatctggacagggaatcttcccgttttcagcaggcagaagggacaattgcacagatcagaagagcgccgcttggagtcgttttaagtatgggaccgttcaactatcctctgaatgaaatctttaccacactgattcctgccctgatcatgggaaataccatcctttttaaacttccgaaacatggtgtattagctcactatcctttgctggaggctttcaaagaagcattcccgaaaggaacggtgaatactttatacggaaaaggttcagaaatcatcaccccgattatggaaagcggaaaagtaaacgtgcttgctttcatcgggtccagcaaagtagcaaacggactgaaaaaactgcaccctaaagtaaaccgtttaagggctattttaagtctggatgcgaaaaatgcagcgattgtcaccaaaaatgcaaacctggatgtagccgttagtgagtgtattttaggagcactttctttcaacggacagcgttgtacagcgctaaagctgatctttgttcagaaagaagttgcgctggaatttacagaaaaattaagtgcagctgtttctgcgctgaaacctgggctgccatgggaaaaggatgtgaaagtgacaccgcttccggaagtcaataagccaccttatttaaaagaatgtattgatgatgctttacagaaaggagctgcagtactgaataaagatggcggctatacggatgagtcgtttgttttcccggcggtagtgtatcctgtaaacagtgatatgaagctgtatcatgaagaacagtttggtccggtaattcctgttgttcagtttgaagatatagaagaacctatagaatatcaggtaaatgcgtcacatgggatgcaggtaagtattttcagtgaagatcctcaggaagtggcaagacttatcgatccgtttgtaaatcttgtaagccgtgttaatatcaactgccaggcgcagagaggcccggatgttttcccttttaccggaaggaaagacagtgcagaaggtacactttcagtttttgatgcactgcgttctttctctatcagatctttggtagcggcgaaattgacggattccaacaaagagttactgaatactattgtaagagaacatgattccaactttttaagtacagattatattttctgatctggttcagactgtatttaacataaaataaaaatcctcaataaacgtctttgtttgttgaggatttttttaacttaataccggaaattaaagttttgtgttataataaggtggtgttttttagaaatatcatctatgatcagtttgtaaatcatgtcttcatcggaaaaagaatttttagagaaaattgaaaagcataaaggagtggttttcaagatctctaaaatgtatatggataataaggacgatcagaatgatctctatcaggagatcatttaccaggcctggaaatcatatggtgattttcaaaagagaagtgatttctccacatggctgtacagaactgcacttaacacagcaattgtttttttgcgaagtgaaaaaaaacgtagttttatacagaatcagaatgtagatgggctgaatgcccggcaggagccttataatgatacagatgatataaacatgaaacggatgtatgaagccatccatcagttgagccccattgataaagcgctgatatttttctttttagaaggtttttccggaaaagaaattgcagcgcagctgggaattaccgaagtgaatacaagggtaaaactgaaaagggctaaagaaaaactgaaagagatcattacccgccagaatacgggctcctattaaatgataacactatggagttagataattttaaagaactttggaataaagatacaggacaggaatctcctgaaatttctctggaaaagaaaagagaaatccattctccgctgcagatgctgaaagtgaatatggaaactgaattctggctgatgattgtaacactgccaatgcttttaaccggtttcccttttgcttctacagattataatatcaggaccatatcagcatttgttaccatcctgaccgttgcgattatcatttatttttattcccggttcctgaaactgtataagctgctcaggaaaaacagcatcaataccaattatgacctgttcaatcttaaaacccagcttcttgtctcgaaagaaatttatatttcctattatatttcttacatccctctcggatttcttttgtcactgatcaaaatcaacttccattttgatatggaatataatctggcgatcttcggaatcagccttctgattacattattgctgatcgcttttatcatcagatactggatctattatatgtatggaaggtatattgatgatgtagtgcggctggtagatgagcttaacgggattgaagtaagtccgaaacaggaaaagaaaaagacctggtttgaacgctcacagagttttttcatgaataaaatgggaattaaaggaaatattctgaataccatcatatggttcgtatccatgtatatttttatcattttattcctgacacttgttcttctgatcatcatcatactgggtgcaaaactggatttcctcgatatcggatcattgcagagagctttaaataaactgaattagaaatggcttgtcttcttaaattttttatctttaaaaggtcgagctgttaaaaaaatatcagatggatgagattaaaaatcagatgtattctatagaagaatttctggaactcgtgaagcataagaaagacaggaaagaatcctatgacccggaatacaattatgcggtgtattcttcaaaagacgaatttgagcctggaatgaaagttttcattggcgatcctctcgatattggtgagaatgataatgaaatcttacccgattttgtataccataataaactgaattatatgtgctctgatgagaatattcaggatgtggtggatcttgctgtccggcagtacggaaatgtaacttcttcccagcttatcactgccctgaatcattatcttcaaaaagatgattttcttgattttaaataatattgatgtttctgcgcaaataataaaagtcttctgaaagaattgaagacataaaaaatttcggcgggctgaaagcccgccgaaactctatcattactgctttttatttttcttttccttagcaatttcgttttttatccaatccagttgaggatcttttttatcaataatatcctgcatgctctcaataatttttacatcaggaacaactccttttcgtgaatctgaaaaattgatattaggctgtaccagaagtaatccgattggaaatcttatttcagaattgggaagtttctgatatgaataaaaacctgcaacggtcccgtcattggcaccaccggtctcttctcccaccagcgttgctcttttatcattcttaagtttggcggtgataatagaagatgctgaaaagcttccaccgttaatcagtacaaaaacttttccatgaaaggcctgttttttaggttttgtaggtttgtcagctttcattttatagaagacctttccgtcttttttatacgtactgaaagcctgtgcaaaaaaataactagggtatgcaatacttttcagtgcatattccagcgggttgcttttcctgaaataattggtacgcagtggtgtattccttgcagccagctgcgaaggtttaatcagtgtaaaaggagcatccgccagataagaatacaggttgttgatctcataaagagagcctccataattgtttctgacatcgataataagataagaagacctggcattattgattcgggtaaaagtttccttatagaacctatctgaaaaatctctggagaaacttttcacttttatataagcaatagtgctatctttatcgagaaatttaaagcttctgttatatgaatcgctggaagccacataatcattcagtttcttttccagggtcttcttctccatttccttctctttttcaagatcagagtcggattttgtttcccgggttatagtatacgttttcttttttcccttatagagggtttcgagggtggctttgctgccaaaaccattttctgcagtataaaaattgaagaaaagatcctttaaaaaataaggatagaaagtggtattatcaccatcactgctgatcaggcttctgtatttttttatataaccggatacaggaacatgattgatggataaaatctcggttccgggttgtatattttcgatagaatctttgttttcaataatatacattctatctcctgaaatataatattcaaaacggctgaacattcctttctgatgttccagtcttttaatttcacttttggtaaatttctttcttggaattctcagtgaaaggtgtccttcccgaatgccggcaatcactggctgaagcttaaaataaaactgaagaggagtaagaggttcagtaattgtctgcttgagactgtcaaatttatgttccaattccttcttgggaatataccagtataattgagggtgcatttgctgtaattttgaataggcaaaatccacatcctccttaagttgctccggtggaatacatgcagcacgctgttcgttgtgtttttttatagaggcacaggacgaaaatatagcgagaagaaatattaccgaataatttttcaatgtatctgagtttttaacgtgctaaaatagaaagtttaaaattaatcaccatttaaatgagtaataaattttccaaaatacatgataaatttagttaaaaaatgtagtaaaatggaatatattttcatttaaaactaaaagtcaatacatttgaaatttatttgtaaagatgatgtattggattattacaagtctggctgttctgacagtcactttttttattgtgatcaatatgaaagcttttggcggcgtgcccaaagggaaaagactgaagcggataagacaatcgaaactttataaaaacaaacagttccggaatatcagccatactccctccattacagaaggatataaaatttccaaggttatgtatgacttctttttaggtaagaaggatccgctgctgaagcctctgactgtgatcccatctcttcatacggatttgaaaagtatagataaaaaccaggatgtattaatatggctgggacattcatcttattatttgcagacagatggagtttcttttttaattgatcctgtgttgagtctgtatggctcaccttttaaatattttaataaagcatttaaaggatcagatatttttaagcctgaagatattcccgggattgattaccttgtcatcacccatgatcattttgatcatttggattatcccactgtacaatctatcagagacagaacgggtatggtcattttacctctgggggtgggagcacatttggaaaggtggggctattccgaaaacaatcttattgaagaagaatggggagcagaagttgagctgaaaaatgatctgaaaattatttttacccctgccagacatttttccggcagaagggtgaggaagaatgataccctctggagttcttatgtcctgattacaccaacaaagaaaattttcttgggaggagacagtggctatgatagccattttaaaacaataggagctgagtatggtccgtttgactatgcaattcttgagaacgggcagtatggagaagcatggaagtatatccatacattaccggaagatgttatccaggccggtattgatctcaaagcagaacgcattattcctgttcattctgcaaaatttgcactggcacttcatccatggaatgaacctttacagaagttaactgctctcggaaaagaaaaaaagataaatatcctcactccgatgataggcgaggtagttgatctgaatcattcaggacagcaatttaccacctggtgggaaaactgatcaggcatgccagatttctttatatcttgcagggtgattttcaaactgctgtcttacaaaatcacattccgggtctacaagcaaatctttttcttctgcatagcgtaccaattcatccagcaatagtttggcgtatccttttccctcacgctcttcatcaagcttcgtataatatacaataagcagtcttccgtcaacctctatggacatataacctgcttttttatcatcaataaacagctgcaattcatcctgatatggagatacctgaaactttatattttccataataaataagatttggttgattaataattgaagaatacttttgaaaaaacattcttttcattaaaattacgaaattaaatcatatggaataattgtttttaagaatcttaacgaattttataacataaatgataagataaaagataaaagataaaagataaaagataaaagatgtttattgctataattcaataggggtgggctttagccaaaaattaaaataaatacattttataaagcttaagttttcattgataatttattgattattaatacgatcgatgtttaataaaaacctattacaatgccattacaattttaaaacaattaacattcaataattctaaaaaaataaaatatattttaaagataatcaactgtttatggtttttcttaacaaatattagtatttgtggttaaaaattggcactttaattgactatctcttcatgattaaccttaaagtggagtgaaatgaaaaaattaatattaacagcattattggttgggacgttcagtttaagctatgcccaatccgattattataatgattacagaaggagtatttcagatgtcaactggcaaagagtgatcactgatcttgtactttcaacaacacaggccaatcagatctatgtgttgaatgacagatatcgtgattatgattcgtggaacagggtttatgtagtagagccgggaagatggagaaatgaccgttattccgaactggaaagaatcctcggtagagaaaagtatattatcttcaaaaagaaatattacagaggacaaaatcctgtcatagtgtacggaagaaacaaaaatgattataaaaagttccgtaaagaacaggaaaaatactataaaaatcaggagaagtactataagaaacaaaacaaacatcgtggtcatggacacgatgacgattgggattaacaattatcaactatattcacttacatggctggcatctttgtcagccatttttatgtccggtcagaaatatttttacctttaatttgtttgaattttataattttgatatatggaaacacacgaatcacttaaggacttttatgaaagaaatgctcccaacctggaatcatcatgtatcggaatcagtaaaatgggacatttcaatgtattttcccgggaacactgctcactactgactccttacagcaggagatattattacaagatttcactgattataggaaaaggaaaacttcattatgccgataaatggattaaagtggaccgccctgctttattgttttccaatcctaatattccttattcatgggaggctgatgatgccaatcagaaaggctggttctgtctgtttacagatcagtttctgcataatggaagccggatgggtaatcttctggattctccgctttttaaaattggaggaactccgattttctttgttgaccaagaacagcagaaaacactttcggatatgtatacaaaaatgatgactgaaattcagtcggaatatattcataaatacgatatgctgagagcgtatcttcatctgatgatccatgaaaccatcagaatgcagccggcagaaagttttgagccttatcagaatgcctcacaaagagtagcatcattgtttatggaattgctggaaagacaatttccgattgacagtcctgctgcctgtttaaagttaaaaacgcccaatgattatgcgcagagcctttccatacatgtgaattcattaaaccgctctgtaaaagagattacagggaaaacaaccagccagcagatcaccgcaaagattattcaggaagcccaagctttgctaacccatacagactggaacatctctgaaatagcttacggtctgggcttcgaagagcctgcttactttaccaattattttaaaaaacaaacaggaattaccccaaatgctttaagaatgaaccttgtttgaattttataattcttggtttgaattctatataacagttgatctttccatattctaattttgtcttgtaaaattaaatcatacctatcatgaaatttaaaaaattaggaaacacagaagaacagttatcagcaatcggtttaggatgcatggggatgagttttgcttatggtcctaccgacgagcaggaaagtatcaataccttacacagagcgttggatttgggcgttaacttttgggatacagcagagatgtatgccaatggagaaaacgaaaaactgatctctaaggttttggttccgaacagagataaaatttttattgctaccaaattcggattcagatttaaagatggtaaagcaagccacagcggagctccgggaacttatttcgatggttctccggaatggatcagacaggccgtagatttaagccttcaaagattaaaaatcgatactattgacttatattacgcccatagagtagatccaaatgttcctgtagaagaaacagtaggagcaatggcagaattggtaaaagcaggaaaagtcaaatatctcggattgtcagaagcttcggcagaatctatcagaaaagccaataaaatccacccgattgcagctttacagtctgaatattccattttaaccaaagatattgaaaaagaaattctgccaaccatcagagaacttgggatttctctggtcccttattcaccgctggcaagagggctattcaccaatatctatgatgcacaaaatctgggtgatgacgatttcagaaaatcattaccgcgttatcagaaggaatatcttgaaaataacacaaagctggctaacgaaatcaaccaatttgcagcttctaaaggagtgaaaggaacccagcttgcgctagcttgggtactgaaccagggagatgatatcattccgattccggggacaaagcgaatcaaatacctggaagaaaatattgcagctgtcaatatagaactttcccagtcggatctggataccatagatgccatcctgaaaaaatatcctaatgtaggagaacgatacaatgaaggttctatgaaattggtaaacaactaaaaactattttagataaaaactgagtttcttcttatgaaagaagctcagtttttacatttatatttaaatgaaaagaacccgactatgaacagaagagaattattaaagaacggattattggcaggaacattaagtatgattcctttttccgggttaatggcagaacagagatccattccggaaaaaacaggggatgatctttccggatttaaaaaactgaagcttggtgagcttgaactatttattctcacagacggatatattcatgaagaaaacctgaattcatttgcgccaagaggcaccgtttcagaattaaaatcaattcttagagataatttcagaccagagaattatattgatcttgccatgaatattctattggttaaaacaaagaataagctcattctactagataccggaatgggaatttttgctgatgaaagaacaggatttctgttaaaaagccttcagaaagctggttttactcccaaagatattaccgacgtttttatttcacatgcccatcccgatcatattgggggagtgatagataaaaagaatcagcttatttttcctgatgcaaatattttcatctccaaaacagaacatgacttctggatgcaggcttccatgaaagacttcaacaacagtgctctgaaaacacaacctgaattccttaatcaatttatcccggccgtccggaatattctgaaaacgattaagcccaaactgaagttttatgattttaataatcccttgtatgattattttaattttcaattagcacctggtcacaccccaggtttagcggttacaaccatctcatctggaaatgaaaaactgatctatatcgcagatctgattcattccgatgtagtcctttttctgcatcctgaatggggatattttggtgatacggatcttgatatcgcgattgcatcaagaaaaaaactgctgaaacaaatggcagataccaggatcagagcatttgcttaccacttgccatggccaggtttgggttacacaaaagaaaaggctgctggttttgaatggttcccggagagttttatgagttaggtaacaggtagcaggtgatagcggtagagattaaggatatggggttgttgtcacttaatcagtgaacaggtacttagcattcccctcccttggaggggtggcaaaaattcaaacaatttttgacggggtggttaatataaacgggttactatacaagatatttcaatcaataacagaggactttagttcgctttcaggaacagtaatcatccatccggtttcagccagaacttattgatccaaactttaatgatataaaacaacagtacctcccgggaaacgggaggtgctgttttgaacataagaaaaatttaaattatgcttctccaaataccagctcaggagaatacagtttcctaaacatcagataagtcatcgtaagtacggaaaaagcaactattgcatccaccgtagccggaaaaccaagcacggcaatttttgaaaagaaagcaaagagaatatcaaagaacattccggcaaatacccattctttcagcctcaataatctgttgggaagcagaagaacgagaactcctgaaattttaaaaacacccagtatatagataaaatgaggtggatagcctaactgttgtgtgatgtcccatactacagaattttttgtaagttcaaagaacccgctggctccaaaccatagtgacataaaaatagctccggcccaatagatgatttttgtagtttttgttttcattgctgtatattttagttgttattatgtattagaaattatttaaaagatgtttttgctgatcccgagatttctccggttttgatattctgaataaaagctatcacttcccatttttcaggagaaaaaccttcaggaattctgaatgttgttgttccttcctgcttattcagtgagacgtggttctgtttatgaacaatttgccagtgatgcagatgacgcccttcgttttcacccttaccaacctgggtagaggaatgtttttcaacaagattaacgagaagtacactatgagaatctgaggctgaagttttatattgaacatcaatcgtactgctggaaatatttgccgatagtgccacatctgtttttttagaaacaagcagagctttctgaatggaatttttaatattattctcatcagagcctacaaattccgtttttccattaattatcagctgtggagtatacacctgtgaattcaaaatacggctgtactgctgttggcgctgcgaattttctgcagtactgaaccggtctttccatccaagacgattccagtaatcaacgtggtaagagagaagataaacaggctctcctttatattctttttcaatttttcccatgagttcatctgcaggtggacagcttgaacagccttctgaagtaaaaagttccaaaacagcgaaaccattggtttcagaggctggatgttgtactgtcttttgatctttattttgatgaataaatgctgaagtagcaaataacactgcggtaaaagcgcttactgtgattaagttttttagtatcatgtcttttaatttgattcaaaagtagatacttgataaaggcaaaagaatacaaaacaggttcaaccggacaaatcaaaaggtgaacccggaaattgtgaggggaggatatttgggctgggagaaggaagttggaagcgggaagtttctggagtaccaagagaagaaagtttgtcttttaaatattaaatagaagcaggaaagagcttaagaaattaaaacagatcagataaaagcaaaagaaaaccccaatcatatcaatcagggtcataatgtatctcaaaagagttctatatcttagaatgactgcaagtacttccagctcccatcttcagacttccttactcctaaaatattttaaggctggaagctggaagtgagaagctggaagtttttggtgtttgaaaaggaatagtattttatttttttatataaacaacaaagttcaagaactaagacagataaataaagcaaaagaaaaccccgatcatatcagtcagggttataatgtatttcagaagaactctatatcttagaatggctgcaagtacttccatctcccagcttcagacttccttactcctttacctgtcctcaagccacgtaaaaaaactatgcgttttttctttattgatcaaaagcttttcaggcgtttcaacagtaagttttacaaggattttacgttggaaataatgttccatttccttaatggctttgaaattaacaagatactgtctgtttaccctgaaaaattgcttgtctgaaacctgttccgctacctgcccaagcggctgggaaaggggaaactgttctttggcaaatgtcaccagatgcgtgatttcattgtggatataaaagtaggcaatatcttcagtaggtatggtggtatatttttgatttttaaaaaccaggaaactactcttaccggcagcagcaggctggctgattttttgtatcagtgattccaggtccggaagttcatttttctggaagaattttttcagttcatccacttttctcagtgcttcagcaatatcttcttttgaaaaaggttttaaaacatagtcaactcctttacttttaaaggcatccagcatgtactggtcaaaagctgtacagaaaactacagggcaggtgatctccaccgatttgaaaatctcaaaggaaagtccgtcagaaagatggatatccataaagataagatcaggtttgatatcttttaaaccttcaatacttgtttcaatactgtcgtaaacgccaaggattttcgaatccggttgtaagtctgagagtaaattctgcagggattttgcagccctgaattcatcttcaataatgattatattcatggattaatggtagttttatctggaaagttttttcatctgaatgaatgatgatatccttttccaataagtgtttgtaacgcattttaatattatcaagcccgactcccagcgaatcttctgcattcattttacgctggatgggattttcaatgacaatatggttatcgttgttatagattttaatatgcaaaggtttgctttgtgaaacaatattgtgcttgatgcagttctccaccagaagctgaagcgtgaaaggcggaataagggttgtattgatttctttttcaagttcgttggtgaacttaattccttccccaaaacgtgctttctgaagaaaaagataagcgtctactattttcatttcttcctgaacgctgatcagatccagttttctgctttccagcgtaaaccggtaaaaatctgaaagctttacaataaaatcaaccgtttcctcatcatgggtttcagccattaattttaaggtattcaaactgttgaaaagaaaatgcgggttgatctgctgttttaataattcatactgggctccaagattatcactctttaccttttccagctcaagttgtatctgctgtccggtataattgttctgaagcagcgtaagaaacatatagcataccagattgatcagaattccccttacttccaccatcagcatcaccggtccgaaattaatatgggaaagaatcagctgctggatccatgccagtccaaacatgatcaccatcccgaaagccagtaccaccatcaatctggaataggagatatgctgcctgcgttttcctgtacggttcagcatatagatattgatataccacatgataacggaaaaagccgctgtaatccccgagtttacggctgcctctttccagttgaactcatgagaggccagctgaggtacagatgataaaatacccaggaaaacagagcttatccagataatggctggtgagatttttattttttgctgttgcatgaaatctgctgatttgaaatggttaaattaatgctttttatttaaaatattatgataaatagtaaagcgggcgatttttattaaggcctgcttagggggcggtaactcatgaaatactgtattctttcttccttatttgagaaagtattcttaggctgatcatttttaagatcataagagatatttccggcattgtctgcctgaacggtttcgatacttaccagttctccagtgatagttccaccgatatattggggattgtcgtggtatttccaggtaaccagtttcataacagcacctgcttctggtgtccggcttttctttgacaaagatttcagtgctttttcgtttccatatagagccgacatagtttctttcttgggatttaaagaattggagatcaatttgagagaacccgcatcaaaaacaactctaacaagtccgttatttaaatcattattttctttgctgcacgcggtaagggaaataaggcttacccataaaatcaggattgtatttttcattttttctgtaaattttgaattagtctttgcgtatttactttcatcggaacatcaaacaggtaacctgttttttctgctaattgtctgtggcaggcaatgcaggattctttggcaaaagatgctgtttttcccgttgggtgaaggtcatttcccgagaattttgcaaatccccagccttccgtatctttatattgtctggaatcttttaccataaactgtgcattgataaattttccgggcctgatttctccatcaggaagctcttcctgtttccatacagattttacaacaacacttccttccggccatgggtgaaaattttctgtttccaccgcttttactgcgatatcatttccatagatcacacgaatggaatgatcaaacagtgtactcatactgatcactttccagtttttaaaatcaggtgtgtattgaactccattgggagaaacaggaaattttgttgatgctggaataggtacactagatgagacttgtggggtttcaatctttttctgagcagatgtacttactgaagataaagaaagcgtatattttttaatggtttcaatatctttctctgtaatcttagctgaaggatgcagaagagtatattcatggagaggcattttaccactttgcatcatattgagaatagcatacatttttccctgatgttctgcaggagataatttttcccattctgagaagttcaggacttctctggctcttctgatatctttgtttacagcccaggaaacaggagcaagcttatcataccagcttagattctgctgattggaatgacagttgaaacatgagttttcaagaatactgatcacttcctttggggcttctatttttcctgtaaccggctttccttccagtggtttactgaatagctgaagtcctccgaagattcctaatattgccagaaatacgatagcaatgggatttctctttttctttgcggtatccataatgtgtattgtttttattttctgattcaaaagtaggcgtgtaatacatgttgtgaaacggaaaacaaactgagttggacaaatcaaaaggtgaatcctgaatttttaactccgaaaatacacatgaaaaatcccggtaacacaattaccgggatttgcttaaatctgtttattataaagtcataccgccatctatcacaatttcggtgccggtaacatagcttgaaatctgatcatctgataaataggtcacaagttttgcgacttcttcagcagttcctgttttcttcaacggaatctgttctatgagatggttttgaatatttttcaaagtctcttcatccaaccccgccttactcataatttctgtttttataggaccggggctgatcatattcacccttatttttcttggagctaattctgcagctgctgttttcgcaatagaattcagtgctgccttacttgcctgataggcggagctgttaggtttataggtagaagcgacaatagaagataaaaagatgaccgaagcaccatcatttaataatggaatgaatttgcttaatgtaaagtaagctcctctgaaattaatattcatcacctgatcaaaattttcgacatccatgctttcaatcggagtcaatgtacctgtaattcccgcattgataaacagtatatctattttcccgaattgcgtttcaatttcttcttttaaaagatcaatatcactaaggtttgcctgatctgcgataaatggaatggcaccaagttcctgagccgctttttctacagcctctttgcgtcttccggtgataatgacagttgctccttctgaaataagttcttttgctgcagagaatccgatcccgctgtttcctcctgttacgacagccagtttgttactgaattttttcattgtaaattttttgtcaaagttattttaaaatggtatacttttgtaaccagtatcacagagtatatcagtatcattcatgatatcacttaactttgcaactatggaaagaaaccaaaatgaagaactaagagcgttacaggataccctttattttatcggcggaaaatggagaattcctgtgattaattctatctgtaacggaaacagacgcttcagggaaattgaacgcagtattcccggaattaccaccagaatgctttctaaagaactgaaagatatggaactgaacaaactggtaaaacgtaccgtttacccggaaactcctgttttaatagaatatgagcctacagaatactgccgaacatttggaaatattatccaggaaatgatcaattggggtagggagcataggagagtaattgtggaagataggtaaggtggcagatgttagattgcaggaattagaattagggatgcgtcgatcttgatgagtatatatgtactcactattcccctcctctggaggggggcaaaaattttttgaatttttgacggggtggttgtaccgatattttttaacggggtggttacaaaaaaagctccttaaaaaaggagctttcatttatatcaaaacgaacaattaaattccgtcaatgatttcatttaaaacagtgctaggtctcatggctgcatacgttttatatgtatcagttttgtagtaaccttcaatgttctgaggtttaccctgagcaccaattaattcagcattgattacttcttcgttttcctgcattgcctgtgccaccggagcaaactgggcagccagttcagcatcagcagtctggttagctaaggcttcagcccaatacattgctaaatagaagtgagaacctctgttatcaatttgacctacttttcttgcaggagatttgtctgtcgctaagaatttagcatttgcttcatccaatgcatcagctaaaacctgagattttgtattcccctgagtctgtgccaaatgctctaaagaagcctgaagtgctaagaattcacccagagaatcccatcttaggtatccttcttctaagaactgttcaacgtgttttggagcagaacctccggcacctgtttcgaataaacctccaccattcatcaacggaacaatagaaagcattttagcagaagtaccaagctcaaggattgggaaaaggtctgttaaataatctctcaatacgtttcctgaaacggaaatggtatctttaccttctcttgctctcttcaatgtttcagtcatggcatcttttacatcaagaattctgatatcaagacctgttgtatcgtaatctgcaaggtatttttctacttttttgatgatttctctgtcgtgagctcttcctttgtctaaccagaagatagcaggagtatcagataatcttgatctgttaaccgctaattttacccagtcctggataggagcatctttagtctggcacattctgaagatatcatctttttctactttctgagaaagaagaacgtttccggcttcgtcctgaacttctacagttccgtcagcagataattggaaagtcttatcatgagaaccgtattcttcagctttctgagccattaaacctacgttcggaacagatcccattgtggtagggtccagttttccgtgtgctttcatatcatcaattacagactgatagaaacctgcataagaacggtctggaatgatacaaactgtatcctcctcatttccgtctttgttccacattttacctccgcctcttacaagagcagccatagaggcatcaacgatgatatcagaaggtacgtggaagttggtaattcctttgtcagagtttaccattgccactcttggtccttcagccagcgctttttcgatatcagctttaatgtcagcttcctgagcatttcctttgattttttcgaaaagatcggcaagaccgttatttggattgatgtctaaagacttgaaagtctcagcatatttagtaaatacatttttgaagaaagtctcaacaatagccccgaaaataatcgggtcagagattttcatcatagtagctttaaggtgagcagaaagaagaacgtttcttttcttagcttcctcgatagcctcctgaacaaatgcttttaaagcttttaagttcattacagaagaatcaattacctcaccagcctgaagacctgcaaagtcttttaatacagattcagaaccgtcatttcctttgaatacgattctgtattttgtagcgttttctactgttgtagaagtttctgtaccgtagaaatcaccattgttcatgtgagctacgtcagttttgctgtcagatgcccagtcacccattctgtgagggtttgctttagcatagtttttaacagctttcggagcacgtctgtcagagtttccttctcttaatacagggtttacagcacttcccaatactttggcatatttagctttgatcgctttttcttcgtcatttttaggctctgcaggatagtttggaactgcgaaacctttaccttgtaattcagcgattgctgcatccaattgaggcacagaagcagaaatgttaggtaatttaatgatgttggcttcaggttttgttgccagttctccaagttctgccaaagcatcaccgattttctggtcgtctttcaaaaactcagggaagttggccaggattcttcctgccaaagaaatgtccggtactgcgatttcgatatctgctgattttgtgaaagcttttacgataggtaaaaacgagtgagtagccagcattggagcttcatcagtaagtgtgtaatagatttttgatttttctgacattatactgttattttttatttgaaattttaagtcccacaaatttagtaaatatcattgttttatttgggatatttccataaaaaaagaggctatacctctttaattttacattggtgtaattgtatggcttataaaccaatttctgtttgaaaaatgatcattggataaaagaaaaggtattttgactttaagattaatttaaccttaataaaacaggaaaaattttcttttttgattacatttgaagaactaaaaaataaatattatgtcaacgacaattactttaaaaggaaacgaagtacacacaataggaacattaccagctgtaggaaccactgtaaaagattttgcactggtagactcaggattaaatgtaaaaacccttgaaacttttgcaggaaagaaaaaagtattcaatattttcccgagcattgatactcctacctgtgctgcttcttccagaaaattcaatgaagaagcttcaaaacttgataatacagtgatcatcaatgtttcaaaagaccttccgttcgcattgggaagattctgtgcagcagaaggattgaataatgtagaaacactttccgatttcagaagcagcttcggagatgattatgaagtaaccattgcagactctcctatgaagggattgttaagccgtgcagtgattgttacagatgaaaacaacaaagtagtatatacggagcaggttccggaaattgccaacgaacctaattacgatgcagctcttgcagcattgaaataataaaaataatttttgtagaaaagccttgtgaatttaatttttacaaggctttttttgaacaaataaaacagcgcaaaaatggtaaaaagaattgtagccaatattaaaacagatgatctttctaaagcagaacaattttatcaggacattcttgagttggatattctgatggatcacggttggattaaaacactgggaaatgatgaagaggcaaaggttcagatcagctttgcagaacagggcggaaatggtactgaagttccggacctttcaattgaagtggataatgtggatgaaatctatgataaaatgaaaaaagccggctttgaaatcatttacggacttactgatgaagaatggggagtccgcaggtttttcgttaaagatccttttcaaaagctgatcaatattctgtctcaccaataaaaaagtatcatgaaagcagatcgcatcattcctgtcttaagaatctttgattatcagaaggccaaagaattttatgtagactggctgggcttcgagattgtctgggagcactattttgacgaaaatactcccgtttatatggaagtaaaaagagaaaatattattctccatctgagcgaacatcatggagacggaacacccggaacaagagttgccgtctggggggaaggggttcctcaatatcataaagagttaattgacaaaaagtataaatataaccgtcccggactggaaaaaacattctatggcgctgtatccttcaccgtaattgatcctttcgggaataaaattacatttgaagaagaatatgatgaagcaaaacataaagaccttgaatttttctctattcattaatttcaaagcagaataaatcttaccgaatgttgattacagtcaataaaaatccggaatattaaagctaattttgtagaatgaaacgttcaggaaccgcagatttaccccttcactatggcaaagtaccgccatggttgtatgagcgtatgtctgtgctggggctttccattattgaagtaattctcatggattatggtaaagatgaggtattgcgcaggctggcagatccgttctggtttcagagttttggagctgtaatgggaatggactggcattcttcaggaattaccacttccgtaatgggagcattgaaacgttctattaatcccaattcacaatctttggggctttatatctgtggcggaaaaggaaagttttcgagagaaacaccatcggaactgattaaaattgcagataaaaccggattgaatggaacagacctggtaagagccagcaaactttctgcaaaagtagataatacggccatccaggatggttaccaattgtatctgcacaatttcattctctcagataatggaaactggagtgttatccagcagggaatgcatgaatcggacggaacagcaagacggtatcactggcattccgaaaatcttacctcatttgtggaaaatcctcatacgggaatcaacggaatttcaagaggaagaatactgaatcttaccgatgcagaagcttcagaaaacagaaaaggaatcctggatatttcccataccgattcaacagaagtaatgaaagattttgcaagattgattcttcctgcccaccatgatgttcaggcttccgatgtagacctgaagcgtttgggagcacttctgtatgtaacccgtgagcaacagccgcagaattttgaagacttactgatgctggaaggtgtaggtcccagaaccatgcagtcattggctctggtaagtgaagtgattcacggggcgccgtcaagatttgcagatcccgcaagattttcctttgctcatggaggtaaagacggacatcctttccctgttcccatcaatacttatgatgaaagtatcagcattatcaggaaagggattgaaaaatccagactgggaaattctgataaactgaattccttaaataagctgcatcagatcgtaaccaaggcagaaaaagacttcaccccggattttgacattcagcaggtgattgaagaagaaagacagaattcctggcgttttggcgggaaaacggtattcggtgatgcagagaaacccaaccctcccaaacccatacagctttccctgttttaaaaaaatatttcctgtaaaagcttacaattactgtatcggcagatagtcattcccatcctccggaggagtggcgaaaattcaaagaatttttgacaggatggttaaaatagtttgttttttaaatgcctgtttaaaaaatattagccttataaatatcttttatttcagtttgatatctgcttttttataaaagctttatattctttgtttaatattttttctttttaattcaattaaaaattttatttttaaagacttaaaaaaattgacaccaaatgaccaataaagccttagaaatctgctatgattttcccttctttttccgtgaagaacttgacgaaatatttaaggctcatgaaaaaacatcttttcagaaaggagatttcatcctggaagaaggaaaaacagccaatgaatactatatccttgagagcggacttgcccgttcgtatgtcaatgacttcaacggaaatgaagtaaccacccatttttttacggagaatgaagtgattattgaggttttatccatgtttcaaagaataccttctcaggaaaatatcgtttgtattacagactgtgaatgctggaagctggattatgatacctttcaggaacttttccataaaattccaaacctcagagagtggggaagatcatggatgtcccaggaactttttgcctacaaacaaagatctgtggaaatgtttaccctttctgcaaccaaaagataccttaatcttctggagcagaaatccaaagtcatccagtttgctcctttaaaacagattgcctcttatcttggagttacagacacctctctgagccgtatccgtaaagaaatcgtttcccatcccaagaaaatttaaatcttgccctatgacaagttgattttcattgcaccttggtaattttggataacagtttaacactaaaattacagaaaatgaaagtcaatcagatttatgtgaaccttccggtaaaagatgtacagaaaacaaaagaattctggaccagggtaggtttttcaattaatgaacagttcttggacgagaaggcagcctgtgttgctttgaatgataccatctatgttatgtttctgcaggaagattatttcatgtctttcactaataagcccgttgccaaagaaaataccagtcaggttcttgtggcagtaggattaaacagtcgtgaagaagtagataaagtagtgaatacagccgtagaaaacggagcgtggcagcatgaggaacctcaggattacggttggatgtatcagaattccttctgggatccggacgggcacggctggaatatcacttttgctgatctgtctaagatgccaacagcataattcaacccggatacaaaataaatattgccctatggcaagcactttcctagtatatcctgataattttgaagcataatcaccactaaatttataaaaatgaaaatcaatgaaatatacgtcaacttaccgataaaagacgttcaaaaaaccagggagttctggacgaagctgggcttttctatcaatgagcagttttcagatgagaaggcaatttgcgtaatcatgaaagaaaatcacatttatgcaatgtttctcaaagaagagttcttccagacctttaccaacaggccttttgcgaaaggtgatacaacacaggtacttcttgccataggagtcaatagccgtgatgaagtggataacatggtaaaaacagcaatagaaaacggaggttcaaaatacagcgagcctatggaccacggatggatgtaccaaagcagttttgcagaccttaacggccatcagtgggaagtaatgcatgcagatgtttctcaattaccttccgaataattgctgtcttccaactatcaaataacagtcacatggaaacacaatcaaacgatatagaaatcataaaaaatcaggtagtcagtaactattacgtgatgactatgaatatggacggcattacccatgaagaatcgatgatttttcccaatggtgaagccaattgtatgaactggattcttggacatctgatctacatcagaaatcctttactgaatattttaggagaagattctgtgtgggataatgaaaaattttctttctataacagaggcgaaattgctttgaatcacaaagataaattgatcagtttcgaagaattaaaatcttatttaaaacaatctcaggacaaactggaagcaaaactcaacacgcttgaaggttttaaacctgaaacggttaaagatatctcaacccttagcctccatgaaatttaccacagtgggcagttgggctatctcagacgaattttaggaaaaccaggcgcaataaaatagatttcttgctctgctcggaataaaataaacagcattaaaatattcattaaagagcaaaattttatcgaagataaaatctttgcgccctaaaaacgcaaagtttttacaatacttagcgcctttgtgtttatcccaaattctaacctctaatttctagcttctaatctctaatatcaaattaaaatggacactccaaaatcaaaaaaaatagaagtcattattccggcttacagaatgcattcccaaagctttatgaatgttttggacggcatttcggaagaagacgctttgaaaagaattgaaaataaaaccaaccatattgtatggatggcaggaaactttatcaatatgcgctacggtttgggcgctctattgggaattcaggaacaggatccttataatgacctgtttttccagggaaaagcactcgatgaaagttttaaatatccgactttggctgaattgaaggagaatttccatgccatttctcctaagatataccagaagctgcatgaggtaaccgacgaagaacttgacgaaatatttgagataggaatgaatatccctttcatcaaagaaacaaagctcaactttgcaggcatgtgcatcggtcgtgaagattacttatgcggacagataggcttaatgcgcaggatattaaattatccgggaatgaaatatgatgttgacgaaaaccttacatattagcgatgaatccagtagaaaaaggatataagaaggttaacggaatccagttatattacgaaatctatgggtcaggaaaacctcttgttctgattcatggcggaggatcttccattttgtatgattttaaagaagttattgccagactggaaggcaaattccagctgataggaatcgatttacaaaatcacgggagaagcgagcatcgctatattcctgaaacctttgagcaggatgctgacgatgttgcaggacttctggcagaactgaacattgctaaggcgtcattctggggattcagcaacggaggaagtaccgtaatgcagattgcccaccgccatccgggaatcgttgaaaaactggttgttgcctcagctttctacaaaagaagcggaatgatagacggtttttttgaaggaatgcaggaagccacctttgactcaatgccggaacctcttaaaattaattttttaagcctcaatcctgatttttcaaagcttgaaaacctttttgagaaagactgtacaagaatgcagacttttcaggactggaatgatgaggtcttgtcttccatacaatcacccacattattcatcagtggtgatcaggatgtcatgaaaccggaacatgctgccgaaatgtggcggctggttaaaggttcccgactgatgatacttcctgcaacgcacggtgtttatatgatgccggattttgacggaagtattgataccaacttaatagactttaccgtaagagaggtagaaaaatttttaaaccattaagcattttatattcatattaacttaattaattcttaatggatcaacagtagaacctattttttataattataactttaaaattaaaaatcatggctaaattaaatccgtatctgaattttgatggaacagctgaagaagcgttcaatttttacaaaactgttttcggtggcgaattcgtcgggggaattcacaaaatgggaaatgctcccggtaccgaaaatctttcagaagaagaaaaaaacagagtgatgcatattgccctgcctgttggaaatgatcttttaatggcatctgatattgtacctggatttgggcagactcttactgtgggaaacaacaattacgtatctattttccccgattccaaaagtgaagccgacagaatttttaaagaactttctgaaggcggaaatgtggaaatgcccattgaagatcagttttggggagactatttcggatgcttccaggacaaatatggtgttcattggatggtgaactataatgaagaatacgcaaaatagtactatatttaactcattataaaagaggtgcccgctttatgggcagctctttgtttaaactttaaaaaatcagaactatggatccaattaaaatagacattacaattttagcaccggttgaaaaggtttggacttactttaatgaacccaaacatatcacgaaatggaatttcgcccacgaaagctggcactgtcctagttctgaaaataatcttgaggtgggaggtaaattcagaaacagaatggaggctaaagataaaagcttcggatttgattttgaaggtgtatatgatgaaattatacctcaccaggtgatcaaatatcatatggaagacggccggaatgtggaagttattttcgataaaatagatgacaatacaacgaaagtgattgaaattttcgatccggaaaaacaaaattctgtggaaatgcagagagatggctggtatgctatcttgaataatttccacaagtatgttgagaatcattaacaatattttttgtagccatgatcaatttagttatcatgtcaaagagtttaaattcaatgtatgcttttaattatgactccaaagaagaatttcttcacggggttatagcaataccggcaagaaaggctctggaaaaagaaaaaataaattctttggaaaaactgtcagattattccgaaaaagaaatcatgcagcttcatggtttcggaaaaaatacgatgcttaaactgaagaattatatgaaagagcatcaggtgtgttttaaagaggcataataagtattcaacctggcatttctaaggtgtcattgcagataagaaattactttcagatgcaaagacatcatatttctttgctgttatttatggtaaaatttttcacagcattttattcgttatgaaaaggaatgatccataagacaaaaataaaaatacatatgtcaacccatttaaatataaagttatgaacaacgatattttcccatgcctctggtatgacggagacgccaaacaatctgcagaattctactgtaatgtttttggaggagagatcacagcagatactcctgttgtaatgaacattgacctgttcggacaaagactgatgctgttgaatggtggtccgcaatttaaaaaaaatccttccatctcttttatggtaatctgtgagacggaagacgaggttcaaaaatactgggacaggttattggatggaggaatagccctcatggaactggggtcttactcatggagtccgaaatacggatgggttcaggataaatacggagtaacatggcagttattcctgggagaaaaagcaagcgaccagaaaataattcctactttgatgtttatccatgcaaacaatggaaaagctaaagaagcgatggagctttatacgaagacatttcccaactcaaacataggaaacatattaacgtatggagcaggaagtgaaggacatgacattccggaacctgcagaaaatgttcagcatgctcattttgtcattgataactacaacttattctgcatggataattcctatgatcatccgtttgatttcaatgaaggaatatcattggtggtgatgacagataaccagcagcaaaccgatcattactggaatacactgacggcggacggaggaagagaaagcatgtgcggatggctgaaagataaatatggcctgagctggcagattgtccctaaaaaacttattcagctgatgaacgattccgatcaggaaaaagcctacaaagtagttcaggccatgatgaaaatgcagaaaatcatcattcaggatctggaagatgcctataactcttaattatttcggcgtattgtttgatgtggtttagagaaaaagatttgcatatgaaaacacagaacaaatcagactctaagtcaaaggtccctgaagaagggctgtttccggaaattatccggaatgattatcagggaagccggaagctgcaagggaaaaaagcagtgatttccgggggagacagtggcataggacaggccgtagccgttcattttgccagagaaggagcagatgttgccattatctataaagaaagtgacgacgatgccagagaaactcagaaactggtggaaaaagaagggcagaagtgtatcctgatcaaaggagatcttaccaggaaaacattcagaacaaagtgtgcagacaaaattaaagcagagtggaagagccttgatattctggtcaacaatgccggaatacatacctcaaaaaccagtctggaaaagatttctgatgagcagattcaggaaacgtttgagaccaatatcatttccatgatttcattcaccagaaattttcttccattgataggaaaaggaggacgtatcatctgtacaacctctgtcacagcatatcggggaagtgatcatctgatagattacgcggcaacaaaaggagctgttttatcttttatccggtctctggcagataacctcgcagaaaaagaaattctggtgaacggaattgcacccggacctatctggaccccgctggtgaaagaagcttttgatgaccttgactcatttggaaaagatactccgctgaaacgtgcgggacagccttctgaagtagcaccagcttatgtttttcttgcttcaaaagatgcaagttatatcaccggggaaatcattcatattaacggcggtgattttgtcggaggataaatgagaagccgaaggccggaagttagaagttagaagttagaagttagaagtgattgatcagtaatttctctcaccctcaaactctcagactttcatactctcaaaccctccaacccattacccaccaattaacacttaaaaaatggaaaaattatcatacgaaatagaaatcaatgccgaacctgaaaaagtatggagtgtcctctggggtgatattacctacaggcaatggacatcggcttttacggacggctctttttatgaaggaacgttggaagaaaataatattgttaaatttcttgacccaaaaaacaacggaatgtacagcagggtagaaaaagtaattcctaacgaggaaataacatttctgcatctgggtgagatttacgatggtattgaagttcctcaggactggggtcaggctactgaagcttacttcctgaaggaaaacgaagaaggaactttgctgagggctgagattcagactcctgcagaatttaaagaattttttgaggagaaatttccaaaagccatgtcacttgtgaaacacctttcggaaaatcaactgtaggagccgcgaaataatacaaatcataaaaattaaaatatggaaactttatcatacgaaacagtaattgatgctcccatgcagaaagtctgggatattctctggagccctgaaacatatagcgaatggacccgttactttgcagaaggatccgtcatgaaatccgattggaaggtaggcggaaaaacctacttcgttaatgccagtggagaaggcatggtttctaccatagacagtcttgatgaaccgagacaggtagtattcaaacatctgggaatgatagataaggaaggacatgaagatatacatagcaaagaagtaatggagtggagcggcagctttgagaaatatttcctgatcgacttcgatgggaaaacaaaacttcatacagaggttcaggttgaaaaagaatggcaggatcatctcaatacaggatttacaaaagggctcatgattgtaaaaagccttgcagaaagagttagtcttgattcagtataatataattcaacgtttagagttcaaggtctcaagtttaaaactgatacctgagcctaatccctgtaacctgcaacctattatcaactatgaaactacttgtcatactttttggaacatgtattctggctttactggcaacttttctttttcaggggaaaccggattttatattttcgggaaacctgggaatggccgtttttatcatctttacaggcttttcacattttaaattccaaaaaggaatggcaatgatgatccctgattttattcccggaaaactgttttgggtctattttacaggggtattggaaattgcagcagggattggacttatgattccgtccatccgtgaaactacagctgttttactgatcattttttatgtattggtttttatcgccaacatcaattcatccaggagaaagatcaatatttttaaagcagattatacaggtcccgggatgaaatacctttattatcaaaggattcccatgcaggtcattttaattgcctggacgtggtatttcggaatttatttacactaaaaaagacattcaggaaaggctgtctttttttatattcataatgtttttttaattaagtgataaaaaattgtaacattttatagggataatgtgtcttattgtataaatgcacttgattttattattttaaaaaggtgctttcaataacttttaacccttaaaatataagttatgaatctactgaatcccaaaattttcggtacagcctatattgtactgtctactattatgatcaacgcacaaagttctactgccaaactgccgggagatcctactttgccatcttccaaagccaatcttgaaaagcttatttcttacgacaagggaaactttaaatacaaagttgaagattattttgcaagaccaaaagcttcagcatttaaaatctctcctgatggaaagtacctttcttataaagaaaaagatcaggataaaaaaaatcacgtctatgttaaagaccttggtaccgggaaaattaccaaagctattgttgaaaaagatgatctgataagaggttacggatggctgaacaaaaaacgtcttttctatacgcaggatagaggaggaaatgaaaatattcacctttacgctacagatatagatggaggcaatcagaaagatctgacaccgtttgacggtgtaaaagtacagtcgattattccgataaaggatacggatttcgttgtggttaccatgaataagaacaacaaacagatctttgaaccatttaaaatcaatttcgttaccggggaaatgacccaactgtatgaaaataaagatgtcaacagccctattgatgattacctttttgataaagacggaaatctgagaggatacagcgttcttgaaaacggattgacgacaaaaacctattataaagacctgcagaccggcaaattcaatctgatcaaatctgcagactggtctgataccttcagtattattgaatttaatgaaaattctaaaaataaagatgaagcgtatgtagtaaccaacctggatagcgataaagcgaggattgtactgtatgatcttaagaaaaatgttgtgattaaagaaatttattccaatccggtatatgatgtaagctcaataagtactgcaggtaaaaacaggaactatgagcttgattacatcagctatgaaggaaccaaaggagaaacggttccggtaagtaaattttataaggaaatacatgataaattaaaagctcagtttggagacaaagaatttggaattgtttcttctgatgataataatgataaacttctggttattgtaggaagtgataagctctatggaacttattatgaatatgataccaaaaccaggcaaaccaaacttctgtacaacctgatgccacagctgaaggaagaagatatggccgaaatgagacctatcgaatttaaaagcagagacggattgacaattcatggatatattacattacctaaagctgcgctggaaggtaaaaaagttcccttaattgtaaatcctcacggtggccctcagggaatcagagacagctggggattcaatccggaagcacagctgtttgcaagccgtggatatgcaacgcttcaggtgaacttcagaatttccggaggatacggaaaatcattccagaaagccgggtacaaacagatcggaagaaaagcaatggatgatgtggaagacggagtaaaatacgctattgaacagggatgggtagataaagataaagtagccatttacggaggaagccatggtggatatgcaacactgatgggattgattaaaaccccggatttatatgcttgtggagtagattatgtaggcgtatccaacatttttactttctttgattctttccctgaatactggaaaccttataaagaaatggtaaaacagatctggtatgaccttgataatcctgaagaagcaaaaatcgcgaaggaagtttccccggtttaccagattgataagatcaaaaagcctttatttgtagttcagggagctaatgatccaagggttaatatcaatgaatctgatcagattgtaaaagcgatgcgtgccaaaggatttgaagttccttatctggtaaaatatgatgaaggacacggatttggaaaagagccaaacaggattgaactttataagtcaatgttaggattctttgctgaaaattttaataagtaacctataattttataatgtttgaaacggaaggctcaggtcttccgtttcttttggttattatgactaggtgggtgtttagattcctacgcaatgacaagctgtatggataaactatcattacaattgtgtcattccgtaggaatctcaaatgacgtcagaaattgagaatggataaaaagatctttatcattcatcaattaccaattatcactcatcagcttagccccgatagaagcggttaccccggaacatgaataggagagtctgtgggcaggagtgtgggatggtctggcgtgaggagtatgagcggatagcgggaaaaagctcccttaaatataagtaatgagtaatgagtaatccggggataattgagaatataaaaaaccaacggataaaagaaaaactgaattgtaagaaaaatattttaaatttattaaagtaaaaccaaaaggctaaccgtcatatcagtatggaggttgtcgaaaaaataacaatgccacagaaggagaaagaaagcatcatctcacagaccgtttccaactacggagggaagctgatgtcctatattcgtcccaaagtgaaaaacacggaggatgcggaagatattctgcaggaagtgtggtatcagttcagtagccttacgaatctttctgagatcgtaaacgttggaggctggctgtacagggtgacggcaaataaaattaccgaccgttaccgtaaaaagaaaacagaaaatcttgaagatttcgtatatgaagacgaagacggcgagttctctatcaaagatatccttttgatggacgaaagcgcaggccctgaagtaaagatgtttcaggatgaaatctggaaaaaactgtttgaggcgcttgatgaacttcccgaaaaacaaaggctggtctacgtagaaaatgaactgaacgacaaaaccctccaggagatcgccgatgaacagggagaaaacatcaaaaccatcatcagcagaaaaaactatgctgtgaagcacttaagaaacagattgagaaaattatacgaagatttaaaaagttagaaaaagaaattatgaatcataaacacaaaaagggttggatttttttattgttatgcccgccattaattttagctgccgttacatggattgtaatgatgctttggaactgtcttcttcctgagattttaggagtgaaaacaattactttctggcaggcaatgggaatactgatcttaagcaaaattcttttcggaggttttcatttcggtaaaggaatgagagatttcaaggaaagaaaaatgagagaaaaaatggcaggtttgtctcctgaggaaagagagaaattcaaggaagtctggagaaacaaatgctccggaggattcttcaacagaaataacgaataatttaaaaatttgaaagaagtagtaaagtaaaattaaaattcattcgtctctataaaaaacaagaagtagtaaaatttaaaattttgaaaaaatgaaaaattcagcattaaaaggagctcttggagcactagccgttgtgggtgtagccttaattgctaaaaaagccgcacaaagaaaaagatttattaaaggtatttttgacgaatacggaatcaaagaaaaatcccctttcggactggcagataagatcagagaaatgaatgatgaggattatcaggaactgaaaggaaagttcaaaaaggaattcggttcaagatgctgcaaaaaggataatacctgcgaagcataatccataagaactaaattgaaattgtttaattccggcgcgggaagcaaagcttcccgcgccggaatttttttatttaaacagtttatataaacctttttaacactacatttgtattataaaagttcggttatcatgaagctcagggatatttatattgcattactgtctgttttctcaatcatcatctatggacagaattctcagcaaaaacattatattttctttctgcataataaatttctggaaggccattctttggaggagaagcatccaaaatacggggtggcagaatatgaagcaatacttcatcaactaaaggataacaatacggttgtgatttctgaaaaaagaaaagcagatacagatcctatagtgtatgcaggaaaggtgaaaaaacagattgacagtcttatgaaaaaaggaatccctgccggaaatattgcagtaataggaacttcccagggaggatatattgcacaatatgtttcttactatgagaagaatccgcaattaaaatttgtgattattggagccagttttaaagatgattctctggaaaaagataaaaatttcagattatatggaagaatactttccatcactgaaaaatctgatgacggccatattctgctgtcgcatgaacagaggttcatcaggtctcacattaaagattttaaggaaatagaacttaatacgggactgaatcatggtttccttttcaaagcacttaatgactggattgctccggctaaggattgggtttatcgtaaataattacggtcggtctatgacccttcggttcttatggttgaagttactacgaaatgatctgggtaatctgcgggaaatacctttaatatgaagttgagatttcttgctttgctcggaatgacaaattcgccgttgaaattgtatcggagataaaatccttgcgcttaaaaaaaatatacagattgttgtgaaaaactttgcggctttgcgtttttcaaccaatggattacgagctatattgagattgcttcaccttcggttcgcaatgactttctgattcatactttcaacaaaattttaccgtaaacatcaaacgcaaagaaaaataaatccttatttttgtattgctcaatgaaagattactattattttctcggtatatcacaggatgcttcagaagaagacgtcaaaaaagcttatcggaagttatctttaaaataccatccggataaaaatgataacgatgacttttttgctgaccgtttccgtgagattcaggaggcttatgagacattgagtgatccggcgagaagacgtacatatgaccagaatctggaaagccatcagcgaagtttcaggtataatattcctcctgcgatcaaaacgtttacagcgaataaaattcatgcgaaaaaaggagaggagattatcatcaactggcagacgaataatgccgatgtggtgaaggtattgcctttcgggttagaaaagccttatggagagaggatctttaagatcacagaatttaaagacggaaaattccagcttttgcttcatgcaacaaattctcttttgcacaaaacggttgttcagggaatcaccatcacggaagtttttgagaatgatgctgaaaagttcaaaaattcggtggaagaaatgtttaagccacaacctgcaaccagaattaacaaatccggccagcctaaaattatgatgctgatctggggaattattatccttgcgattgcaatctatatattgataaaaaacttcgactagcttaagccattttttttcttcccgggcattttttacatcttttacccttcttgaattttttgcaacatgatttcttttcacagaacatctcttcgttattgaaagagtaaggtgccaaaggcggaactttaaatgggactatcatattcatgatgcaaatatattaatttagaataaatataattaataaattttcataaaaaattgcaggcctgaaaattagacctgcaattggggctttatttaaatgaaaatgaagtcgaaaactgaagcctgaaagcatcacttctctttccttcaaaattttctgcacttgcgtaattgccttccatacccattctcaggtttctatagggatgataaataagattgattgctgcattctgaaaacgtttcataagactagtctcaattgcggagctggagccaacctgtgaataactgtaataaactgtcgagctccatttagaagaccaccaatgtccgtaaattcctaagatattgaacagacttagcatttctgctctatttttttgaggatcaaagacggcatcatagccttctccgcttaaaacaacattatttcttgccattccttttccgtatgaggcctgaaatctgaaatcatcaagatttgttatatgttttctgaatgaaatcatacctccaaatcctatcttggtatattcattttcctgattttcataattaacaggagagagcgtagcgccaattttagcataatctctggcatttccatagcgatacatgcccgttacaacaggaatcagacttttctttttccattccggatggttcttcggaatagtcatacttactttaccaggatcttccaatgaaaaggatagagcctctttatcagaaagtctttcagtataacgtagctgtatagatcgcagaagcatcgctccgttggctccgttaaaatcaaaaatattggggaaaatcctgatatctgtgaaattactccaggtttgcccaatcagccattttttccattgaagataaccatgccttaatcttggcgtagtagtcccgttaggtccgtaaaagtctatttctatataagcattaaccggagaatctccgtttttatctgtctgttttagccctagccctatctgtgattgtctcacactgaagtaacttgacattgaattttgttgtggaattataatagaaggagctacaattccgtctttagctccaaatttctgaaaatcaagcatagcgtctgcatgtataaatccttttaaataagcagaccatttcctgcctgaagaatctggttctgtattgacaagagttatttgtgcatgggctttagtctgaaataatattaaagtcatagtagtgaacgccggcataaaatgcctgctcaatctttttttcatcatttgtgttgttaataatggattatcttttatttactcacgtaaattgaatttatccgttaatatttaaagttacactgcttaggacagtttttgtgtttcattaatgtacttgatgcgaatgtacaaatgcttctggaaatggtgtaagtgaaaaatttaaggtttttaataggtttatagaagataaaagctaaaaaaaagaagcgaaaatgaaaggaatattctttaaaatttaatttttctaaaatagaattcattaaacggtgaaataataaattttattttttaacatttaaaaaagactttatgcctcaattttaagaatttttaagaaaatgaccgcctattttccatgttgtgaaatcgcttaaaaaatcgtaattttacgaatcttttttacaaacaaaatctaataaataaaaatgaatacagaacagtttgtgagccgtcacatttcccttaatgaagccgataaacaggcgatgttggaaaaacttggcgtttcaagtatcgaagagttaatttctcagacaatcccttcttcaatccgattagagaaagatcttgagatctcggaaccactttctgaataccaaatgttgaaccattcaaaagaattggcatctaaaaatacagattatacaagttatatcggatttggataccacaatacacttttgccttcagcaatccagagaaatatttttgaaaaccctagctggtatacggcttatactccgtatcaggcagaaattgcacagggaagactggaagctcttcttaatttccagactgtagtatgtgaccttacaggttttgcactggcaaacgcatctttattggatgaatctactgctgctgctgaagcgatgcacatgttcttcaataacaggtctaaagaccagaaaaaagcgggggctaacaagttctttgtttctgatcttgttcttcctcagactgtttctgtattaaaaacaaaaggtgaaggattagaaattgaaatcgtagttggagatcataaaacacatcagtttgatgattcttactatggtgttttattacaatatcctggtaaaaacggaatcgttttagattatactgaagatatcgtagaatataaaaaacttgaccttcaggtagcagtggcttgtgatcctcttgctttggttaagttaaagtctcctgccgaaatgggagctgactgtgcggtaggaactacacagagatttggtattccattaggatacggaggtcctcacgcagcgttctttgcttgtagagaagattataaaagagatatcccgggaagaatcattggtgtttctcaggacatgtatggaaaacgtgcattgagaatggcattacagacaagagagcagcacatcaaaagagagaaagcgacttcaaacatctgtacagctcaggttcttttggcggtaatggcagggatgtatgctgtttatcacggtccgaaaggattaaactatatcgctgatcagatccactttaaagcaaatgctttgaaaggaggtcttaaagcattaggatatcaggtagtagaagagccaatcttcgatacggtgaaaatcacgatgcctgaagaagagaaagccaaattagtaagactgatgctggatcacagacttaaccttaactatttcacagaaggtgttgtaagtattgcgatcaacgaaagtacaacattagagaaattaaactatctgatggcttctttcgctcagtttaaagacaagcagactttcaaattagaaatcaaagaaggatacagcattcctgaagaaaacttaagaaaagacgagattcttacggaagaagtattcaataaataccatacagaaacagaattgatgcgttatatcaagcgtcttgagagaaaagatttatcattaacacattcaatgatttctttaggatcttgtaccatgaaactgaacgcagccactcagatgttaccgctttcatgggaaaactggggagcagttcacccattcgtacctgtaaaccaggctgaaggataccaggaaatgatccgtgagttagagaaagacttggcagaaattacaggttttgcaggaacttctcttcagccaaactccggagctcagggagaatatgcaggattaatggtgatcagacaatatcatatctcaagaggtgatcaccacagaaatgtagtgttgattcctcagtctgcacacggaacaaacccggcttctgctgctatggcaggaatgaaaatcgtagttgtgaaaaaccttgaaaacggggaaatcgacttcgaagatcttaaagctaaaacggaacttcattcagcaaacttatcagctgtaatgattacttacccttcaacttacggtttctttgatgccaacattaaagaaattaccaaccttatccacgagcacggaggacaggtatatatggatggtgcgaacatgaatgctcaggtaggatttacaagtcctggaaacatcggagcggacgtttgccaccttaaccttcacaaaacttttgcaattcctcacggaggtggaggtcctggagtaggtcctatctgtgttgctaaacacttagtacctttccttccttccaacgcgaatatcagaatcggttccaaagaagcaatcgacggtatttctgcagcaccttacggttcaggattgatccttaacatttcttatgcttacatcaaaatgctaggaactgaaggtcttaaaaaggctacaggacatgctattcttaacgctaactatctgaaagaagtgttagcagaacatttcccgattttatattcaaacgaaaacggaagagtagctcacgaatgtatcgtagatttccgtcagttcaagtctttaggaattgaagtggcagatgtggcgaagagattaatggattatggtttccatgctcctaccgtttctttcccggttgctggtacattaatgattgagcctacagaatctgaaagcaaggctgaaatcgatcgttttgcagaagcattgatctctatcaaaaaagaaattgatgaaattgctaatggagaagcagatgcaacaaacaacgtattgaaaaatgctcctcacacagaacaactggttatttctgattcatgggataaaccatacagcagagaaaaggcagcttatccgttagagtgggtaagagaccacaaattcttcgcttctgtatcaagagtagatgaagcttacggagacagaaacctggtatgtacttgtgagccgattgaagcttatatgtaatctcagtttttaactataaaaaatccctttcagtaatgagagggatttttgtttttatagtcattgcgagcgcagcgaagcaatctctttaacgcaaaggtcacaatgatttttcgacaactaattgtttcaatgttcgcaaaggcgttccactcagcaaagcttaaacgatgtgtttttttggcaaattgcgagacttgtacggtcattgtcattgcgagcgcagcgaagcaatctcaatgatttttacttgcttttaatcagtccttcaagcctggtcatcatatcatccttttctttcagcattctttcataaagcgcaattttttcttcgtgaagctggatgattttatcaataggattgtaattattgacaattacacctgtcgcgttatcatggaagttgcttgcaataatattgatagcctgttcttcatcaaaattttgaaatgcttccacaggaatttttaaaacctcagaaatcttttgaagaagcggatcctcaatagtttctttctgttccaataaggaaattttcttctgattccagtcatcacctaaatccagcgccaaagcttcctgtttgatgcccagcatttctctgaatctttttacatttcttccctgatgtatcttttgttccatttgtggttttaagcttatttgaaggtttatgatgagtaaagataaaaaattgtgatgatattaatatgtggagctggagatttgtaccaaattctttttaattaaaacaaaatcacctccagattttctggaggtgcttagtatttaaattccggttttttatcttcgtttaaagctatacgccagcaagatagcaaagcccatagtaacgcaggttataattgaaatggtttcaattgaaattccacttttcatctgtgtgttttctttttcacatgaaaaaaagaataataatgtcataaacagacataccgatagtaattttttattcataaatgtatttgtttggttacgaaatatttacagcaaaaactataccggatttgtagactaaggaataggtttattgacttgtcctttcagttaatacctgcattaatgagtaacaaaggttttcttattaataacccttcggcaggctcagggtgacaacccgaataccaaccgaaatttttaagcgttgtcaggctgagcctgtcgaagccagtatttactaaagagataggtttttactgcttaattttcgtttaaatttttggaaacgttatctattaccaaaatataatgacaataatgaataataataccggcaatgaaaagtagagaagctattattatctcagtagtcaggtgatgtaggataaaatgcaggatcagaaaaagtgcagcggaatagatcagggaaaatagtatagaatacaatgcttttgttttgtaggtaagaattcttgtattttcgttgtagtaaaagtattctttgccagttgagaaaactaatggagatttgtttgcaaaatcaagtttaaacattttgttttcacctatgatggtgccgtcagcaggaacaatataagttaagcccctttctgtaattgaatggcatactacatcagtgacatttttaaacgttttgctatcttttatttctctctcaaaagtataagtaaatgggaacatagagttttaagcttagttatttgtttttccttcatcccaataatagctgtccgggtagattcttgctccgaaaacggcagttcccactcgtacaatagtggcgccttcttcaatagctgtttccagatctccgctcattcccatagaaagctctttcatctctacgttgggaatattttcacggatgatgtcctgctgaagatttttcaggattttaaagcatgcccttactttatcggtctcagcactgaataagccgatcgtcatcaatccctttatctttaaagtagagtagttggaaatctttcgggtaagttcaatagcttgatcaggattaactccaaatttactttcttcattggatgtatttacctgaattaaaacatccatcgttgtgttttcagctaaaagtctttgatgaagtttttctgccagttcaagacgatccatagactgaacgcaggtgacatcgtatttcaggatatctttaatcttattggtctgaagatggcctatgaagtgactttcatgaggaatgtcctttagatcttcatatttctccttcagttcctgcactttattttctgcaattaaagtgtatccgttttcaagagcaattttaatacggtcaggcggaacagttttggtagcaagtaataattttacatcatcagtattccttccggattgttcgcatgccttttttattctttcattgatagcggcgaggttgtggagaatatcttctttcatgatgggatggtttctctggcttccagttttttgatcaaagcggatttgacagccgtcaaagcatagtctttcgcttcagcaaaagaaatagaatactttctttcaacgcttctcatatcttcaggaaactgggctaataaatgatcgtagtacgtatcaagaatttcggcggaaggcatttcgtaattgatttttaactgaaagcgtcttaaaagggcagtgtcaataatctcgggatgattggtggcacagatgagaagtgcattttcagggtaataatctatcaactgaatgagggtattaacgagtcttctcatttcgcctacatctttatcatcacttcctcttgctttcccgatctgatccagttcgtcaagaaaaagtacagatctttcccttgcagccttgtcaaaaaccattttaatattctgtgacgtttctccaatgcgggacgaaacgatattgctcaggtttaaaataatgatattttttcccagagcgttggcaacggcctttgccgtcatggtttttccgcatccggaacttccttcaagtaaaatcttatggttaaccggaaggccgtattcctgcaattctttagcgtaagtatgctctttgataagctgtacaagctgttctctgttgccggcattgaggaatacttcgttaagatttacctgttctttatcctgaataataaggttgtacagattcatgatgatttaatgattattgaatacacaaagataaagctttacagcatgcaaaaagaaatcctgaatcataataaacatctggtccagcgcatagaatgatgaatgatgaatgggatcagtggtttacaggatgcaacataaaaaaaataaagccagacttacgaccggctttattcatttggatattaaaatttgttatgaaactaagatctttctgcttatgtttttggacccttttacccgatgggtaaaagagtgatctgatctctcagactaaaaacataaaacaatataattagtatagatattctataggcttgctttatttactattagtttctttctcttcttactgtcatgaaatatgaagtaattactactaaacctgttgcgataccgatataagttatcattttgtattatttttaattatttgacttttttttattaatttttcaattgcaatattactactttcaaatcatgtgccaaagtaaaatattatgatgtttatcagtgtattacggtggtttgtctttgtattatggtgatgttttgtttacattaaattaatgtgttattgaaaatttattaatacttttattattctttctgtaaaattttatgaaaacgttaatcgtttcctgacttctatattggacttgataaaacaaataataaataatgccttgcataatatcgtttttagatgccgtttttggcagtagattttctcatgtgaaatagattttgtgttaagaaaacttattattggcgataattttttgtgccggaatttttgtcagcttgacatttcctgatatatagagatattaatgatatgacacaactggctaataatgaggcgtaatggcacattttttccagatcagtcaaatatcacggaaaaaaggaagtaactatgaataaggcacataaataattttatgtgcctttagaaagtattattgtttactgatatttttaaaaatcaagacaggaaagggaattgtcgttagagtaactatattaattgttctcattttggaattccccggaggctttcactatttttgtacaaagaatgaatttatgggacgcagttatatttttcttgccctggcaattatatttgagatcattgctacctctttcctgaaaaaatctgaggaattttccagactatgcccatctgttgtaacggtgataggatatgcctgtgctttttattttctcagcctcacccttcgtcagattcctgtcggaattacctatgccatctggtccggagtgggaattgtctttataactataatcggtgttattgcattcaaacaggttccggatctgccagccataattggtattgccctgatcgtactcggagtgattattattaatgtattttcaaaaatggggactcattaaaaaataatttcctggtgcttttgcatctgtttccaatgtttagatcttgttttgtataagaaaaactttcccagtttatatttgaactttaaatatccgcgaaactcaataccgtcaaataatgtaaagggagtatccggattttcttctaaagcctgcctgatgccattgctgaatacagtaggtcctgtggtagaatgtatatcatgtggataacggtgagtattgatattatccatcatcaactccagtgttttctttagaaaaggatgattcttattgaaaataagtgcccattgaacatacagattttcatgtctttctacactgattactgcttcatcgttatccttaatcaattttctgaatggcttaataatactgctgtccacatccagatatacacctcctttcttatatagtacggcatatctgaaaaaatcagcttttgcagcaccaatcctcagcttgcgataagtttcaatataatgaggagggaattcttcttcaaggaaattttctatatcctgatcatcataaaagtaatagtcatattcaggattttttcgtttcatattccagatatgataacgcgtaatgagaggaagttttttagttataaaagtctgaaatatctgtttgggtacagccatattctatttttagtaagttcttatattaaaatcctgaaatcattttcataaaccatttgcatgagaggtaataagtttttcatgaaatagaatttcccgaatttgtgttttatgaagtttgattatattttgcgggaatggttaaatactgaaaagagaaaattttaatttttttttaatctctctgatattgagacttcaataataagttcagatattgtaaaatgtggtttcaccttttaaaggctgaatgacagactggaaaaaattgaaggtaaaaattctgtcatagaagatgtccagacagttttcaataatgacatcagtatagccggttttgtcccgatggcatgtttcttctacaaaaacaaaccagagttctgagagtccgtatcttcttctgaacgcttctgaatcactgcagtcaggtactgcggagtgtttaagatcacaaaacagaattccttttttatgaccatcatgttctacaatattaatagggtggtacaggtagctgagaattttcattttcgggtcgaagcattctacaaaatggtacaaatcaatcagctgtattactttttcttcttgttgagattctgtcataaaaaagcattctgaggatatttcctgagtcagttcatgaaaagcttttaattccatatgtgttcattttattagtgcaaaggaatagataaaagtagtatgcaaagatgtttttatacaaaacggcaggtattttataccaaaaccggaagtgtactaagaagtgtactcattggtataataaaatacaggttttgtataataaagtagttataatttccgttattctctatttttgttaatgataaaagagcctatcctatgaaatacagtccgtggaaatttgaagaaacatttgtgatggactttctggtggaagcgaaatatggattccgcagacatctgctgtttctcatcttctttttctttctgatttacagcacaaggttctggcactggtattccgggatatatcagtactacgttttattctttgtgtataccatcctgattgccatggtctatattaatatatatgtattggttcccaggttcttctttaaaaccaaatatattacctatctggttttactggttctgatgggcgtggcgggacttaatttcatcgggtatggtttcagacatctctttcaggatttcagaacgcaagatattccgaaagataatgaaagaggaggcatttatgaaggtattctgatgtgcattccgattattcttaccaccactaccataaaacttctccagaaatggatcagtgataataaaagaattaatgagctgagcaatcttaccttgaatatggaactcaatgagctcagaaatcagattaatccccattttctgtttaatatgctgaataatgtaaaagctcttatccggacagacccggccaaagcttcagtagtaattgtaaaactttccgagtttctaagatatcagctctatgaaaacagtgaagaaaagacattactgacctcagaaatagattttctgtccaactttttaaaccttgagaaaataaggcgtgatcatttttcttttgatattcagtctgatattgacaaaagaactgtcaacagtatctttattccgccgaacctgtttaccacttttgtagaaaatgctgttaaacacagtgtagacatcagtggaggagagtcttttgtgaatgtcaaattaaatattgagaataggcagcttcattttacctgtgtgaactcaagaagtcccggttatattgttcccgataaaaaaaacagtggtcttggacttgccaacattacaagaaggctggaacttctttatggtgatacttttgatctgcagatagagtcaggagataaagaatatattgtaaatttaaaaattcccgtgtaatgaattgtattatagttgatgatgaacctttggcaagatcagaaatgagatcactgatctccgaaatttccggtatagatattcttggtgaattttccagtgcgccgtctgctcttgagtttcttaaagataacgaggtagatcttatttttctggatatagaaatgcctatggtaaccggtcttgaatttgctgaaatgcttcccaaaaagtcactgatcatctttacaacggcctattcccaatatgccttaaaaagttatgagctggaagccgtagattatcttttgaagcccattgatccccaaagactggaaaaagcaattgataaggccattctttacacagaattgttgtccaaagatacagtaaagaataccgtagaatctaatactgcagactttttgtttatcaaagccgaacgccgattttacaaaattaatttttcagatattaaatttatagaaggacttaaagattatgttgttatccatacccggcaccagaagctcatcacggctatgaatctgaaaaccattcatcagaaaatttcaggtgaaacctttatcagggttagtaaatcgtatgttgtcaatatgaattatattgattcatttgataatcataatatctacattgaagactctgaaatccctctcggagaagtatacaggtcagaattctttacaagatttgccggaggccttctcaactcagactgatgatggatgagtaatgagcaataagtaatgaggaatttaataagcagggttatgatacgaaaagaatatgcatattcatctgtgtaaatccgtgtaatctggggctaaaaaattactcaacagaaacgggctttagcccgttaaatcaataaaaacattcgatggcttcagccaaaacttaaaaatagtttattcaataaagtttctgatctttttcacaaaagaagctccttctttttccaacacctgtctgttttttgatcagcttccggccgcaaaccgggcatacagatttggtatgtaccagccagtgttttttcaaaacaaaatcccttttccatttcaggaaatcaaaactataatttctggcttcagcaataagctcttttctttttttagccgggagattgcccaacagactttcaggctgtactccaatcctgaaaaggacttcatttttgatgatgttgcctacacctgaaaaaatatcctgattcattaaggcgtcgcacaccatcattttcggattcgattttagtttttcttccgcttttttcggattccactgatcgctcatcacgtcagcttcccaatcaatagtggagagaaagtcaagatctacagattttaccgaacaggtgtaaaaataaatgcttccggttgggaaaaacaaagccaggcgcaggcttttatcaggtttggtctgctcatcaataccgtaagagccaaacattaataaatggatacggatggccgctttctcaaaaacgaggtaagtctgttttccaaaagtacggatttcgcgaagggtctgcccgataaaagggtctttttcaaatttggcattccctgaaacttctatcacttgctggcctgcaaatggctgcaggttttctttcattaatatgatggatggaccttcaggcatacgtttgttttgagataaagattcaaatagtattccattatctgaatcttcatccaaaaaacaaacctatgtaaacattacaggatcagttatgtttttgccctacaaaacggataacagagcctgttccgttgtgaaacaaaccttctttgagttcgatttctgtttcttttaattctataatatcataatccgggaaatccgctttgatctcatcaatagaaaataaggattcaacatctttgggtccgcctactttctcattcctggcaatatattcaagatggtttttactgaaagcttctaaaataataaatccgcctttacggagatattgattcagcatctgatggatggaagacttaactgctgcaggaaaatgagcgtaaataagtgcaatgacgtcaaactgctctttttggtaattcagatcagaaagttctccaacctgataatcaatggtggttcccagctgatgagcaagctgcagtgctttatttctgccgttagcactgatgtcaaaagccgaaacctgccatccctgtgtcgctgcaaaaacagcattccgtccttcgccttctgcgggaaaaagtatagtgccgggctttaattgactaagttgctccctcaggtaattattcggttcggttccatacgcaaactcttcgctgctgtacctttcatcccatctgttgagccatgtgttgtccttcattgtaaaagaatttaaaatttgcatgaagaagaataaaaagtattcttcagttatattagccgtaccaaatgtagaatatttcttcaagcttccggcctctaaaaaacgtttgttataatagattttttgaatgagagatctgttcaataaaaatctaaatactattccgtacaattaaaatttgaagtaattttgaaaaatgatgaatttaaaccacattttcaccaatcaacgtacaggaaacaatccgcagaccaaagcttcaagaactgattttcaaagggatttcgatagaattatcttctcttcagccttcaggagactgcagaataagactcaggtttttcctcttcccggcagtgtttttgtacacaacagacttacacattctctggaagtatcgtctgtaggacgaagtttaggaagtattgtcggtgaatttattgctgaagattttaaaaatgaactgactgaggattcaaagaatttttatctccataatttaggaaatgtaatagctgctgcatgtttatgccatgatgtgggaaatcctgctttcggacattccggggaagatgccattgcaagttattttgaaagaaatgaaaaagatctgaaatccaagttcaatgaaaaagagtgggcagatctggtaaattttgaaggtaatgccaatgcgatcagagtgttggcacagcagcagcaagggaaagatgcaggaggtattcagcttactttctcaacgctggcaagcattgcaaaatatccgtgtgaggctgtagccaagaaaaaaggaatcattcacaggaagaaattcggatttttccagaatgaaaaggatatattcctggaaatcgccaaaggaacacagcttattgctgaaagtgaagaaccacatgttttcaaaagacatcctttcgtatggctggtagaagcagcggatgatatctgctacaatatcattgacatggaagatgcccacagactgggaattgtatcaacagcagactgtaaaaacttatttttcgagctggtaaaatctgaaactgatgacattcagagaattgagacaaaattaagctctatctccaatgaaaatgaacagatttcgtatttaagagcaaaagtgatcaatgctttaatcaataaatcaattgagatgtataagcataactttgaaaccattcttgaaggaaatcttggtaacggtttactggacatctataaaaaagaaaataaggcacttcaggacattgagagtttttcggtagaaaaaatttataatcataaagcggttgttgaaattgaaaatgcaggatataatgtgatgtatgaattgctggatcactttattccttccattctgaagtctgatgaaaaaagaaaatcttatgacgaaaaagctttgaaattaattccaaagcagtttatttacgataacggaaccgactaccagaaagttctaggagttattgatttcgtttcgggcatgacggataattatgctaccgatttgtatagaaaaattaaaggaatagacatcggaatgaccgtttaaattctatttattctaataattcagaagcctcttcgattaatgatttcattaaggtggaggcttttttatgctttaaaaccggagcaatctggccggaccagaagaataccagatcatttttctcttgttctaaagcagcttttctcaaggttcccatgaattgagcctgcaaaggaaacggcaatgttttatcagttgcagtcaaaacatcctgtgtaatttttgtcgtaattccgcgccctaatcttcccgtgtacgccctggtaagagtggtggattttgcagcttcggaaaacaacagttctttgtgaaagggtagtgccccggattcttcagttgcaagaaaagctgttccaatctgcacagcttctgctcccagctggaaagcacctgcaatgccctggccgtccgctattcccccggcagcaactacaggaatctttacacgatcccggattaattgaattaaagcaaaagttcccgttgtagaaagttcagacctgtccagaaatgaaggtctgtggccgccgctttcaaatcctgaggcgacgataatatctactccggttttttccaaagcaacagcttcatccagcgtggtcgcatttcccaacacaacagttccttgatgatgaagatcttcgatgatgttttcattcagcaacccaaacataaagctgaaaactttaggtttgatgtcaaagatcacttccagctgattttgaaatctggattcaaaagagggtggaggtgccggaatatctatatccaaaaggtcaaaataaggtttgaaagtttcaacagccttctgatattgctcttttgtatgttttccgtcaatgatatcatgatcgcttacccacagattaagattgtatggtttatcagttttcgactgtattttatggtgaatgtcatagatttcatggggtgacaaagtgtaggctccgaaacctcctagtccgccaagattactcactgtagttgttaactcaacagtagaaaaatctccgccaaaagggccttgaaagatagggtattcaatcccggttaattctgtaattctatttttgttccacatattttttcggtttactacattaaaggttgaattaaggttgtacatgggtcagtgtcttgttaataataagccatttcccttctatatgattgaaagttatgaaattataataattgaagtcatacatttttacatgcaatttcgcgacagcaattgaattgatgatatcaactgaaataatttcagctataaattcctttcccgatttttccggacttacgcggtttccgactccttcaatatactgttctgcagttttgaaataaggaattccattgatatccccgaaaagcagcgcatctttatagaaagcttttttcaaaagttctgtatcgcctttataaattcctttgaaataataatgctctatcacatttcttatttcggtttctgatgcctgaatggttttcatattcttaagattttgtgcatgaccgctcaacggaaagctgagcagccatgctataattaaagatagtttcatgataaatgatgtccggcacccatccctccgtcaacattgatgatggccccggagattaatttatttttagcaatagcaaaaatcatctgagccacttcttcaggctccccgatacggttgatgaggtgtattcctgcattgttatcaaggtctgcaccatgcattggagtcctgatcaatcccggcgcaactgtattcacccttatattgtcttttccaaactctgccgcaagctgcaatgtcagtgcatgaatagctcccttactcgaaataggtgccgtagaaggagattgggcaatggcgtggtacactaatggtgttcctatattgatcaccacaccatctttttgcctgatcatttgaggaatgacggcctgcgtggtaaagaaggttccttttaaattggtgcttaaaaaacggtccagatagtcttcagtaacttccagaaatggtttgttttcgtaaattccggcgttgttgatgagcacatcagcagacccgaatctttctaaagctgttttcaacagcgcttctcctgttgtcttatccgaaacatttccggcaactattgcgagattttctgcggctcccagttcatgatacactttctctaatttgactgccgtttgtgaattaatgaccacgttatctccttgatttaaaaaataccgggcagtttccaatcctattcctgaagaggctcctgttacgattacggtttgttttttcattgctgatttattttttgactgttgaaaatccctgttcttttaatacagaaacctgttctcctgcatacccccagttatcgtcttcaatctcattgataacaatatgtgtcaaatgaggatctttattcaaaactgaggttacagcttcactgatttttctgattaactgttgttttgtttcgcggttaaggtcttcgcgaagaacatctactttgatgaatggcatgatgataaattttagagttattgaattaataagcttccgcaataagatgaatgtttaaatcaaagttgttgtagatcaacgtatcacccaggttggtaaagaagttagaggacctgaatctgatattgaattttgttctgtctactacaagtctggtttttagaacagctgcattatctgttgttacaatatgaaggctggtgtcgataggttgggtaatgcctttgatggtaagatgtccttgtacgtaataaaaattctcatcaccaggttctgcatgagtaatttcaaatgaagcttcaggaaactgttcaacattgaagaaatcatcagaagccaggtggttggcaaactgtctattggtttcattatcctcaatgtcaaggattttgatggagcgggtatcaatgatgaactttccggactgaagtttttggctttcaaatatgaagttgccttcttttatgcggattgtaccgttatgagctcctgtaacttttcttccgatccagtggatagtactgttttcggtattgactttaaaaatttttgtatccatttttattgggtttaaatatggatacaaagttcagctcaccaaaagaaatatttacgtgatgtacctcacaaaatgaagatgagaataaacagtttaaaaagctgcagattattgatgaagcctgctcaaagtttctctcgtcactcccagatatgaagcaatgaggtgtttcggaaccaggttgtaaagttggggatacatagataaaagctcctggtatctgaatttggcatcattattcataaaagaaagaaggcgtttctgtgcggctacataccctttattggtccgccatctgaaaaaatgttcaacctgatgaatttctttacagattttttccctgtcctcatttgaaatggacaaaattgctgcatttgtaatgcagtctacattaatggtcgcccttgttttactgtaaagagcatcaaaatccgttacccaccacgtcggcatggcaaactgaagaataaacattttcatattgtcattaagataaaatgctttcaaacagccttccagaacaaaatattcatgattcacgaaatcgccttccgaaataagactttgccctttctttaaagtaatcagaccaaaatgtccgaaaacatagtcaagttgttcatcagtaagagaagtgaatttagagatgtgatcttttaatatttctttagaattgaccatgatgtataatgaataatcaaaagtaagttttttcaggatcattttaatttaaatgttttgaataattctacatgatgatttccgctgaacgatgctttaaggcttaaattaatttttcctatatttaaacagcacaggtaaaaattgtttttaacaaaacaggatttataacgacatattaaaaaattaaaaactatgggtatatacttagcgcccgttattttcttcgggcttatcattttgttcgcttcgttttttgtggtcaagcaggaaacagcagcgattattgaacgcttcgggaaatttcaggctgtaaaacattccggtcttcatcttaaactgccaattatagatcagatcgctaaaaggctgaatctgagaatccagcagctggatgtaatgattgataccaaaacactggataatgtttttattaaaatgaaaatttccgttcagtatcaggtgatcagaaaccaggtgggagatgcttattaccgtttggaaaatcctgaaaaccagattacctcattcgtgttcgatgtagtgcgtgcggaagttcctaaactgaaactggatgatgtttttgtaaggaaagatgatattgcagtcgcggtaaagagcgagcttcaggaagccatgaacagttatggttatgatattatcaaggctttggtaacagatattgatccggatgagcaggtaaaacatgcgatgaacagaattaatgctgcggaaagagaaaaaaccgctgcagaatatgaatctgaagctcaaagaatccgtattgtagccgttgcaaaagcagaggcagaatctaaaaagcttcaggggcaggggattgccgaccaaagacgggaaattgcaaaagggcttgaagaatctgtcagaatgctgaataatgtagatatcaattctcatgaagcatcagcgcttattgtggtcacacaacattatgatactttacattccgtaggggcaagcaacagaagcaatctggtacttcttccgaactcgcccactgcagcaagtggaatgctgaatgatcttgtggtggctatgacaactgccaacacagtgggagaagctacaaaaggaaaatatcctgaacctcctcaaaaagaatcaggtttttaaaattaaaagaaaaaagaagcgtaaatgaacctgaaaaaatgaacttatggaaaattttccgtgattgtcggaaataacatcaggcttcattcttccagcttcccgcaataaaaaacgcttctgaacttcagaagcgttttttattattatttcttcgttttagaaacctgttctaccagtgtgtatctgatagaagaagcatcagccggcggattttcaattttttctgttttcacttttaaaacatattcataacctggttcataagtgaatccttcaatattactgtagaagttcgtccagttttcagaacctttctcttttacctgcagacatttcatacggcctgctcctgcagaacaatctactgtttgggcccctatgataagtgttttttcattggctgccaccgctgtttttttcgttttagaaacctgttttaccaatgtatattttatagatgatccatcagctgggggattagcaattttttctgtttttacttttaaaacatattcatagcccggttcataagtaaatccttcaatattgctgtagaaattcgtccagtttccggaagcgttttcttttacctgcagacatttcataggagctacgcctgtacagtctgctgtctgcggtcctacaatgaatgttttttcatcacctgcggatgcattggttgtggttgtacattgcgtcattgcgaataatgctaatgcgggtgctgccccttttagaattgttgctatacttttcataaacttgatttttccccttacgtcgcaattaccatgccgaaaaaaaatactgaatttgtagtacttctgctattgttttttacttttttaatcatttaatttgaatttcttaaacactaaccaaaatataattcttataatgaatatggataatcaaatgcaagttgaaaattacaggattcaaaaacctgaaatgtgggcaggaaatatcggagatgaggaaatcataagtcggatcaaagattcagaatttgccagaaaacaaattgatgagggcagggattactgctattttctggataaaaaatactatacaagcaatacggaaaacagtgaatatgtctgcatggcctatacgctgaatgaacccggaaatctggaaagagcttctgtttctgatgttattgtggaagaaaacgaagtataccagatccacagaatcagcgttctgagagacggtgtgctgattgataagattccggatacgaaaatcaaagttcttgacagtgaaaaccagagcagcggaggtgttctgagcagtaataaaaagatcaatattaccattaaagatctgagattgtatgatatactcattttagaggattcaaggattaaagaatttactgatcgcgattttctgagaaaggaattctctaaatacgtttgggtaagtcctgataattactgggcttacggaagttttaaatttaccttcatcaatgaacgtgaacagacgattgcttacaaaaaaacttttttcagagacgaacaaggcaatgtccttgagccgcaggtaaaccatctgaaaaaaggagagcgcttcgttatcgaagaacagaattatatcaatcctgtagattcaggacgtgagatttttccttatgtggattttgctacagaaagcaactggaaagatctgtctaattatattgtccctttctatgaggaaattttcaataaagcttccttaaaagattttgctccgaatcttgttgaaaaactggatgccattgccgatcaggacgaaaaacttcagtttgccatagagtatgttcagaatcatatttattatatcttcaatgcggatgagatgaacgggcataagccacaggaaccttcaataacttatgaaaacaagcaaggagattgtaaggcaaaatcggttttattgaaagtgattcttgattatattggcgttgaagcttcagttgtattggtaaatttcaacacagattattatatcaagtattatcttccatcattattaagctttaatcacgtggtggtaaaagtaaattacaaagggcaggaatattttattgatgccactatccgtgatgaattcggattgatagaaaaccgcggattcatatattttatgcattatctggaagtgaaaaaagatcaggaactgcaggtaagaaaaccttataaatttccttatttctgtattgatgaaaaagtagatttcagtgcgcagggcaataccggaaaacttactttgtcaaccacttacaaaggaaacagagccaatgccatgagaaggtattttaagagtacgaataaaagggaaattattgacagctggaacagtttccttttctatgcgcttaactattcaggagacaggaatggtacagatgtacgggatgtgtttaaagacgcagctattgatgtggtaagtgatgataagaagctgaatgaagtcagaattcaatattctgctgttattgagaatccttattttgtagatcctcaaaagaatcgtttcctgatgtattttgacagaaatgtagtgaaggcaagtgcgagggatttcatgcataaagatttaccattctggcataatttcgacagcgagaaatacgagatcaacctgcatacggatcataaaattgatactgaagaaaaatatacgattcaggaaagcaccattattaatccgtattttgattataaaagtcgtaaaaaagtacataagaacggagcaagcgtgtatatagaatatagtcctctgatcaatattgaaattcctcagaatgagtttgaacagttcagaacagaccatcataccattgccgacagtaattacggtttgggaattgatattatcgaaccaggtctgatgaacagtcttaaattcagttttaagaaaaaatttaaataagatcctttaagtttaaaggtaaggattcaatgttgaaggtttagatttccgcgggcggcgaagccgcccgcggaaatcttttatattattttattctaattattaaaaaaaacacatatttatgtttaagatattttgtcttgcctcttttattgcagtctcatctctgattaatgcacaaaaaataaccaaagaaaatgttacaggattctggaaactgaaggaagctggattttatgaagggaaagagaaagtgataaaacaattcgataactgccgtctgatgagaaattatgccatcagggaagatggttttgctgtttataattatacagaaggaagtgtggaaaactgcagcccgtccgagcccagactttctttctggagaatcgtagaaaacaggatccagttttatgtagatgaccagaatatccttgaagaagtagtggtaacaatgaataaagataacacgatgacgttttcaagttatatccctgaacgaaaaaaagtagatggcgacgcttttgctgaaaaaatagcaaacaccgttcactacgatatccttgaaaaacaataaagtttcagacgtcccaaaactctgcctaagcatagtcattgcgaaccgaaggtgaagcaatctcaacattattcataagcagaaagttggaaaatgcaaagtcgctaagattttataagccatatgtatgtaagacgcaaggattttatcttcgataaaatttcaacagtacttttgtcattccgagcaaagcaaggaatctcaattattcagataagggtttaaattttaaacccttatggattctgtggtttattattaggcattatgaatttctgcttcccaatcaaaagttcaaaaaacagtctgaaatctgagattaaagaccacaaaggatatttaaacgtagcaggcttatttctctcaatcacagcatgactgaaccaggcaaatccgtagcctacaataggaatgtaccataaaaatctttcttttcctgaactgataacatatcctataacgaaaaatacaagaaacgtcccgataaaatgaaaaatccgggttcccgttttactgtgttcagtaagataaaactgataaaattctctgtatgttctgattctttcagccatggcggttagtttatgggttcttatgaagctaaagcaataattctgccgatttttatcagaggtaaaataaaaaaggcaaaatcgcagatcagtttctccatccggtttaacctttctgccattttgccttttcgcaattttgccaattatgatttagctattctttaattcttttcccagtttactgtttttgtatccgtagcagaaataaataaccattccgatcaggaaccacatcccgaaccagaaccagttctcgtggctcattcctgtaagaagatacagacatgagcttaatccaaccaatggaatcaatgataaatttttgataaacgctacaacacacagaataagattgatgatgataaagaagaatatagaagctctgaattctccttcattgggatctgaccagttcatcaggttgtcaaaaaattccggctgccattgatagaaagcaattaatccaccaataaaaacaacagggaaaatgattttaccattcacataaggaaggtgaaatctgccttttattttttctttggcaggaagaagaagtactccggcacatactaacacaaaggcaaaaatagtcccgatactcgtaaagtcaaggataaaagttttgtctgtaaacaggataggaatccccactacaattccggtaacgatggttgcgtaggatggtgttttatacttagggtgtatcttttgaaatcttgcaggcatcagtccgtcacggctcatggcataccagattctaggttgtcccatctgaaatactaataatactgtagtaatggctacaatagcaacgaaagaaaccacaagttccatccatgctacattggcatttgttttttcgaagatgaatgaaagcggatctcccacaccatcgaatttcttatagtctaccattcccgttaataccagtgttaaagcgatataaattaccgtacacagtacaagagagatgatcattccttttggtaaagttttctgtggatctttggtctcttcagaaagtacacttaatgcatcaaatccgatatacgcaaagaatactccggatacggcactcattactccggcaaaaccatttggcataaaggaaggtgttccggttgcaggacttacaggagtccagttttcagtgttgatgtaagcaaaaccaaccagaataactaataaaataacaccgagttttaagatcaccaatgagttgttgaaatttttactttcttttactcctacataacaaagccatgtaatcaatccgttgataaccaatgccggaatatctacaatgaacttcagactaccgattaacggcgctgttttccatgcatttaataattctttattttctgaaccatattgaaaggctttccttgcttcggtatagctgcaggtcagataatcaggaatgtgcattccaagacgtcccaggaagctggtgaaatagtctgaccaggaaaaggctacgtaaatatttccaaaagaatattccatgatcagagcccagccaattacccaggctataagctctccaaaactggcataagcataggtataagcagaacctgcagtaggaattctgctggcaaattcagcatagcataacgcggtaaacccacaggcaaaaccgcaaatcaaatatagaaggataacaccgggaccccctctgaaaacggcttctcccaaactgctgaaactcccagctccaataatggccgcaataccaaaaaatacaatgtcccacacacctaagacccttaaaagccccgtcgaagtatctgtatccgaatagatttttcttctaaaaagttgactcattcaataactatatttgatttgaaaaaaagcaaatgtaatgattttttattttgatgttaacagtcgttaacaacatttaagcaaaaatgctcaaacaaaaagctttagtctttataaacagggatttctacatagctgtcattgtaccattttatctccagcggctccccggcatcctttattgtttcatcactcacatccttgccagatccgtaattaatctgccagttaggattattattaacgccgaccaataaaagaaatttgcttcctttctctatctttctgctcataacatacgaattattaatcggaatctgttcaatgttattgggttcaagaagctgtcgtttttcattgttctttgcatagcttgctctcacgatatgagttgatagcaagtaggattttccatccggagaaatctggtacagataagtatcagtgtcaaaatcttttttattgaccgaaacattgaaaactcctgacagatttccgctcatgacgatatctttgtcaagtacttcactttcaaaagcaacagaattcgttgttttgatactgtcttttttactgactttataataggtgtctttctgattcctgttttttaaatcaacggtttgcttggtgaagctccggctttccggcttgctgaatactgaagaagtgttttttgtgtcctgaaggtaaaatttcaaggaagaattatgcattttgtcaagatcggcaacatgtttccacgtattcgtattcatgacctgaaaattgattttatcttttaaaatttccggttttttaccgcccttaagaatataatcaaaccatgagaaagcaagatcatcaatactaattctggccaccggatcaataggattaccattcacatatgtaaacccgaaactttgtgctcctccatgattgtaaggacctattacaagataatgatttgcatttttattgtattgatgatgttgtttaaaataatacaatgcaccaatctgatcatcgtcataatatcctgtagtcgtcaggatcggaatattgattttagaaaaatcttctttgtaaggaaccattttctgccagtactcatcatatcccggatgatccagccatcgctggaaaattttacttggcttcccgcttattttatctaaagatctgaatgatttcccgtttttgtaccattttgtaaaaatagaatcccactttacagcattggtaaaatcagcttcatcggtaaatttattattggttacatactgaatccactgcagcatatagctcatgaagacattattctgagcaggataatctatcccgatgcctactgccacctgtggaacgattgttttcaaagcaggatgcactttttttactgctgcccactggctgaatcctaaatagcttcctccgatcattcctactttcccgttgcaccacggctgtttgcttacccaatctatcacttcatagatgtcttgcgattcatgttcaaaaggattgttggcatcattgctgtttctcttgccacgagtgtttactacaacgcctacataatcataagtggcagctctctttccaaagaaaccatcaatgggacctgcatagatattattggttaaaatagcaggaagaggagacgtattctccttttttcggacaatagtaatggttaaggtatttccgttgatcttaaggtcttttgtttcagtaatgaatttttcattatcttttgaagcaagcagctgcataacctgaggtttgatgctggagtaggttttataattcagataatttttgcataaagctaaagcagttctgtaatcgatgctgtccttatctttctgtttatccagtacttttttcaactgttttctggattctcttacatctccgttaagagcgagctcaagtctgggaatcagtttttcaggaagactctgatatttttgattaaatactttctggagcgcattcgtaaaagaggcgttgttttctttttgctccatctttgcaaggctgtacagctcaaatccaatatatctgtatccacccatattgttatcggcaaaaagatcacggttttcagaaagagaagccaatgagtttttgtaatcctgggcaaccatctgcagacggaaaagattatccataagatcaacggtattttccggtttatacttcgccgactgaaggtgaggaatcacttgctgtgcaagttcaggaatctgtttttccaatataagagagtcagttacagctgtttttggaaaataaaatttttgtgcctgtacaaggttgacaaaaattaatgctaaaagtatcttaaatttcatggaatggtgtatttatggtatgtttttagctgctgttgaaaaagtatcaaattaaaataagtttttgataactgtttattaaaattgtttacattttatcagacgaaagtagtaaattttatcattgaacagtgagaaaatttacattgttataaaattgttatttataaccattaaatctgttaaaacttgcttaaacaataagtttttaatattttcgttaacttatttagactaattttcttatatcaagaagaatgaaatcaaaaaaaatacttttagcggctgcggtcatttatttcggaatctccgatgctcaacagtcccaatattttacccagaaagaaaattacaggtttaatctagccgaaaatctttatcagaccaaaatatacaacgcctctcaatacgaatatgcaagacaatatttctacaaccagaatttgtcccgttctaagaaagaaggcgcccagttttttgataatgtgatcggtgtgattcttcagaaaaatcatgctgaagagggattaactgctttcatgaaagaatatcctaattctgcttattttgcacaggctaatcttccgcttgcagattattacttagcaaaaaaagactttgacaaagcactggaaacacttaaaaaagtaaaccagtatcagctttccaaagaagagaataccgaatatattctaaagcttgggtatgcaaagtttatgacgggtgattctaaaggagctactgatgctcttgaagaagcgtataaaaccgcagatcagtctcagaagggagatattgcttatatgcttgggcacttatattacagcaacaggcaaaatgataaagctttccagtattttgattccattaaagaccaggataagttctcaaagcttgtacgtccttattatgtacagatgtattataatgataagaactacgatcaggctattacagaaggaaacgccctgttgaacgaaaatatttcagattcttataaagcggaagttcataagattatcggggagagttacttcatgaaaaatgattatacctctgcctatccgcatttgaaagactacctgaatgttcagcagaatccatctgaaaacgatttgtatgagatgggatttgtggcagcacagctgaaaaaatatgatgaagcggtttcttattataaccagcttctgaacagcaattctgctttagcgcaaaatgcttactatcagttaggaaatgcttatctggcagtagataaaaagcaggaagccctttctgctttccgttcttcttaccagatggattatgatgcgaaagtgaaaaaactggctcatgagcagtacgctaaattaagttatgacatcggtaacccgtttgaaagtccttcagcagttattcaaagttatatcaacgaaaatcagaatggtgccaatgccacagaaatgcggtcattactggtgaaatcttatctgtattccggaaactataaagaaaccctgaacgcgattgacagattgcagagttcaactcctgagatcaacaaggtagatcaggaagtttcttatttattgggaactgaagaattcaataaaggaaattatgatgaagctgagaagtatttcttaagaagtcttggtttcaacatcaataaagaatttaacagcagagctttatactggctggcacaggtgtattaccagaaaggaaattatccgtctgccattgttcgttatgaaaaacttttaaacgaaaacttccctgaaaagcagcagcttccttatgatttaggatatgcctatttcaaatccaaaaaatttgatcaggctgccacttatttcaagcagtatcttgccaatcctaaacctgaatttaaaaatgatgcagaacttcgtcttgcagatatccattatgccaacaatgacctgaacgaagcgattgccatttatgataaaaatgaagatgccacggattatactttatatcagaaagcaatggctttaggattcaaaggggatacgcaggcgaagattaacaaccttaaaaaccttttatcaaaataccctgattctgaatattacgatgatgctcagtacgaaataggaacggcatacgctgctcaggatgattttgcgaattccaatgattatttcggaaaagtaattaaaggttcttccgacaaagatctgatcgcgaatgcttctatctacagagcacagaattatattgaccagaatcagaatgacaaagctctttctgaattgaaatctttgggtgaacagtataaaaatacagcatatgctcaaaaggtggttcaggctgccaaacctatcttcacgaaaaacggagatgtttcaggctatgaaactttcgcaagaaatattggggtaaatgtagacgctgctgaaattgatgagatcaatttatcaacaggaaaacagctgtttgcaaagaaagattataagaacgccatttcttattacgaaaagtatctgacacagaacccgacaggggaaggtttatatcaagcgaagtatgaattgggagaaagttattaccagaccaataattcaactaaagctttacttgtgcttcaggaagtggctggaattcagaatgattaccaggatgacgcacaaactcgtttagctcagatcttccttgcacaagggaataaagcggaagccaaaaagtaccttgaaggtattaaaaattcttccaatatcagcattaaaaactatgcgaacgttgaattgatgaagctgtatgcagaagaaaataacttctctgaagctgaaaaactagccaatgcagtaatcgccaattctaaaaactccgcagctgttattgaaactgcgaaagtgatcaaagcaagaagcctgatgaattcaggaaaagataaagatgctcagacagcctatacttctcttgaaaaatcatccaatacttcggtagctgcggaagctttatatgctaaagcctattatcagaataaaggaaaggctttcaagtcttctaatgaaacgatctttaagcttgcgaacaactatgcttcggaagaattctggggggcaaaagccttggtattgatggcgaaaaactatatcggtctgaaggataactatcaggcaagttatacgtgtgatcagatcattgcaaactataaggatttccctgaaattgttgcagaagcaaaagaagttaaaaaacagattaagaaataggaaatgaagggttttaaaattgctgcttgttctttcttagtttcggcttcactctggagctgtatcccatcgtacagtgcctatccgaaagagtataaccatgcaaaagctgatttcaaaaagcaaaaagcttttgtagtgaataaagagcttaagagagaatttgagattttaaaacattctgatatttatgaaatcgtagatgacagtactcaaacagcaaaaattaccctgcatccgatgaagacctatactcctccttgtggaaacccaatgattgggagtatgattacagtcgggttactgccttcgggatttccgtatgatattgtttacagttatgatgtagctgagaacagtgaaacaaaaaattatcaatacaaattacaagtttatcaaagcctttggctgtttaatatattcagactggggagaactttttcaaaacagtcggggaaagctttattaggcagttatatagcttccaataaataaaagcccgttatatatttttttcaaataaagaaaatatgaacaagaaaattcaaatattatccatattatttttaggggtttcgtcggtggcgttttcccagatcaaggaggaaaaactggttcttaacaaaaaaagagaaccggaagtgaagaagatcgagaagaagaaaacttctgtagaaacgattaaaaattatccgccggaagagaaatcacagaatcccgtgaagtatactatcacagatgttcctgctgtttcagatttcaaaacttcaacgattcagggagaggatgtagctccgaaatttgacggaaccgctcagaataactatttccagttcggaatgggtaattatgggaaagttctggtagatgggaatgtttccaaaacccttgaaaataagcttgaagtaggagcagatgttcatgttctctctacgaatggtcttaaaaaagattacgactggaaatccgggcagacatcagccaatatcggtgcgttcttaaactcttacggcgaaaagggtaaattcaaccttaatgctgaatatggtttggacagctataattattatggaatttatgctatgcagcctaccggtgaacttgacctgaaacaaaaagtcaatcagtttaaagtaaacgggtattatgatttttattctaatgaaatactgaatgatataagggtaaaatcatctttcctgaaagatcattttgatgcacaggaaaaccaggtttcaattcttgccaatttctccaaacatgctgttgaattaggaaaatcaggaatcaatctgaatgctgatcttggagtgggattggatgctgtgaagacagattttgccatcagggataaaaactcagctaactttttcaataccagcctggctcctaaagtgaccttcagaaaaggagactcttatttgatattaggatcttcattctctttcctgaatgctaagaattccaatgaccagctggaacagcaaaaaaataataagacttactggttcccacaggcagaattccagtttgctgctgctaatgaatttaaattctacggaggggtagacggtggtctgaaactgaatacttatggagatatgctgcagacgaatccattcatcctttctgaccagtttttaaagcctacagagacgaaatatcatttttatgtaggtttgagaggagatattgatgaaacggtgaaatacgacttctctgcaggttacggaaaaatgagagacattatgttctttaaggccaatgatctttttgataacacttctgttaaccgttctgcttacaactttgccaatacattctctgcaatatatgatgacggaaatgtaagtgatatcaaaggaagcgtacagtatttcccgttagccaatcttattttagacggagaattaaggtttacgaagtacaatcttaagaattatgacaatatttataacgttcctttgtttaatgcaagtatcggggcaaaatatacgatgcttgacaaaaagttattgttaggatttaaaggaatctttgcaagtgacagaacgacaaactcttatgcaattgaagcagtaggtgcaccgaatgtaatttatcagtctacggagaatacaaatgataaagttggcgggtatgctgatttaaatctttctgcagagtataaaattcacaaaaatttcagtattttcgcactcggaaataatcttcttagctcaaaataccagacgtacaaaggctataaagtcctgggtgcgcagattctgggaggtgtgaaaattactttctaaagtataaatgacaggtaatcaggtattactcattacttatcatacattactgatgaatatggctgcatagtttaatggatagaacttcggatttcggctccgacagtgagggttcgaatccttctgcggtcacttaggacggacaaatcatttttattaatggtttgtccgttttttatttgagtactgtcaagattgaaaacagggctgaatttagctttgatacagaaatgcgttttattgaaatcaaatattctagctttatcagtacaaattcttgttattatgccgggagaaaattctagatatatatcactgttattcatatgtaaatagatatatcctgtaggtagtatttttacaagacaaccttcaccagaaattttatcttttctgcatattattctgattttggttttgaaattaacctacgggaaaatctaaatgaaaatcaagatgtcccttattaactctgtaatgatttcagatgcattcctatcatttaaagtaatatagcttctgaaagagactgtctccactgtggatttcgtgttgaagtactttttgttctctgaattctttggtataaactgactaaaacaatttcttatttaaaatggttcttaatgaaaaattttataattttgatagtgtgaaaaagctgatttccatattgttgttaacattgtatttggtttctacaactgaactgtatcagcttttgaaaatgccgcttcttattgagcattatattcagcataaaagcctgaatcctgaaatgtcgtttactgcatttctgaaaacccattacgatcatcctgtgaaggacagtgaccatgatcaggaccagagattgccttttgtttcacatgcaagcctgctgtctgtggttttcactattaacccttccttagattttcattgtatagaaaaagtttgcaatcctattgaaataaaaaagaccttttacaaaagcgcgctttataataaggaaattcttaattctatctggcagccgccaagatttcttcaatcttaatctgttttactcagtcattttttgaccgggaaggtattctgtatctgtatataatgcggatgcattcaatctatgcgtcagaataccggaattttattacgataattaagattaatcaatcattatatgcttacaaaaatcattgagttttctgtaaagaataaactcattattgcattgttggtattgggacttattggtgtaggtgcctatcaggttaccagactgccgatagatgcggtaccggatattaccaacaatcaggtacaggttattaccacggcgccatcttttggtgcaacagatatagaacggctagttacttttcctatagagcaggccaataacaatatttcaggattaaaggagatcagaagtttctccaggtttggactctctttagtgaccattgtctttgaggataatgttgatatttactgggcaaggcagcaggttgccgaaagacttcagcagatacaggccgttattccgcagggaattggaaatccacagcttggacctatttccacagggctcggcgaaatttttcagtatgtggtaagacccgaaaagggatacgaaaaaaagtacaatatcacagaactccgtactattcaggactggattgtaagaagacagcttttgggtgtaaaaggagtggcgggagtaagcagctttggagggaaactgaaacaatatgaaattgctgtaaatccggacaggcttaatgcctatggaataacaatcaatgacgtatttgatgcattgcaggccaacaatcagaatactgggggagcttatatcgaaaaaggacctactgttctttatatcagaagtgaaggattagtaggaagtattgaggaaatcaacaatatttctattgcgacaaagacaaatgatgttccactctttattcgggatattgctgaagtgaaaaccggctttgccacccgttatggagccatgacttttaatgatcagggagaagtttcaggagctgtagtaatgatgctcaaaggcgagaacagtaatcaggtcataaaaaatgtaaaggaaaaaattgcccaggttcagaaaacccttccgaaaggagtggtgatagagccttttctggacagaaccaagatggtgaacaatgccatcggaacagtagaaaaaaaccttacggaaggagcactgatcgtagtcttcgtactggttttatttcttggaaatatcagagcaggattgctggttgcctctgttattcctttggcgatgctttttgcaatatgtatgatgaacctctttggagttagtggaaatctgatgagccttggagctctggatttcggactgattatcgatggagcagtgattattgtggaatctgttttacaccagttcagtcacaattcaaaatttaaaaagatattctctgtcggaaaatcagaaatggatactgtggttatagaatctgcaggaaaaatgatgaacagcgccgttttcggacagattatcattctgattgtctatctgccgattcttaccctgcaggaaattgaagggaaaatgtttaaaccgatggcccagactgtagcttttgcacttcttggcgcatttttgctttcactgacctatattccgatgatgagtgcggtactgctgagaaaaagaagcgacaaaccaacattatcagacagaatgatgaaaaaggtagagaaaatctatctgacagttttgctcaaacttctcagaatacccagaatagtttttggtgtagtagcagtcttatttgtaaccgctgttttcattttatccagaatgggaggcgaatttattccttcccttgaagaaggagactttgcagtagatacaagggttttaccaggaagtagtctgacaacaactattgaaagtacccagaaagcagcacatattctcaaatccagatttccggaggtggaaaaggtcgttacaaaaataggaagcggggaagtccctacagacccgatgccgatggatgcttctgatatgatggttattttaaaggataaaaaagaatggacctcagcgtctacttttccggaattagcggataagatgggtaaacagctgcaggaggtaccaggaattactgccagctttcaatatcctgttcagatgcgttttaatgaactgatgaccggagcaagacaggatgtggtaattaaaatttttggagaagaccttgatgtgctttcccaaaatgcacagaagcttggaaaaattatagaaacagtagaaggaacccagaatctttacatcgaacctgtttcgggaatgccgcaggtaatcattgaatataaccgtcctctgattgcccagtaccatttgtctgtttctgacatcaaccgtgtcgttaatactgcatttgcgggacaaagtacaggattggtttttgaaggagaaaaacgcttcgatatggtggtacgtctggataacaaagaccggaaaaatgttaccgatattaagaatcttctggttcctacgccttttgggaatcagattccgctttctcagcttgccaaagtggaagtgaaaaatggtcccaatcagattcagagagaaaatgctcagcgaagaattgttgtgggttttaacataaaagacagagatgttcagagtattgtggaagaacttcagcagaaggtagatcagaagatgaaacttccaacaggatattatatgacgtatggaggttcttttgaaaatcttaataatgccaaacagcgtctcatgattgcagttcctattgcattggctcttattttcgtcatgctttttctggccttcaattctgtgaaagaaagcttactgatctatactgcgattcccctttcgattattggcggtgtatttctcatggcactcaggggaatgcccttcagcatcagtgcgggcgtaggatttattgcgctcttcggagtggcagttctcaatggaatcgtgttgatctcagagttcaaccgtcttcacaagagaggaattaaaaatatcgtaagaatcattatagatggtggagaatccaggcttcgaccggtgctgatgacagcatttgttgcttcattaggatttattccgatggcggtcagcaacggagctggagccgaagtacagcggcctctggcaacagtggtcatcggaggattgatggtcgcaacttttcttaccctgtttgtcttaccattattatatgtaactattgaaaaaggattcaaaaatgaaaaaaataaaaaataaaaaacaggcttccattctgacctttttggtatgcgtcggttttgcgggactgttaaactcccagactcccgttacattgcaggatgctgttgatattgctttgaaaaataacagaaatattaaaaatgaaaaactaaaatcagaatatacgaaagcccttatcagatcatcatctgacattcctcagactggagtaacggtagattacggacagatcaacagtgctctgacagatatgaaattcggaatttcacagaatatagcatttccgactgtatataaaaagcagaagaacgtgtacaccgaagaatggaaaaagtctctgctgaacgtttctcttaaagaatatgaactgaagaaggctgttagccttaccttttacaatatcctgtacgcgaaacaaaaagaaaagctacttcaggaaacattaaagctgtacactgattttctcgataaggccaatatccgtctgaaagcaggagaaagtaatattctggaaaaaactacggcttccaaccaaaagtctgctattgaaattcagctgaagcaattacaccaggagctttcagtgctgagatatcagcttcagtggcttttaaatacagaaacagatttcattccggaagatcagaaaatttatcagggaagccttaatgaggaactcagcttacatccggctattaaggtattgcagcagcagaaaaacatttctgaacagcagattgcccttgaaaaggcaaaaatgcttcccggacttcagctggcctacaacctcaacagcttcaaagggatgggcgcagatgataaagtgtacaacggtacaccacagtttcattctgtacagcttggagtttcagttcctgttttttccggagggcagaaagccagaattcaggccgcaaaaattgctgaatctgttgtggaaagtgatattgccaatatggaattcaacctgcagaatcaatacagaaaggcatctggaatttatcaggctaaccttgacattgtttcacaatatgaaaactcagaattgaaaaatgccgatatcatcactgaaacagctaaaaaacagtttcttgaaggagaaatcaactatctggaatttgtcatcctaatcaatcaggctgtcactttaaaaagcagctataccgatgcagtctggaagctgaatcagagtgctatagagctggaataccttactttaaatccataacaatgaaacgtacatttaaaattatatcatattccctgtcaatattaggattactcatgttttatgagtgtaaagaccatggaaaaacagagccggcgccggcaacagtatcttcaaaagatgaaaatgtagtaatgcttaccgatgcgcaactgaaaaatgcacctatagtaacaacggtactctccctgcagaaaatttcctccgttttaaagctgaacggaatgatagatgtaccgccccaaaatctggtttctgtcagtattcctttaggcggatacctgaaatcaagcagcctgcttccgggaaagccggtttcaaaagggcaggtgattgcagtgatagaaaatccgcagtttattcagcttcagcaggattatttaatggcaaagtctaaaaatcattttgcccaattggattataaccgccagaaaacgctcaaccaaagtcaggccaccagcgataaggtaatgcagcaggcccagtctgaaatgaacagccagaaaatcctgatgaactccctggctcagcagctacgtcttatcaatatcaatcctgaatctctgaattccgggagtattcagaaaagcgtaccggtttacagcagcatcaatggctttgttagcaaggtgaacgtgaatattggtaaatatgtgaatccttctgatgtcctttttgaactcattaatccggatgatatacatcttaacctgaaagtatatgaaaaagatctggcaaatctgaagaaagggcagaggtttgccgcctataccaataccgaacctgataaaaaatactatggtgaaatcctgctgatcagcaaagatgtgaccccgggcggatgggctgaagtacattgccattttgaaaaatatgaccagagccttgtacccggaatgtatatgaatgccgaaattgagactagtacctctttttccaatgctgttcctgaagagagtattgtcaattttgaaggaaaagactttgtcttcgtagaagaaaaaaaacaaacctaccgacttactcctgttacattaggcgaaacagaaaacggatttgttcagattataaatgctgacgattttaaaaataaaaaaatagtcatcaaaaatgcatatacacttcttatgaaacttaagaacactgcagatgaataaaaattatagtaaaataaaagaacttataaataaatacaaattatgaaaacatcttctttaataaaaacaggagcaggttttgtagtcctgttactgattgcaattcagttttttgatactgataaaaatatagcggtggttccttcggagaatgctattgaaaaacattaccaggttccggatcatgtgcagggaatattaaaaacaagctgttatgactgtcactccaacactactgcctatccgtggtacaataacatacagcctgtgaaatggtggctggcagatcatgtgaactcgggaaagcggcatttcaattttgatgaattttacagttattcaaaagagaaaaaattaaagaaacttgatgaagtggcagaaaccgtaagagagggtgaaatgcctcttacatcttataccgttgttcaccagaatgcaaagctgaatgatactcaaaagtcagaaatagaacaatgggtaaaagaggttaaaaagcagattgaatagaaaaacagaaaacattactctgatataataaaaacaatcagtaaatttaatatccatatccatttcatatgaattacaatataccggaagacttaaaaggacttacagacgctgaagtagccgattcaagaaaaaagtacggatataaccgcctcgaagcagttaagaaagaatcatgggccgatcttctgctcaacatcctgaaagagccgatgctgattcttcttatatgtgtttccttcatttatgtacttacaggggattatggagaggctttattcatgtttgcggctattgttggagttaccgcaatttctttttaccaggataaccggagcaaaaaggcgctggaagaacttgaaaagctcaatgaaccattgagtaaggtgatcagaaattcaaagattatcaatattcccacttttgaaatagctgttggagatttatgcattaccgaagaaggaaatctcatcaatgcagacggaagaattgttcacagcaacgatttttctgtcaacgaatcttcccttacaggagagagcttttctgtttttaaggacagcaaatccgaagacaataaagtttatagcggaacaattacggtttccgggcttgcggtttttgaggtcgaaaatattggaaaagaaactaaagtaggcaaaataggacagtctatactcaacataaaaacagaaatatctcctttacagctccagatccggaactttgtaaagggaatggctgttatcggagttattatctttcttgcagtatgtactttcagctttattaaaacgggagattttgtgaccagtttattgagcggacttacattggcaatgtctgttcttcccgaagaaattcccgtagccttcacaacgtttatggctttgggtgcctggaagctgatgcgggaaggaatcattattaaacgaagcagtattgtagaaacgctgggaagcgtttctgtgatctgtacagataaaacaggtacaattacggaaaactcaatgcagttgaagcatctttatgattaccgttctgacagaacttatgaagaaacagagtttggaacaaaggaactgaatgagcttattgattatgcaatgtggagtagtgagcctgtgccttttgatcccatggaaattacattgcataagatctatgagcagaaccgaaagcctgatcagaggaaagactatcaaatgtttcatgaatacccgctggaaggtaaaccgccgatgatgacccatctttttgaaaacgaacagaaagaccggattattgcggccaaaggagcccccgaagctattatcagtgtttccaatctttcagaagaggaaaaaagtaaaataagaacgttaataaagagtttcggagaaaaaggatacagagttcttggtgttgccagatctcattttgaaggaaatgattttcccgataagcagcaggattttaaatttgactttttaggcttaacagtattttatgatcctcctaaaaaaggaataaaagaagtatttaagcatatctacgatgccggtatccaggtaaaagtcattactggagataatgcggatactaccagagctattgcattgcaggcaggaataaacaacagtaatccacccgttaatggaagtgaaattgcagcatgctcagaagcagatcttatcaagatttctgaagagactactttatttacaaggatgtttccggaagctaagctggaagtggtttcggccttgaaagcacaaggtcacgttgtagcaatgctgggggacggtgtgaatgacggcccggcattaaaagcagctcatattggagtggcaatgggaaataaagggacggaaattgccaaatcagcagctgcactggtcatcaccaatgatgatctggataaactcgtgattggagttgctgcaggaaggagaatttatgccaatataaaaaaagcggtccagtatattatttccattcatattcccattattcttaccgtttctttgcctttgtttctgggttgggtattcccacatatatttaccccggtacatgtgatttttcttgaactggtaatggggcccacatgttctattgtttacgagaatgaacctatggagagaaacgctatgcaaagacctccaagagcacttacagatacttttctgaactggagagagcttaccataagcattattcaggggctcgtcattacagcaggaatattatggttgtatcagtactctgttaaccacggaaatgatgaagctaaaaccagagcattggtgttcactacgcttatattttccaatatactgctgagtctggtgaaccgttctttctattacagcatgctggagagttttaagaaccgaaacgttctgcttgcaggcatttcagtattggttgtacttctcttgctgattattctctatgtatcgcctgtttcgggatttttcagcgtgacagctctcagcataaaagaacttggactggcactgctcactgcttcagtttctgtgctgtggtttgaaatttataaattcataaaaaggctttattttaggaagtaataaatataaaaaatagtaaaaagcataacttcattagaaataattgaacattgcattcctccttacttttggaaaacacctttcaatgattatattaaaaataagcaggggttatttattgataatattaatcatattaagtttttgtattaaaaaaataccacaaataggtaattttgaattaattatttgtatatccataagaaagacatatttttgcacaacacaagatggaattatatttaattccatcttgttaccaaaaactaattgaaaactaattacaccatgaaaaaaactatcctggattttattttattattccatccacattgattgtttccaacaattaaaaacatcatcaaaccctgaaaatttctttggaaatatatgctgtatctatcggtatggcttactgtttatttctgaagcaaaactttcatggagttaagaaaccacgtaaacaaagcggaaccgaaaagctaaacgagtaggaagaatattataaaacttaaacatgaagagaattattttactaaaaagcatgaaaaaactttattttttattattaatttgtatttcattttctgtattggcacaaacgtatacttacacaacgtacaatacctcaaattcggcaataggaagtaattatattgctgacattaaaacagatcccaatggattattgtggctggccacttacaacggtgtttcctcttttaacggaaccgcttttaccaactataatactacgaattccgggattgcatctaatgcaattctaaaaattgaaattgatggccagaacagaaaatggattgcttctcaattcaatgggatcatcctgtacaacggtacagcctggaccaattacaccaccgctaattcggggcttcccagcaatgagattatagatatagcgcttgacgggcaaaataatctttgggttgtaacaccggcaggccttacaaaattcaatggaactacctggacgacttataattcagtatcaaatttaaattcggtagcaactgacagtaataatggggtttgggttacaaacggtggtgtgttatacaaatttaatggtactgattttaattttgtagctcagggaactgaaaagatactgagaattgccaataatacaatttatgtaaaaggctttgatagtttaattactttaacaacaagtggaaccaatgttacttttatttatcaaaataactcctgtctggcaggatataatccaaatgcattagatgttgacactaacagcaaagtatggatagggtttaatggtgcaggcttacaaaattttaccaattgtactacctataccaaaacaaatacaaattcaggcttacctgatgattattttagtgctgtcagaacacaagcttcaggaactatctggctgggaacattgcagcttggtctggtaaaaatgacaccagctgcaaccatttgcaatccacctacccagttgtatacttctaatatcacatctaattctgctactcttaactggctgccttcaacatcggcccctaacggagggtattattatgtgtacagcaccagcccgactatgacagggtcagctactgccagctcttctacaactgcgaatattgccaatttacttcctaacacgacttattattggtggatcactgcaaattgcgttaccagtcagagtacgtgggttccgggaggagcttttactacacttcctgcccagacgggatgctggaaaacagtaagtgcaggatatctacattcattgggaataaaagcggacggaacactttgggcctggggtaataatagcaataatcaattgggagacggaaccaatattaacagaaataacccggtccagataggaacagaaaccaattggaaaaaagtttttgcaggtgagaaatatagtattgctatcaaaacagacggaagcctttgggcatggggaaataaccaattcgggtatttaggagatggaacaactaccaacagaataactcctacaaaaataggaacagctacagactgggaagatattgcagttggaggcaatcataatttaggtctgaaatcaaatggaacgctttgggcctggggaatgaatatatacggaggtctgggagacgggactactactgataaacttgtacctgttcaaatagggacagccaattggaaaagtattgctgccggtagtttttattcagtggcagtaaagacagacggtacattatgggcctgggggtacaatgggcatggacaattgggcgatggtactttaactaaccgtattgtgcctaaacagattggtaccggtaccgattgggcagatgtggttacagggaactcacatactgtagcaagaaaaacaaacgggcttatttatacgtggggcttcaacgaatccggtcagctggctgatggaactaccgctaatagatctacaccttacttagccgctgatggaattcaaaaagttattgcaggaagcttcaataccatggccattacaatgtccggcaccgtgattgcctgtggaaataataccaccggatcttttggaaataatacttctgtaagctcttcaaactgggtgagcctgggtgccaatacgcctataatcctttctacaggaggatggcataccttatctgtaaataatgacggtatcttaaaagtatccggagctaataactatggccagataggcgatggtacgaacgttcaaaaacttgcatttacccagctcacatgtcctgtaagtaatttagcagttgaagaaatttcgatagcatccgaaaatctgaaagttttcccgaatcctgttcttgatcatctcaacgtttcatccgataaaaatatcctgtctgtagcggtttacaatgcagccggccaacaggttctttttgatgatatcaatagtaataaaggaacagttgatttttctgctttaacgtcaggagtgtatatggtaaaagtaaatactggccataatactgtaaaaacggtaaaagtaatcaaacgttaaaagtataatgtaaagtagtaatttaataaactttagttttgttttcacacaactaaaaactaaaataccctgctataatagcagggtatttgttttgactcaaacctcacttttttacacgttgtgatctgccttctacattatgggcgctgtcagatactgctgcattgatattgcctgtggcattccctgtattattattgctggtttttcttcctccaatgtggttttttgtattaatactgtcctgacttgttgggccgcttttcagagtatctgaagctgctgaaaccgctgtatcagaataattgctgtgggtattggcggaatcattaacatagttactgttttccgtattgttttttttgcaggccagcatagtaaaacttatggctgccattgataagattaaatttttcataggatattttgtaatgagttattggctcttgaggtgaatcaaatttcgatatttagccgatgcaatcatatgagtatggtcataataagagtatagctatccggaaattcaaaaatttataatatccggtctttgatcaaactcattttgatatatcttttactttgaagcgcaacgaaaatatagattgaaaattcattcgtttaatccgctgtttacgaagacttcaaatatctggtatttctgcttttcaaattcttcatttcgtaattctttatggttagcgtatgaaaaatggtgaataaagatctgtttttgatggcaatttattaatgaaaagtgtgttttttacattttttttttaagcaaaatgaaaaaaaaaattattcttcttatcataatatttattctgaaaattcaaattttttttgaagctgattatgattgcaattaattgtgaattcatatcttatgaaaatactaagtgtaaaattaatgataaccttatcataatttttatacaattgatatcataaaaaatcgatatgtaatgcattgataagcagtagataatgacggatttattttttttattcagatgaatttttatatttgtaatgttaccaaaatgttaacaaactaatgaatcagaactttattcatacctatgtctctgtagattgtgttgtatttggatttgaccatgaaaaccggttgaatatcttattagtacaacgccatgttgatgatatcccattggaaaaacaacgaaaactgccgggaagcctcatctttagcgatgaagatgtagatgacgctgcacaaagggtacttcatgagcttacgggaataaagaaaatggttcttaaacagttccgatgctttgctgatcctatgagagcaagcaacgtacatgatataaaatggatggataaggaatataagcatcatatagacaggatcatcacagtggcttatctttccctttgcaaaatagaccataagatcaacagtacgaagtatgataccgtagactggtatcctattgatgaggtgccggtattgccgttcgatcataacaaaattatcaatgaatcccttattgagatcagaaaatggattgaatctgatttctccattattttcgagctgctgccgaaaagatttaccataagacagctttatcagctatacagtgctttaagcgaaaaaaatatcgatataaagaattttcataagaaaatatcttcgttcccctatattgttcctttggatgaaatccaaaaagatgtatcacaccgtgccgcaagatattacaggtttgatgccaagatttacaagaaaaacaatacaaaacttataaaataatctttttttaaatattatgtacttactaggctatgacattggcagttcttctgtgaaagtttgtctcatcgaggcatccagtggaaaggtgattgcttctgaattttctcccaaaaaagaaatgaaaatcactgctataaatccgggatgggcagagcaaaatccagttgactggtggatcaatctgaagttggcccacgaagctgtcatgcatgaatctggagtacatgctgaagatatcaaaggaatcggaattacctggcagatgcatgggttaattctggtagacaaagatcagaatcttttaagaccatccattatctggtgtgacagccgcgctgtgccttatggtgagcatgctttcaagaccataggcgaagaaaaatgtctttctcatctgttgaattcgccggggaactttacagcatcaaagcttgcatgggtaaaagaaaatgagcccgaaatttttgaaaagatagacaaaataatgcttcccggagactatattgccatgagactctccggccagataggaatgacgattgaaggattatcagaagggattttctgggattttaagaacaactgcatctcggaagatattattaaccattatggaattcccaaaagttttttcccggaaattgtgcctacatttggtattcaggcaacagtttcaagggcagcagcggaagaattaggattgaaagaaggtactcctatttcctacagggctggagaccaacccaacaatgcgctttccctgaatgttttcaatccgggagaaattgcctctacagcaggaacttcaggggtggtatacggagttctggaccagctggaatatgataaactatcaagggtaaatacatttgcccatgtcaattatactccggaacagatcagacttggggttttgctgtgtatcaacggaaccggtattttaaattcgtggctgaagcacaattttgcaacctcactttcttcttatggagatatgaacgatatggcttcactttcaccaattggttcaaaaggattaagcattatcccttttggaaacggagccgaaagagtgctggaaaataaagatacaagctgttctattcacggaattaatttcaacatacatacaaaaggagatatactgcgtgcggcgcaggaaggtattgtattctcttatgaatacggaatggatatcatgagaaatataggaatggatatccaggtcatccgtgcaggaaatgccaacatgtttttaagttcaatttttcgccagtcgctatccagtgtaagcaatgcggtcattgaactttatgataccgatggagcggtaggagcagcaagagctgccggaatgggaataggattttattcagattcccgggaagcattttcttcacttgaacagatagcggtgatagagcctgaacacgaaaaacgagaacaatatttagaagcctatggcagatggaaacatcatcttaacgaaataatctaggaccattacaacagtatttttcatcctcttactgactcttaagaaccagtgagaaggggatctctacgcaaaaaattaaaaataaataaaaaataatcaaataaatatgaacactttaacaggtacaaaagagttttttacgggtattgaaaaaattaagtttgaagggaaggagagcaggaacccgttggcattccgctattatgatgcggaaaagatcgtgatgggaaaacctatgaaagactggacaagatttgcgatggcttggtggcacaccttatgtgcaaacggaagtgatccgttcgggggacctaccatccaccacccatgggatatcggaaatgatccggtaacaagagcaatgcacaaaatggatgcaggttttgaattcatgtctaaaatgggcttcaactattactgctttcatgatattgatcttgtagacccagccagcaactggaaagactacgagaagaatatgcagactatcgtggaatacgccaaacaaaagcaacaggaaacaggcattaagcttttatggggaacagcgaatgttttcacgcatgaaagatacatgaacggtgcttctacaaacccaaattttgatgttgtggcatgcgcaggaacgcaggtgaaaaactcaatagatgctacgatagcacttggtggtgaaaattatgttttctggggcggaagagaaggatatatgagccttttgaataccgatatgaagcgtgaaaaagatcatcttgcacgtttcctttctatgtcgagagactatgcacgtcagcagggctttaaaggaactttcctgattgaacccaaaccaatggagcctaccaaacatcagtacgattatgattctgaaacagtaatcggattcctgagacattatggattagacaaagatttcaaactaaatatcgaagtaaaccatgctacattggcaggtcacacattcgagcatgaacttcaggtagctgttgatgcaggacttttaggaagcattgatgccaacaggggagattatcagaacggatgggatacagaccagttcccgatcgattactacgacatggttcaggcttggctggtattacttccggcaggaggtctgggaacaggaggggtgaattttgatgccaaaatcagaagaaattccattgatgctgaagatttattcatttcccatatttcagggatggatgtatttgcaaaaggtcttcttgcagcggctgatatccttgaaaattcagattacaaaaaactgagaacagaccgttatgcttcttttgataacggaaacggaaaagcatttgaagaaggctcgcttacactggaagatctgcagagaatcgctcacgaaatcggcgaaccacagccaaaaagcggaaaacaggaattgtttgaagccatcgtgaatatgtatatataataaaaaataaaaggcttataaacactaaggatttttatacacaataattattaaagagccttttattcaacaactaatactaaaataataattatgaaccgattttatttcaataaaagcaatagagccgcattattctttgcaatgactttattgccttccggcatagcatattcacaggttaagaaagatacagtagctaaagaaaataaaatagatgaagttgttgtgataggatatggaacccagagaaaagaagctgtaacaggttctgtagccactgtaaaaggagatgccctgcgtgaagtaccctctgccaacattacccaggcattacagggaagaacggcaggggtagatatctctcaaagttccactaagccgggtgctgccatgcagatccgtatcaggggaacaagatccctgacaggagataataacccgttgattgtactggatggtattcctttcgtgggatcgctgggagacataagctcaagtgatatcaaaagtattgacatcctgaaagatgcctccgctacagccatctacgggtcaagaggagctaacggtgttattctcgttaccaccaacagaggagcaaaagggcagaaacctaaatttacctataacacctttacaggagttcagactttattttcaaaatatccgatgatggatggacctcagtttgcaaagctgcgtgcttatgccattcctgcaggaaatacaacccctttgtattcaaacggagctgatgaaaataacagcgtcaatacggactggcaaagcctgttttataagccggcgatgatgaccagccatgatgtaggggtttccggaggaacagaaggtggaaattacaatgtaggattatcctattttaaacaaaatgcattaattcctgttcagagttatgaaagatttgctctgagaatggccattgaccagcaggtaggatctgtctttaagtttggttttacaaccaatacaaactattccgtttcggaaggaaacggagtaaacccgggtgcggttctgggatattctcctattgccgatccttacaatgcggacggaagcccgaaaagagtaatgagtaccgcaggaggtattgatcagacatggatttataccagaagaagcttagagagcctggcagacaaatatattgatgaaaccaaagcttttgcatcctataataacctttacggagaagccagccttcccctcaaaggattgaaatacaggttaaatgtagggttggatttccgtacctcaaatagcggaaactacagtggtgtaggagtcttcaatacaaaccctctgggtccgtcagcggcaggaaaagggaataaccagacttatcactgggtattggaaaacctcctgacgtacgaccgtacattcggaaaacataagatcaacgctgtagcattatactccgcggaacagaataaatatacaagctcatacatgagtgcaaaaaatgtccctgcagactttttccagtattataacctgggacagtcgcctcaggcagacattacggtaagacctgaagaccaggtgtattcgaaaaccgggttgctttctgctatgggaagaatcatgtatacctatgataacaagtatatgcttacagcaacgcttcgtgctgacggatcttccagactggcaccgggtaacaaatggcatacatatcctgcattatcattgggatggaatgttaccaacgaatccttcatgcagaatatcaaagccattaatctccttaaattcagagcaggatgggggcagacctccaatcaggcagtagatccttacactacgatgggaagatttaatgtcgctccttataattatggacttgcaggaagtacagggatttacggaagccagccgccaaacccgaatttaggatgggaatattcaaaaacacaaaactacggggtagatttcggaatcctgaacaaccgccttacgggaagtgtggaatattacaaaacccatacctatgacctgctgacacagaaaagtcttccggcatcaagcggttggtcatccattgtttccaatgtggcagaaacagaaaataagggattggaagtttccttaaacggggttatttttgataatcctgatggatttacgtgggaagcaggagttaatttttacaccaataaaaacaaaattttatcgcttgcatccggaacagaacgtgacatcaataatttatggttcgtagggcataatattaattcattgtatgactatcaatacatcggtctttggcaggctggtgacccttatcagagtattctggagccgggaactgcagcggacgttgtaggatctatcaaggttctttacaccggcggttataatgctgacggaactccggtaagagcaataggaccggatgacagacagatttttgatacagctccgaaattccagggaggatttaatatgcgttttgcctacaagaattttgaactaagtacagtaggagctttccagcacggaggaatcctggtaagtacgatttacggatctgcaagttatcttaacagattaacgggaagagggaacaacgtggatgtggattactggaccgaagataatacaggagcttattttcctcgccctggacgtcatttgagtggtgacaatccgaagtactcttctacattagcgatgtttgatgcttcttatcttaagcttcgtaccattacattaggctataatgtcaataaagattttttaaaggatctgaaaattaccagcttaagaatttacttcaccgtaaccaatcctgtagtcttattctctccttatcataagttctcaggaatggatccggaaccaaactctttcggaaatgaaaaccaggcagtaagcggatatccaaaccgtcagcttgttataggagctaacaacccttccacaagaaattacttaatgggacttaacttaaccttttaaaactgtactgtcatgataaattttaacaaaaaactgctattaggagcaatctttttatccttaacatttacaggttgtagtgaaattcttgatgagcagccaagagcaatctatacagctgactattttaacacaccggacggggttaatcagggatttacagctttatacagacagatgagattactgtatggcaatggctactttatgagcaattgtcagaacggaactgacgaatctacctgggcacaaagtgcggacggtaactttaaggaattagatatgtccggaaacgggattatcaattccaatacttttcctacaagtatggtctggaactctgtattcccgtatatcaatactgctaacggaattattgaaaaaggaccaggattcggaattgcagaatctatgatctctgaagcccgtttcttccgtggattttattacttcatgctcgttcagacctatggaggagttcctctggatttaggagcaggagaattgaaatataacactttaccttccacctcttcagcaagaaatacggtaccggaagtgtacacaaaaacagtttttgctgaccttaaaaaagcaatagaaaacctgcctgcctcaccaagggtaacaggaggtgtcactaaaaatgtagcaagactgatgcttgccaaagcttatcttacttatggatggtggctgcagaatccaaacggcattccaacttatcccgaagtggcaagaactgatcctgacggacacaatgcccagtggtatttccagcaggcttatgatatcgctatggaaggaatcaacaatcccggaccttacgcgcttcagcctaccttttatgatgtcaatgtaggttcaaatgacaggaataccgaatccatgctttatgcagaccatacacagtcaagtacttattataacgaaagcgaccctgtaggatttggttcaggctgggctccggacaattttgcagcatggatgcagacctggaactatactgccatcaaaagtagtaaaacaacagcatgggtgggagcagacgtagtaagttcagtacagagagaagcagcacagtcactgggacgtccttgggttcgtatgtgtcctactttaggggttattaaaaatactttcgcagataaaaccaacgattcccgttatgatggaacctttgtaaccacgtacagagggaactggaacaagaatggaacaggtcttacaacggttcctgtactgtataacgccaataatttaccggtacagccgggaggagctatcttaagcttcctaaatgatgacagccagatgccttcttaccctacaggatccggacaaagcggtgtaggagcaggaacccttccgggaagagcagactgggttattgcaccgaacggaatcagcagaattgtatatcctggattatggaaaataggaacttaccgtaccgatgatccgaacggtttaggatatccgaatgccggattaacgcgtcctttcagcgttgccaaattctcagaattctattttattgccgcagaagcagccgtaaaaggtgctgcaggatctatgacagccagagaccttatcaatgtgatccgtgcccgtgccggaaagtggaagtttaataatgcccagaataccgcttatgtagcagataacagcgctgcaatgacagcggccacacctgccgtaattaccattgattatatccttgcagaaagatcccgtgaatattacggagaattctacagatggtatgatctggtacgtacacagaagtggggagattatgcggctacctatcagatcggaggagcttcttatggagatcactctccgcaaacagttacaagaaacatcaaaccttttcactatctgaggccaattcctcagagtcagattgatgcgatggaagtatcggcagatattaaggcgaaataccagaatcccggatacaattaatttcattctacattcatatcagcaacagagtaggtgtgaaaacacctgctttgtttatctgaattaaaactttacattatggaaaaaacctggcgttggtttggaaaaaaagacaaaatagaactgagcacgcttcgtcaaataggagtagaaggaattgtttctgcactgcatgatatcccaaacggagaaatctggaatccggaggccatcaatgattataaaaactatatagaaagccacggacttcgctggtctgttgttgaaagtcttcctgtgagtgaagcgatcaaatacggaggggaagaccgtgactctttaatagaaaattatatcacgagccttgaaaatctgggtaaagcaggagttacaacagtttgctacaactttatgcccgttctcgactgggcacgcaccgatctttttcacgaatgggaagacggttcttcatcactttattttgacaaggccaagtttgcgtacttcgaaattcatatccttcaaagagaaggggcagaaaacgactataacccggagatccttcagaaggtagaagaattaaaaaataccttaacggagaaagataataatgacctgatagattctgttattgtaaaaacacagggattcgtgaacggaaatatcaaagaaggtgaaataaatcctgtggaaaagttcaaaagtctgttggctttgtacgatggtacagataagcgtcagcttcgtcagaacatgaaatatttccttgaaaaaataatgcctgtctgtgaaaaatggaatatccagatgtgtgtacaccctgatgatcctccgttttcattattgggcttaccaagaatagtaaccaatgaagaagatatcgactggcttcttaaagctgttgataaccctcacaacggattgactttctgtgcgggttctttaagtgctaatcttcagaatgatgttcccaagctggctcagaaatttgcccaccggacaaaattcgttcacctgagaagtaccaatgtctttgaaaatggtgacttcatcgaggcccatcacctgggaggaagaggaaaactcatcgatgtgatccgtgtattcgaaaaagaaaaccctgatcttccgatgagaattgatcacggaaaacttttaacagaagatattgacaaagggtataaccccggctattcattcttaggaagaatgctggcgttaggccagatagaaggagtaatggctgccgttcagtcagaattacagaaaaattaatctgcgtttgtaataaaatagtaaaaagtaaaatgaaagacctgtttagtattaaaaacaaagtagcagtcatcacaggggcttcgggcgttttgggaggcagccttgccaaaagttttatagaggccggtgccaaagttgtggctctgggaagaaaccaggaaacactagatgcacgtgtaatagagcttacagatctgggaggcgaggcactcgctgtagaagccaatgtgatggatattgaaagccttgaagctgcttctgtgaaaataaaggaaaagtatggccgtattgatattctgctcaatatagccggtggaaatattccgtcagcaaccttatcacccgaacagtcatttttcgatatggatatgaaaggatgggcagaagttaccgatcttaatatcaacggaaccgtttacccgagctatgttttcggaaaagtaatggctgagcagggaagcgggaacattattaatatttcttccatggctgcttattcagcgattacaagagtggccggatattctgccgccaaatcggcaatcaccaattttacccaatggctggcctctgaccttgcattgaaattcggagataagatacgcgttaatgccgtggcaccagggtttttcattggagatcagaaccgtgctattctgttgaatccggatggaagcttaacggaaagaagtaaaaaagtaatggcgaaaacacccatgcagagatttggagaagtagaagagctgaacggggttgtacagtttctgtgttcagatgccgcaagttttatcacaggagcactgattcctgttgacggaggtttcagcgcattcagcggagtataaaaactaatttcttcatatcatcaaacagaaccttagtggtttcattaagggttctgtttttaaatgtagacatctaagtgttgtgaaaatctttgattttcatcttatgtgaacttttctgcatagtcataattgaaatgttctaaaaataaagcttttgtgcttttgcagggtttaaacaagttaattaaaatccaggattgtaaaaataaataatgagtaattccattaaaaataaagacgttttcggagaactgtttctgcttgaatcggcaaaggcagaaaatctgtatttcgggtatgccaaagacatgccggtgatcgattatcacaatcatctggagccggatgttatttctgctaatcagaacttccgttctccaaacgctatctggctggatggtgaccactacaaatggagagccatgagaaattttggtattgatgaacagtttatttccggaaatgcttcagatcaggaaaaattcaggaaatgggctgaggtagtaccttatacccttcgtaaccccttatttcactggacccatctggaactgaaaaacccttttggaatcagtgaatatttatcacccaataatgcagatacggtgtatcatcagatgaatgaaagtcttcagacacctggttttttaccacaatccattattgaaaattttaaggtagaagccttatgtactacagatgatcctgctgatgatctggttcatcataaagctttaaaaaacagtgggtttaaaacagctgttcttccggctttccgccctgatgcctatatcaatatgattaatcctgaacagtatctttcaggaattaaaaagcttgaaaaaatctgtggattttcgatcacatcagtttctgatctgttgaatgcacttcagtccagaatcaactatttcgtggaagcaggggctatagtggctgaccacggctttgaatatttcccggatactacaaaatggaatcatagccttgaaaaagagttttccgaatttctaaagggcaatctctcaacattttccgatccggatgcattgtgcggctacttgctgaaagagctttgtaaaatgtatgcagaaaaaggctgggtacagcagtttcatgtaggggcaacccggaataacaattcagaaatgttcaggaaaatgggtgccaatgcagggtatgatgccattggagaatcgtattacgcacagagattgagcgttttgcttgatgagctgaatacagaaggaaagctgaccaaaactattatttacaatctgaatccggcatttaatgaagttctggcaactcttgccggaaactttaatgaaggaggcatcaaatccaaagtacagtttggagcggcctggtggtttctcgatcagcttgacgggatgaccaaacagatgaacacactttccaatatcggtctgatcagcacttttgtcggcatgttgaccgattcccgaagcctgctgtcattctcaagacacgattatttcagaagacttttatgcaatatgttcggaagcgaaatggaaagaggacttcttcccgatgacgaaaaatgggtaggaaagatcattcaggatatctgttatcataatacaaaaaactattttgaaatctaataccatgcaggattcagcaaaaatactatgtttcggggaactgcttcttcactttgccccggattccgaaggaaattggctcaatgaacagtctcttaagatgtatataggcggtgctgaatacaatgtagcagctgcactttcccagtggaagaattctgtgaagctgttatcagcattaccggagaattttgtaggaaatcacctcgaactacagcttaaaaataaaggaatagaagtccttgcagaaaagaacaagggaagaataggaacattttatctttcttccgatggagatatgcagaatgcttcggtggtgtacgatcgctttccgtctgtttttacccaatcggattttgaaactttcagtgatgatgaactattttcagaggtaaaatggctgcatatcagcaccatcacgccggcattgagtgacaatgcattcggcaaatgtctgcaaatcatgaaggaagccagaacaagaaatattacggtttcccttgacctgaattacagggcattgctttggcaaaaccagaatcctcacaaaattaaagagctgatgccttttgtgaatgttctcatgggaaatatctggtctgtcgggcagttcctggatattccagttgaatatgagcttaacggaaaatttgatgatgaaaatcttctgaaacaagccgaaaaaacagcattggaaatcaggagacgattcccggaggtggaaaaaattgcaaatactttccgctttacaaacggagaacaggtgaattactttgccaccttatttactgatgaacagcttttgatttcagaaaaatataattcagataccattgaagaaagagtaggaagcggtgattctttcatggccgctttgattcatggaattttaaaaggaaatcctgatcagcagatcctggaagatgcgacaaaagttgcttttaaaaagcttttcgtaaaaggagataccattgatgaaagcattaatatcgaaacattatgagtgaaatagtacaaaaaataaaagaccagaaaatcgttccgttgttttataacgaatcgtttgaagtctcaaaaaatatcgtaaaagctttatacgcagcaggaatccgtgtgatagaatataccaaccgcggccatcaggcactggaaaatttcactaaactgaaagaaatttcccatacagaatttcctgatcttctgttaggaatcggaacggtgaaaaacatagaggaaatggaagattatactaacgtaaaagcagatttcatcattacaccagtgatcagtgaagcattggtaaaacatgctctcgaaaaaaatgtcctcttgattcctggttgttttaccccttccgatatcaatatcgcacatcagaatgggttaacactggttaaaatatttccggctgatgctttaggaaagaactatattaaatcggtacagcctgtttttccgggaatgaattttatgccaaccggaggaatccatgctgaaactgaagatatcagggaatggctcaatggaggtgccatagcagcagggttgggaagctctctcatcggaaaagatagtaatgaagaagaactgacgctgaaaacaaaagaattattacaacaacttaatcaataactcaatgcaggctcctcaaaaccgcaatataagatggtggatgctgtcccttgtcttcctcgccactacgatcaattatcttgaccgtcaggtaatgggtttgctgaaacctgtgctggaaaaagaattcagctgggatgaaaaagattacagctatatcgtcatggcctttaccacgacatatgccatcggttatatggcgatgggaaggtttatagacaaggtgggaaccaaaatcggatatgcggtttcccttattgtatggagtttggcctcaataggacatggtcttgtaaaaagtaccatcgggtttatcattgcgagaagcacgttgggaatcagtgaagcaggaaactttcctgccgccatcaaatcagtggctgaatggtttcccaaaaaagaaagagcattggcaacgggaatttttaactcaggagcaacggtgggagctattttagcaccgttattggttccgttcattctcggacattacggctggagacagacttttgtatggattggcgctttgggtatggtttggattgtcctttggtggaaattttatgctgtaccggaaaaaacaaaaaatatcagcaaggaagaactgcagtatataaaaagcgatcaggctgaaaaagttgaagagaaaaccaaaattcctttatcggaattactcagatataaagtaacctggtcatttgccatcggtaaaatgttaaccgatcctatctggtatttcttcatgttctggctgccggcgtatttctcggatgtattcaaaatggatttaacaaaaccatcccttccattgattattatttacagcggaaccacgatcggaagtattggtggaggatatctttcatcatttctgatcaaaaaaggctgggccatcggaagagccagaagcattacgatgttattgtttgcattgatggtggttccggtcatgttttcaaaatatgtagataatatgtggattattacgatcattattgcctttgcaacagccgcacaccagggatggggagccaatcttatgaccacggtcggagaccagttacctaacagctatgtaagttctgttattggttttggcgggatgctcggttcagcggcaggaattatttttccgttgttcatcgggattgttttggatacattcaaaaaggcaggaaacgtcaatggcggttacaatattattttctttatcgcgggaatttcatatgttgcagcctggggactcatttcgttgattaaaagaaagaaaacagcttaatataaaagtaatacagtttgaaatttaaaaaataaaaatgaaatccgggctttacataaccacaggtcttctgatcagtatattttcctttgcccagaaaggaggaaagtataagctgtggtatgataaacctgcaaaacaatgggtggaagctttgccggtaggaaacggaaatatggcagctatggtctatggagacccctatcaggaaaagcttcagctgaacgaaggcacattctggtccggaggcccttcccgaaatgataatccggatgctccaaaagtcctggattctatccggtattatttatttaacggaaactataaaagagcccagattcttgcggataaaggattaacagctaaaacagttcacggttcggcatttcagaatattggtgattttacactggatatggataacctcaaggatatcagaaattattacagagaactggacattgaaaaagcaatcgcaaccactacatttacctctggtggtattaattttaaaagagaagtttttgcctccattcctgatcatgtgattgtcattaaattgagctcagatcacaagaatgcactgaactttacagcgaaatttaatagagagcttaaaaagaacatcaaagctattgatgccactactttacagatggatggggtttcttccacattagacgacattcaagggcaggtgaaattcaatgcactggcaaaactcatgaccaaaggtggtaaaacccagatttcaaagagcggaatttcagtaagcaatgctcatgaggtcatgattcttatttccatagccactaattttacagactataaaaatttaaatacagacgaaattgtaaaaagcaagaaatatattgaagcagcagcgcataaaaatttcaaaactttagttcaaaaccatctgagtgcttatcagaactatttcaaaagagtagatctgaatttaggaacttccgaagcagcaaaaaatcctacagatgtccgtattaaaaattttgcgacgggctatgacccggagcttatttcattatattatcagttcgggcgttatctcctgatttcttcctctcaaccgggtggccagcctgcaaatctgcaggggatctggaacaattccaataaaccggcctgggacagcaagtataccattaatatcaatacggaaatgaattactggccggctgaaaagaccaatcttcctgaaatgcatgaaccattgatccggatgataaaagatttgagcgaaacaggaagagaaacggcaaaaacaatgtacaacagccgtggttgggtagcacatcataataccgatatctggagaataacaggcgtcgtggattttgctaatgccggaatgtggccgatgggcggagcctggctttcacagcatttgtgggaaaaatatttatacagcggagacaaaaactatctgcgaaccatttatcctgttctgaaatctgcagcacagttctatgaaaattttttgattgaagagcctgcgcatcactggctggtggcaagcccgtcaatgtcacccgaaaatattccgcagggacaccagggaagtgctctggcggcgggaaatacaatggacaatcaattgatgttcgatttgttcaccaaaacaaaaaaggcggcacagattctcaatacagattcagataaaattcaggtctggaatactattatttcaaaattaccaccgatgaaaatcggaagctacggacaattgcaggaatggatggaagacctggacgatcctaaagacaaccacagacatatttcccatttgtacggattatttccttccaaccagatcagtccgtttaccacgccggaattgctggacgcctccagaaccgtactcgttcaccgtggtgatgtatccacaggctggtcaatgggctggaaagtcaatctctgggctaagttattagatggaaatcacgctaataaattaatcaaagatcagttaacactggtagaaaaagacggttggggcagcaaaggcggaacgtatccgaatcttttcgatgcacatccgccattccagattgatggaaattttggctgtacttccgggattaccgaaatgcttctgcagactcaaaatggttttatagacattcttcccgcacttccggatgagtggaaaaacggcagcatttccgggctgaaggcgtatggaggctttgaagtcagcgtgatctgggaaaacaacaaagctaaagaaatcaccataaaatccggattgggaggaaactgcagaataaggcttccgaatggaatgcagctttccggaaatgcaaaactgaaaaaggcagaaggtaaaaacccgaattctttatttgaaattccggaaactccaaaaccactaatttctgacaaggcaaaattgaatcctgttgaaattaaaactgatcttatctatgatttcccgactgaagcagggaaggtgtatacattaagatggagtgataaaagctttgaaggaacaatttaaaattaaatctattacaataaaaactaaaaaatctatatatgaaaaagagtctaatgaatcctgtttttttaagaaataaaaccaatgtcattgcagtggcagcactactttccatcagtaacctctctgcacagactttttccaacttcaactaccgtggaaacgataaaatatataatgacaaccctcttaagccggacgagttctattccccgattttacagggctgctatcccgaccccagcattaccaaaaaaggtgatgattattacctggtaaactcttctttctcaatgtttccgggcgttccgattttcacttccaaggatttggtcaattggaaacaggttggacacgttctcgacagaccttctcaacttaaggtggaaaaaggaggtgtttctcatggaatttatgcgcctgatatcaaatacaataaacacaacgatacattttatatgatcactacccagattgcgggcggtatcggaaatatggtcgtaaaaaccaaagatccggcaaaaggctggagtgaagtccaaaaattgaattttgacggtattgatcctgccattttctttgatgatgacggaaaagcttacatcgttcacaacgacgcgccaccacaaggaaccgagcagtatcaaggtcaccgcgttattaaaatgtgggattacgaccttgaaaaagatcaggttgttgcaggttcagacagaattatcgtaaacggtggggttgacctttctcaaaaaccaatttggattgaaggtccgcatttgtacaaatacaaagggaaatattacctgatgtgtgcagaaggcggaaccggaggcaaccatagcgaagtgatttttatggcagattctccgaaaggaccgtttgttcccgctaaaaataatccaattcttacgcaaagatattttccgaaagacagaaaagaaaaagtagattgggcaggtcacgcagatttggtggaaggtccgaacggacaatggtatggcgtatttttagcaattcgtccgaatgtaaacaaccgtgttaccaaaggccgtgaaactttcattcttcctgtagattggagcggaacgtatcctgtattccaaaatggcctggttccgatgagaccaaaattgaaaatgccgcaaggcgttcagaatcaaaccgggcaaaacggatttttcccgaacggcaactttacatacaacgataaactaaccgataaaaacctcgatttccgatggattgcgatgcgcggaccgcgtgaaaacttcattactgcaacaaaaaatggtgtaaaagtgaacccaatggaaacgaatatcaaagcgttggctccgatttcatctttgtttcacagattacagcacgaagattttgaaacttccgtaaccttagattataaaccaaaatcggaaaaagaattggctggaattaccctctaccaaagcgaaacattcaattacgtttttggaattaccaaaaaagataaagatttctatatcgtattggaaagaacagaaaaaggacagtcaaaattgattgcaagcgaaaaaatttcactttcaaagagtatcaaatttcaggctacaggagaaaaagatgaaatcagcttcaattattctttggacggcaaaaatttcaaaaatctgggaggaccggtttcaggagatatactttctactgatgtagcgggaggttttacggggagtcttatcggactgtacagcacctcttccaatgatattgtaccgaattaagttagtattagcaatgtcacactgagcttgtcgaagtgttacttttaagactgaaaagaatcaaatcgaaccaaaatatcaaaaccttgaaaatcaaaaaatcttatatagtttctttattgggatttatcgggctgaatcttctttcagcccaggtaaatccttccggaaaacagagtaccgcatttaccaatcccatcatttgggcagatgcaccggatttatccattaccagaaacggaaatgatttttacctgatcagtaccaccatgcatctgatgcccggagctccggtaatgcattccagggatctggtacattgggaaatgtccgggtatgtttttgacactttgaatgacaactcaaaatatgatttattgaacggaaccgtttacggcaggggccaatgggcttcatcaattcgctaccataaagggaaatattatgttttgttttctccgaatgatgaacctttcaaatcttatttctatgtaactgatcatcccgaaaagggaaaatggaaactcattaccagaacaaggcattttcatgatgcgtctttgttttttgatgatgacaggatatacgtttttacttccaacaaagtttttgaactaagtcctgattttaaagaagtgatcggaaatccggatggaactgaggtatttcagaaagatgcttcggaaaccggacttctggaaggtaatcagatcatcaaaagaaacggaaaatattatatgatgatgatatcatggccaagaaacgggaaacgccgtcaggtagtctacagggcagataaagtaacaggtccttacgagaaaaaagtaattctggaagataattttttaggattttcctatgcagggcaaggcgctttgatagatgataaaaacggaaactggtattcccttattttccaggacagaaacggagtgggacgcgttccgctgctgctgcctgttcaatgggaaaacgactggccgatattgggagataacggaaaagttcctttgaaaggagaagttccgcttccgccgttcaaacccaaaaatcatctggtggaaagtgatgagttctctgataaaacaatgaaaatccagtggcaatggaatcataatccggtgaatgaagcgtggtctttatctgaaaaaaaaggctgtctgagactgaagaccagcagagtggtagacaatctgtacgcggctcccaatactttgacccagagaatggagggtccgacttcttcagcagttgtcgcaatggaccttaaaggaatgaaagatggtgacgttgcgggtttcagtgccttcaacggggattccgggattttgtcagtagtaaaggaaggtgaagaaaaattcattgttttttcaaccaacgaagtgagcctggataataaaacaaaagccattacaggggttaaaaaagaagaaaaaaaacggattcctcttaattctgataaaattttcctccgtatcgatgctgattttaacctagggaaagatcttgcagacttttattacagtacggatcagaagaactggacggaaatggcaaaagattacaaaatgatctttgattaccgtagattttttatgggatcaaaattcgcaattttcaattatgccactaaaaataccggaggcttcgtagatgtggattttttcagagtcagtgaagccggaaaataagaatcaaaagcagagaaaaatctgttgtaaacagtaagtaaaatatacgctattattttttttatctgaaataataagtgtgaaaaatacaaataaaaatcatgaataaatcagttatatgggctttaggatttgttttgtcgggaatatttgtttccgcacaaacttttgatcaacaggcaccgcagggtttcgatgtggaaaatgctgctgcttcccacgggaaaattgacacgattcaatatcaatcgaaaactgttggaacaacaagaaaagctttggtttacacaccaccgggattcaaaaaaagtgaaaaatatcccgttctttatcttcttcacggcatcggcggggatgaaaaagagtggttcaatcagggaaaacccaatattattctggacaatctgtatgcacagggaaaacttcagccgatgattgttgtacttcccaacggccgtgcgatgaaggatgacagagcgacaggaaatataatggctcaggataaagtggaagcttttgcaacttttgaaaaagatctgctgaatgacctgattccgtttgtagagaaaaaatatccggttaaaaaagaccgtgaaaaccgtgctttggcagggttgtcaatgggaggcggacagacacagaattttgctttcggaaacattgataagtttgcctggctgggcgcattttcttctgcacccaatacaaaagagcccaataagcttttacccaatccacaggatgcgttaaagatgaagctgatttttatttcctgcggtgatgcagacgggctgatgcctttcagcaagagaaccagtgattatctgagaaaaaataaaatccctcatatcttttatatagaaccgggcggccatgattttaaggtttggaaaaatgatttatacatcttttcacagctgttgtttaagcctgttgacaaaactaagtttgaaggatttaccgttttgggaactcccgcagcaactaatataagaaatgcccaatatcctcaaatccttcccgacggaagagtaatgttcaaagtgaaggcaccggaagcgcaaaaagttcagatcgatttagggaaaaaatatgacctgaaaaaagatgctgacggcttctggacaggtacaactgatccgcaaagcggaagcttccattattattccctgctgattgacggggttgcggttgctgacccgtccagtgagacattctacggaatgggaaggtatgccagtggaatagatattcctttcgaaggagatgatttctatgcattaaaagacgtccctcatggagatatccgtattaaaaatttctattccaaagtcactaactcatggagaagagtttttatttacaccccgccgggttacgaccagaatcctgctgaatcttatcctgcactgtatattttacatggcggaggtgaagatgaaagcggctgggccaatcagggcaaaaccaatctgattctggataatctgatcgcagaaggaaaggcaaaaaaaatgatcattattatgccggatgccaatattggacagggcggaatccggaactttggagagcgcaatcttcagatgtttgaaaaagagctgaaagaatccatcattccgtttgccgaatctaattacaaaataaaaaaaggtaaagaaaaccgtgcgttggcaggactttccatgggtggaatttatacactgtatgccggaattcagaattctgatatgttttccggtttgggagttttcagttcaggatatatgctgccgatgctccaggatgttgccaataaacagtaccaatttttaaatgaaaataaatctgctttttcatccaacatcagaaatttctggatttcaatgggtggaaaagatgatattgcttatgaaaacggtcagaaaatgttgaaagaactggataaaaccggaattaaatatacgtacacagattatccgggaggccatacatggccggtttggagaaatagtctgcatcagtttgcccaggtactttttaaataatgtttttaagtcaaaggcataaagaaaagtaattcaaatctgaaataaaatgggctttacaaaaatgaacaccaaaacttctatcattacggtcatcatgtttttcggaatggtaaatgtcagtgcacaggcttatcagaaaacagattcaggattgaagttttctgctgatcatatgaatgttgaagtgaaattttatggagaaaatacgatcagggttattaaatatcctgccggaaaatcatttgtcaaaaatagtttgtcggtcattaaacaggagcagaaaatcagattctccgtttcagaaaaaaataatgttatttcattaaaaacaaatgaccttctgctttccattaatactaaaaatggagtgatcacttatgcattgccatccggaaaagagcttttgaaagaaaccgcaaataatttcaaaccattcaatgatgccggaacacagacttattccgtaagacaggattttcagcttgaaagagaggaacctatttacggtctgggaattctgcaaaatgaaaaaatgtcccagcggaataccgatgtaaaaatgattcagaataacacctgggattttgtgcctttcttccagtctgtaaaagggtatggcattttttgggacaactattcaccaacacaatttacggatacgcctcagaaaacatccttttcatcagaagtgggagatggtatagattattattttatctacggaaaaaatgccgatggagtaattgccggaatgcgtgatcttacaggtaccgtacccatgcttcctttatggacatatggctactggcaaagtaaagaacgttacaaaagccaggatgagctgacagaggtggttaaaaaataccgtgatctgaaagttcctttagacggaatcatacaggattggcaatattggggaaacaattaccagtggaatgccatggacttcatcagtcccgattttccggatgctaaaaaaatggtacaggagatccatgatatgaatgcccatctttcggtttccatctggtcatcattcgggccaatgaccaaacagtaccgtgaaatggattcaaagggaatgcttttcaatatcagcacgtggccggaatcaggccgtgatgtctggcctccggatatgaattatccttccggcgtacgcgtatacgatgcttataatccggaagcaagaaatatatactggaaatatctcaacaaaggcgttttcagccttggtgtagattcctggtggatggattcaacagaacctgatcatctcagccagaaagcagaagatctggacactaaaacctaccttggctcattcagaaaagtaagaaacgcgtatccgctgatgacggtaggtggtgtttacgatcatcagcgtgaaaccactggtgataaaagggtttttattttaacaaggtcagcttttgcaggccagcagcgatatgcagccaatacctggtccggcgatgtcaattcttcctgggaaacattgcgcaaacaggtaccggcaggattgaatttcagtcttaccggaaatccgaatttcaactctgacatcggtggtttctttgctggtacttacaaaagaaatggaggttcaaaaaatccaatgttccaggaactgtatgtccggtggctgcagtatggaacctttacaccaatgatgcgctcgcatggaaccgatgttgcgagggaaatttatcagtttgggaataaaggagacattgtgtatgatgcgatagaaaaatttatcagacttcgttacagcatgttaccgtatatctattctgtttcccatgatgtttcaaaaaacgggtcaagctttatgagagccctttcaatggattttccttcagacaagaaaacatgggatatgaataatgaatatctttttgggaaatcattgttggtagcgccggttctcaatgcccaatatactcctgaaaagacagttaaaaccgatgaaaatgaaggctggaataaaaccgacaacaataaggataattcggtttcaaatatagattttactcaaaacaaaaacgtgaaagtttaccttccggaaggaacagattggttcgacttctggaccaatgaaaaacacagtggagggaaagaaattcagaaatctgttaatcttcagactattcctttgtatgcaaaagcaggaagtatcattccgttgggccccgatgtacaatatgcaactgaaaaaaaatgggatcatcttaccataaaagtttatccgggaagcgatactgattttattttatacgaagatgaattcgataactataattatgaaaaaggagcttatacagaaataccttttcactggaacgaaaaatcaaaaacattgacgatagctgcccggaaagggaagtacaaaggaatgattgagacaaggagttttaacctgattcttcctgatggccgacagaaaacggtaaattattcagggcaaaaaacagatattcattttaaataaacttaaaatattgaatatgaaaaatttaagtttaataatagtattgggattcttccagatttgttttggccaaaatccgatcatccaaactaagtatactgccgacccggcaccaatggtttataaggatacggtttatctttatacgggccatgatgaggacgatgctttcggattcaaaatgaaagactggttactatacacttccacagatatggtcaactggacagaccacggtgtagtggcttcacttaaagactttaaatgggtaaataccgacaacggtgcctgggcaccacaggttgtcgaaagaaacggtaaattctatatgtattgtccaatgccgaacaatatggggattggtgttttggtggcggacagtccgtatggtcctttcaccgatcctattggcaagcctttgatcaaaaattctctggatgacatcgatcccacagttttaattgacgacgacgggcaggcttatctgtactggggaaatccgaatctttggtatgctaaactgaatgaagatatgatatctcttgccggaccaatcaccaaagacccttcgtttgcgaaggtgaaagaccagccagatcctttcaagtatcaggaaggaccttgggtttggaaaaaaaataaacattattatatggcttacgcatcaaaatgttgcccggaagggattggttatgctatggcaaaatcacctacaggaccctggaattatggaggtgtgatcatggatggcgaccagagatccagcggaaatcatcccggtattatagatttcaaaggcagatcttatgttttcggattcaaccatatgcttaggatgcaaactatgagcaagcattacgaacgccggtctgtcagtgttacagaaattacctacaatgcagatggaactattcagaagcttcctttctggactgcggatggcgcaaaaagagtgggtactctgaatccttataaaaaagttgaagcagaaacgatggcttacagcgaaggcctgaaaacagaaatggttacagaatgggaacgcaatcaaccctataacagaggcaaaaaaatcacagaccgtatcatcgttacctcaattaacaatggtgattatattaaaatccagagagtagatttttccaaaggcgtaaaatctttagatgtgaatgttgcatctctctatggaggaaaaatagaagtacgttcagatgctcttaacgggcctgtgcttggcgttgttaacgttacaggaaaaggtgagggcgacttatataagactattaatacacctctgaaaagtgtaagaggaatccacgatttatattttgtttttaaaggagaaaaagaccttttctatttcgattggtggaaatttaatgaaaattaaaactgaattcaggaatatcaacaggaatgggctttagcccattttataaagaaagaaatatgggtggctttagccaaaacttaagtcatttgttatgagttatattaatatatcagttacaattttaaaaatgttcagatttaaactctttattttcagctttttaattgccggatactgtttaaatgcgcagtcaaccgtttggttagaccagttggatttgagcgttgtaacacagggacacggaaaaccgggcatcaatacttcggtggacggaaaacctataaccattgcaggcgaagttttcaaaagaggctttggaactcacgctgaaagttctttacttattacattaaacgggaaagtcaaaaaattctcagccttagtaggaatagatgatgagatcaaaggacagaaccctgccgtggaatttgaaatttatggagatcataaaaagctctggtctagtggtattatgcacctgggagataaagcaaagcctgtttccgttttgctggaaggtgtaaaacaattagaattagtcgtaacagacggcggaaacggaccttattatgatcacgctgattgggcagatgcaaagtttgaaacagcaggcggtgcaaaactgacaacatttaacccgatttcagcagtaccttatattttgacgccaaaacctgcggcaactccaaaaattaattcagcaggcgtttacggagttcgtcctggctcaccttttttgttcagggttgcagcaacgggtgacagggcaatgacttttacggcgaaaaatcttccgaaagggttaacaatagattcagagaccggaattatcactggaaaaatagattttaaaggaagctatgaagtgactttgaatgctaagaatgcaaaaggttcagcttcaaaaaaattaaaaatagaatgtggagacagaatcgctatcacgcctaccatgggctggaatagctggaactgcttcggacatgaagtttctgcggataaagtgaaacgtgcagcagatgcccttataaagtcaggattaatcaatcacggatggaattatatcaatatcgatgattcctggcagtataacagagatggaaaagacccttcattccagggaaaaatgcgtgatgaaaacggttatatcctgaccaattccaaatttcctgatatgaaaggtcttgcagactacatccataacaatggcttgaaaatgggaatttattcttcccccggtccatggacctgtggcggatgtgccggaagctacggttacgaaaaacaggatgctgaaagctacgccaaatggggtgttgattacctgaaatacgactggtgcagctatggcggtgtaattgacgggctgccggataatgatcccaataaagtttcttctcttgcatttgagggcggcggggatccagataaaggcgtgaaaccattcaaactgatgggaagccttttgaagcagcagccgagagacatcgtgtacaacctctgccaatacggaatgggtgaggtatggaagtggggtgatgaggtcaatgcacaatcttggcgtaccaccaacgatattacagatacctggtcaagtgtaaagaatattgctcttgctcaggataaagccgctccttttgcgaaacccggaaaccggaacgatccggatatgctggttgttggtgttgtcggttggggaaatccacatcagagtcggttgaagcctgatgaacagtatcttcatatgagtctgtggagtattttttcagccccgttgctgattggctgtgaccttgagaaactggatgatttcaccttaaatcttctgacgaatgacgaagttattgccgtcaatcaggatgttttgggaaaacagggtatttgtttgcagaccatcagtgagctcagaatttatgtcaaagaattggaggacggaggaaaggcagtagcttttgccaatttcggaagagaaaaagtgacactgtcatataaagatttcaaaaaattagggatttccggtgttcagacggttcgtgacctttggagacagaaggatattgcagaaatcaatacggacaaaaaaggtctttcattggacattccggcacatggcgttgcctattataaattcatttcactcaaataaataagattaagatatgaatcaacgaaactttaaatatatcacactttcttttctgttggcagggattggtatttctgcgcagaatccggttattcagacccattttacgccagatcctgctcccatggtctataaagggaaaatgtatgtttatacaggggatgatcagccgggatttgatttttatacgatgaccaaatggcgggtgtattccacggaagatatggtcaattatacagaccatggttcgcctatttctttagagtctttcagctgggcgcgggacagagcctgggcagcacagtgtattgaaagaaacggtaaattctactggtatatctgtgtacagaccgttgacaacaatatggctattggggttgcggtgtctgacagtcctaccgggcctttcagagatgctttgggaaaacctctgatttcaaccggaacctgggataatattgacccgacggtttttacagatgatgacggacaggcttatctgtattggggaaacagtaaattattttatgtgaagctcaataaagatatgacttcttatcaggggaaaatcacagaaattccacaatctgtggaagctttcggcgggctgagacgtcccgggaaaagtgatgaggttctgcaaaagcaggaaaaatttgatgatgtatatgtagaaggaccatggctttacaagcgaaataatcaatattatatgatgtatgctggaatgaccggaagaacagaatgtttatcctattcaaccagtccatcgccaaccggaccgtggaaatatcaggggaaaataatgaccgaccagcctactaacagctttaccaatcacggtggaattatcgatttcaaaggaaagtcctacctgttttaccatactggattattgccggccggaggaagctacggacgttcaactgctgtagaagaattcaaatataatgctgacggtactattccgaagatcacaatgaccaaagaaggtgtagctccggctggaaccttaaatccatatcagagaaccgaagccgaaactatggcatggtcggaaaaatgcagcacttccgaaaacaggaaaaccggagtgtatgtctccgatgccagagcaggagggtatatcaaggtccgttcggtagattttgaaaaaggggcttctgcattttcagcttccgttgccgcaggaattgatggtggaattctggaagttcatctggatgatgttaaagggccaaaaatagccgagattgaaattccgagaaccggtggctgggaagagttcaaaaccctgacctcaaaaatttcagaatctgtttccggtgttcatgatgtctattttgtgttccaggggaaaaatattacggcaggaagaaagttatttaatttcgattactggagctttcagaaaaaataaaactgactatgaaaaatacaatacaatatatactggggttttgtctgataggtttttccgaaggcatatcagctcagaaccctattattcagaccaattatactgcagacccggcaccaatggtgtacaatgacaggctgtatgtgtacacgacacacgatgaggatgattccacctggtttaccatgaatgattggaaagtatattccacgaatgatatggtgaactggacagatcacggaacaattctctcgtataaagatttcgactgggcaaaacgtgatgcctgggccgcacaatgtgtagaaagaaacggaaagttttttttatacgttccgatgtggtccaaaaccaataacaaaggcgctataggggtcgccgttggcgacagtccgttggggccttttcatgatccgctgggaaaacctcttgttcagagcgaatggggagatattgatcccaccgtttttgtggatgatgacggacaggctcatatgtattggggaaatcctaaattaaaatacgtaaagctgaatgaagatatgatctcctatgccggaaatattacagaagttccgatgacagaagaatcatttggcaaaagagatgggaaacccaatccggaaagacccacaaaatatgaggaaggcccgtggctgtacaaaaggaaaaacctgtattatcttttctggccgggtggtccacttcctgaattcataggctattctacaggtaaaacagcacaaggaccctggaaatatggagggattgtaatgcctactgaagggaagtcattcaccaatcatcccggtgttattgatttccgggggaaaacctatttcttttatcacaatggcgcattgccgggcggaagcgggtttacaagatcagtaagtctggaagaacttacattcaataaagacggatccatttcgccatttaaaatgaccaacggaattacaaaagctattgcaacagttaatccttattcattcaatcaggcagaaatgattgcctggtcggaaaatgtaaaatcatatcagaataaagaggcaggtgttttcatcaaggcaaagaaaaatggggcttataccagtgtaaagaatgtggatttccgaaaaaaaggagctggttctttctctgcaagagtaggaactacccataacagtgacgtcactatgactattcatctggatgctgtgaacggaccggttgccgcaacggtaaaggttccgatgactggtggagatgaccgctgggaaaccgtaaaagttcagcttactgaaaaaattaccggtattcatgatctgtactttgtattcaatggaaaagcctcaacagatattatgtattttgattactggacctttcttgaaaataattaattatgagaaaaaaagttttatatatcgtattcagcctgtttctgatcagcaaaagctttgcgcaggtagcagaaatttcaagtccggacgggtatctgaagcttcaggttttttcagaagagggaaaagcatcgtataatgttatccttcagggaaaagcaatgcttgaaaaatccccgctgggcctggttaccagtgagtccgacttttcaaagaatctgaaatttttggacagcaaaaaagatatcatttctaagaaatatacaaacgaaaaaatcaaaaaatctgagattgattataaagccaatactttatcggttaatttcatcaatgcagaccaacaccagataggcattgaatttcaggtgagcaacaacaatattgctttccgttataatattccatcaatgaaagaacggctgagtgttgtggtacagtcagaaaccacagggtacagatttccgtcacagacgactacttttctttcacctatgatgaagccgatgacaggatttgcccgtacagcaccaagttatgaaagcggctataaagctgatgctgaactgggaatatcatccgattatggatacgttttccctggtcttttccatatcggaaatgagggctgggtgttgctttccgagacaggagtgaacagttcgtattgtgcttcacaccttgaaaccacagcagaaaaaaatctttacaaagtagcttatccgaacattgctgaaaataacggtttcggaagtaccggagcagctgtttctcttcccggaaaaacaccatggagaacaattacagtggggaattctttgaaacctgttgtggagaccacgattccttttgatgtggtagatccgatgtacgagccttcacaggagtatcagttcggaaaatctacctggagctggattctgtggcaggataacagtatgaattatgatgatcaggtgaaattcatagaccttgctgctgcgctgaaatatcagtttattcttatggatgcgctttgggataaaaatataggtaaagaccgtatgaaagagcttattcaatatgcaaaatcgaaaaatgtcggggtattactttggtacaattccaacggtgctgcgaatgatgctccgatgggacctagaaataaaatgaactcatccgttgaacggaaaaaagaaatgaaatggctgaaagaagcaggcgtaaaaggactgaaagtggatttcttcggaggagacaaacaggaaaccatgcgtctttacgaagatattctgtcggatgccaacgattttggactaaccattattttccatggagccactgtcccgagaggctgggaagtgatgtacccgaattatgcaggaagcgaagccgttcttgcttcagaaatgctctatttctcagaagatgtccgtaagcaggaagctttttttgccacacttcatcctttcatcagaaatacagtgggcagtatggagtttggcgggactttcctcaacaaatatttaacaaaatccaacagggataaaaataaaagacatactacggatggctttcagctggctacagcaatcctgtttcagaatcccgttcagatgtttggcatcatgccgaacaatcttaccgatgctccggaatttcagctcagctttatgaaagaaattccgacactttgggatgaaaccgttttcatagacggctatcctgggaaatatgccgtggttgcgagaagacatgcggatcaatggtatgtggctggtgtaaatgctgaaaaacaatctcagaaactgaaaataaagcttccgatgtttgcagcgaaaaacttgaaacttatcaatgatgatgcaaaaggaaatacatcagagaaagaagtaaaagtgaatgcaaaaggtgattttacgattgaaattcagctgcagggtggttttgtactgaaaaattaacagtaaaccttataggtttttaaaacctataaggtttgaagagattaaaagaatacagattttttaaggttaaataaaaactgattatgaatcatttaaaaatatttttcttattgtgttgtttgggttttgcctgcagatctatgctgcagaaccgtttatcagtactgagaaaatccccgacggaggatttgtagtaagaaattaaagattaataaacaaaaaacagggaaaaatgcgcttcaaaaacttatacctcttcatcatttcgggatttttggtttcctgttcttcctcccggagtctggagaagcaatcatccaaagaccagtggctcactacctgggcaactgctccccaattggtggaactcaaaaatctgccgccggaaccgggactttcggggaataccctacgtcagattgtccgtgtatctgtgggtgggaaaaaattgcggttacgtttttccaataggtattctacagacagccttgcagtaaaagccgtttctattgccgtgccgtccgatagcagtaatgtggatgcaaccagcatcagatcattaacgtttgagaagaaaaacagttttaaaattgctcccggatccgatatttattctgatgaagtgaactttaatctgaagcctaattcgttactggctattacaatttcctatacaaaagtaacccaatctgtcaccggacatccggggtcaagaacaacctcttttattgttaaaggtgagcaggccaatgctgcagtatttaaaaatcctgtaaaaacagatcattggtattcgctttttaacatcgatgtaaagaccggtgagccttcgtatgcggtggctattatggggaattccattaccgatggaagaggatcgggaaccaacaggcagaatcgctggccggatattttttctcagcggttattggctaatccttctaccaggaatataagtgttcttaatttcgggattggtgggaattgtgtagtgcgtggcggtttgggtcctacagcattagaccgtttcgattataacatccttaatcagcagagtgtaaaatggttgatcattctggaaggagtgaatgatctgggaggaacaagagatgctgatgatgcctctaaaagaacagaagaactgattgccgcataccaggtgatgattgataaggcgcatgctaaagggatcaaagtgtacggagcaacgattcttcctttcggaaagtcattctacgacaaacctttccgcatcgaggcctggaaaaaagtaaacgattggattaggaacagcgggaagtttgatgccgtcatcgattttgcaaaacaaatgcaaagtgaaaatccggaagtcatcttgaacgatatgcacgaccatgattttcttcatcccaatgaggccggctacaggagaatgggagagtttgtggatctgaacttatttaaaaattaaaatcaaaaagatatagtatgaattttacaaaaaacatttcgctgtttcttacgttgttgtttatattttttgtaaaagcaaccgaaccatttatttcttttgccaagacagaaaattcggtggtgttgaaagagcgcaattcaggtttgatgctgttttcagacagcgattcggataaaggaattctgcgcgctgttgcgaatcttcaatccgattttcaaaaagtaaccggcgtccagcctaatctggtttcccaaaactctggcctgaacggcatgatcatcattattggtgaagcaggtaaaagcaaaaccattgataatttaattcgtcaaaaaaagctggatggaaaaacattaacagggaaaagagaaaaatatatcattcagaatatcagcaatccttttccgggcgtttctgaagccattgtgattgcagggagtgataaaagaggaacgatttacgggatttatgaaatgtctaagcagataggtgtttcaccatggtgttattgggcagatgttccgattgagaaaaaagaaaatgtatactttaaaaaaggaatatataccgatggtgagcctgctgtagagtatcgcggtattttccttaatgatgaagaaccttcacttggaggatgggccagagcaacatttggcggagtaaatagtaaattttatgagaaagtttttgagctgatcctgcgtcttaaaggaaattacatctggccggcaatgtggggaaaggcattttatgacgatgatgctctgagcgggccactggcaaatgaaatgggtattgtcatgggaacttcccaccatgagcctatggctttggcacaaaccgactggcacaggtatattaaaaaaaataacctcccgaatgtctgggattacgctaaaaatgcggaggttttacagaaattctggaaatccggaatggagagaagtaaaaactgggaaaaacttgttacagtaggaatgcggggtgatggtgatgaagcgatgggagagggaactaatatttccctgctggaaaaaattgtaaaagatcaacgtaaaatcatcgcagatgttaccggaaagaaagctgaaaaaacacctcaggtctgggcattgtataaagaagttcaggactactatgataaaggaatgagggttccggatgatgtgatcctgctgttctgtgatgataactggggaaatgtaagaaagcttcctgacctttcaaaacctttgcataaaggaggctatggaatctattaccattttgattatgtaggtggcccgagaaactccaaatggatcaacatcagtcccatccagagagtctgggaacagatgaacctttcctatgaacataaagtagataagctttgggtcgtgaatgtaggagatttaaaacccatggagtttccgatcagttttttcctggaaatggcctggaatccgaagcagtttaatggtaaaaatcttttggaatatactgagaagtgggctgctcagcagtttggtgaaaaacacgccaaagaaattgccgggatgattaatctgtatgccaaatacaacagaagagtaacccctgaaacccttgacagtaaaacatacagcctagagaattaccatgaatttgaaacggtcttaaatgattacagagcattggccgtagaagctttacggttaaaagaacagattcctgccgattatcaggatgcgtattatcagctggttttgtacccgattgatgcatgcagtaatttatacgaaatgtactatgctgttgcaaaaaacagggaactggcagcgaaaaaagatccgggagccaatttttacgcagataaagtgaaggcatgttttgaaagaaatgcttatctggacaatcaatacaataatgtgattgccggcggaaaatggaagcatatgatggatcagatgaggataggatataaaagctgggcagacggaaaagaaaatataatgcctgaagtcacctatatttctgaagctgaggttcccaaagaaaaaatatttcaggagaaaaacggctatgtttccattgaagcagaaaattttgtaagaatgagcaattctgaccggatccattgggaagtgattcctgattttggaaaaacaaagtcgggagtgacaacctttccgcagaatgcctatcccaaagctaatgaaaatatctggctggaatatgatatcaattttgaatcaaaaggtgagtttgaagtccaattattattagctccgactttaaattttaatcataataaaggattgcgctacgaaatttcttttgacaacgaaactccgcaaattgtcaacttcaatggccattacaaaggagaattgggaagatggcagtccgagcatattattaaatctgttacaaagcattcggttcagcaggctggaaagcacacgttacgtttcagagtgctggaacccggcattgtccttgaaaagatactgatcaacaccggaggattaaaaccctcttacctgggcgctcccgaaagcgaaatgcttcactgattggcccaatactcatcacaaacaacactttaattatgaaacactaatcttaattcacattccaatctgaaatacagttccctcacagagaatgaagagaaagaacagcgaatgattttgtaagcaactttatttaacagatcgctgcctgatatcattcagggtattttcctgacggtttttgaaaatcaaccgtcttgatggggaatctattgcccttactttaattgtttacgatcaaaatcacgactatctaaaactaaaccattatgaaaaaaattttaagtcttgtaaccattcattctatagctctgttttgcagcctgatgcttcatggacagcttacaaccgtaaaaattgataagaatattccttatcagaaaataaaaggattcggaggatttgtctgcagtccccagtttgcgtataaccacatgtctacctcagagattcagacgctttggggaacttccagtgaaggtggatataatattatgagattgtatattcccgaaaacagcagtaactggagctcagtactggctacagcacagcttgccaaatctatggggcttaccatttttgcttcgccctggaccatgcccgcagcctggaaaaccaataaccatgtaaatgctgttcatactgacgctaacggagtacaacagatcggatatttaaagccggaaaattatcaggattatgcgctttatcttaacagctttgttacctatctccagaacaacggagtagagctcgattatatctccattcaaaatgaaccggatgaaatggcacagtatcagggatgtatctggactcctgcgcaaattaccaccttcatcaaaaattacggacagcttatcaattgtaaagtgattgccccggaaagtgtgggatttacggataattttgccagtgctttgctggatccttcggcaatggctaattttgaagtgtatggcgggcatcaatacggacttatgcagtctacctacaaacaattccagaattacaacaaagaaatctggcagacagaatatctgatcaactggaactcttcgtccacccagccggcaagagatttcagctggaatatagatgcatttacctttgccagcagtgtcaacaatgcattattgggtaatgtcaatgcttggattcattattctgccaaacgttattatggcttaatgggtgatggaacttacggaactactgcaggtgtaatgaccaaaagaggctatatcctttcacattatgccaagtacacaacaggaaaaacgagaatagaagccaaatgggatgacaaaacaggtgttttacagggttcttcctatatttcccaggatggaaaccaggtggttcttatggtcatcaactcttctcagaatgcttatagccttaaggttgatctgcctttttatacgacttcaggaacaaaagtactgaccaatacgcaatccaatatggtgagtacacctatcactatgagtacggcaacattccgtcctactgctgatatcagcccttccagtgtcatgacatttgtttttaataaaagtggtgacaggcctgcttctctcatgacaggcggcgatattcattataataaaattgaaacacaaactcctaccagcgcagcttttgggacaggattcaatatcagcaatacgacggtgacgttctccaatccaagccctcttatcagtaataatatgactgcagctaacggatatcttcagcttaatgaccgatacaataaactgatcctgcatgtaaacagctatacaacagccggacaaagctattcggacaatacgactttatactatatcaacagccaaggagtaacgaaatcgtataattacgggaagattaattttccacagggaggaaacttcgatatcaccttagatatttcaagacaggtgcttacagacggatgtaaaggaattttaggactgagaaattccaattacagctctgtgcttacaattaatctgggagatgtttatttcaatgtgggtaatgaaattgcttctaaattcggaggaacctattccgcaagcgacagctatctgatggatgctctggaaaacggctattatacttctgtagacttcagaaatgcagcaggagttacttcctccaataattggcagcctataagtgccaacactaacagcatttattatgtgaattcaaacgtaagttcatctgccaataatgtgatttcagggacaacctgttcaaatctcgtcctttccggtcagggtatggattttcaggtgccgtttaacttcacagccaatacagcttcttacagccgtacctttaatggttacgacgtgctgatcttaccattccaggctaatataccttccggagttactgcttatctgatgtctccggatgcaggtaatatcaattgtaccgcaatttcaaacgggatcattcctgcaaatactccggtaatcatcaatgcgacaggaaatattactttcaacggtacaggaaacgtctccactcctaaagcaattactgttaaccagatgaatggagtttatcagagcattaaagttccggccaatgcttatgtgctgaaaacagaaaacggagtaacaggcttctataaagtaagtgcaggaagtgagcctgcaataggatctttcaaagcatatcttacagaagaaaatacttattctgccaacgttcttcctttaaacttcggatcgttaagcaccagaaatatttctgctgaagctaaaaaagaggatgtaaagatatatcctaacccggtaatagcagaccttttcattgattctgatttgtcagaagcaactgccaccatttttgacggaagaggaagtgtcatcagatccggattgaaaataaattcaggaaaaaaccatattaatgtgggagatttcccggctggtatttactttattgaggttactcaaaaaaataatacagtagtgaaacaaaaatttatcaaagagtaaattgagtccaaagccatcatgagcactgcttatggtggctttatttctacaatttggtagatgaaaaccaaaagtaagtaggatttactattaatttaagtgtattatttacatttatttaaaatagaacgttatatttgtttttcattgcattgttgctgaataatactggcaatttgtataaaataagaatgaaaacataattatccgtaaaaatctgtaaaatcagtgggttgaaaatcattaatcacaaaatcaacaaccatttttcggacattattgaaaccatattacctatgaaaagaattgtattaatcctatgtgcaaccctggcagcacctttattttttgcccagagccattataaatacccattcagaaacccggatcttccggttaatgaaagaatagagaaccttcttactttgctgactacagaagaaaagataggaatgatgatggataattcccaggcagttccccgtctggaaattcccgcttacggatggtggaatgaagcacttcacggagtagcaagagcaggaacagccactgtttttccacaggcaatcgggatggcggccacatgggatgttccggagcattttaaaacctttgaaatgatttctgatgaagcaagggcaaaatacaacagatcttttgatgaggctctaaaaacaggacggtatgaaggactgaccttctggacacccaatatcaatattttccgtgacccaagatggggaagaggccaggaaacctatggtgaagacccttatctgacctccgttctgggcgttgctgcagtaaaaggtttgcagggaaatgacccgaaatattttaaaacccacgcctgcgccaaacattttgcagtacatagcggaccggaatggaaccgccattcctacaatgcagaaatttcaaaaagagatctgtatgagacgtatcttcccgctttcaaagcattggttcaggaagggaatgtaagagaagtaatgtgtgcctacaatgcttttgacgggcagccatgttgtgcaaacaatactttacttactgaaattctccgtggaaaatggaagtatgacggaatggtggtctcagactgctgggcattggccgatttctttcagaaaaaataccacggcacccatcctgacgaaaaaacaacggcagcagatgccctgaaacattctacggatctggaatgcggagatacctataacaatctgaataaatctctggcaagcggactgattaccgaaaaagatattgatgagtcgatgcgcagaatcctgaaagggtggtttgagctgggaatgcttgatccgaaatcttccgttcactggaataccattccatattctgtagtcgattctgaagatcataaaaagcaggcactgaaaatggcacaaaaatcaatagtgctgatgaaaaacgaaaagaatattctgcctctcagcagaagtattaaaaaaattgccgttgtaggaccaaatgctgatgacggattgatgcagctgggaaactataacggaacgccttcttccattgtaacgattttagacggaatcaaaaccaaatttccaaatgctgaaattatctacgaaaaaggaagcgaagtaacagatccttcgtccagaacatcactctatcagaatttcatcagtcagaaaaacggtacgaaaggaatgaaagtagagtttttcaataataatgaattcaaagggcagccggccaatgtttccgtaaatcccaccgccatcagctacaacagttttggaggaacccagcttgcacccaatgtaggaagagaaaatacctcagccatcatttcagggatttttaaaagtacctatacaggagaggttgtgttttctgcttccacttccgatgtctatacccttttcgtggacggaaaagaaattgccacaagaaaaggacctgatgcaagacatccttcagagtttcctgtaaaaatggaaaaaggaaaagaatacaagatagaactgcgtcatacacaaaaaggaaaatatgtaagcatcagctttgaagtctacagaaaagaccctgttaattttgcttcggtgagagaaaaggtgaaaaatgcagacgtcattgtcttcgcaggcggactttctccaagcctggaaggtgaagagatgatggtgaatgcagaaggctttaaaggaggtgacaaaacttcgattggccttcctaaagtccagcgggacctgttggcggagcttagaaaaagcggaaaacctgttgtttttgttctttgtaccggaagtgctctgggattggaacaggatgagaaaaattatgatgccctgttgaacgcctggtatggcggacagtccggaggaactgcagtggcagatgttttggcaggagattataacccttccggaaaattacccattactttttataaaaaccttgaacagctggacaacgctctttcaaagacaagcaagcacgaaggatttgaaaattatgatatgcagggaagaacgtaccgttatatgacggaaaaacctctttatccgttcgggcacggcctgagctattcaaaatttgtttacggagattcaaagctgggcaaaaatacaatcagtaccagcgaaaatgtgacgatcacaattccggtaaccaatatttcagaaagggatggtgaagaagtcgttcaggtttatatcagaagaaataatgatgcccaggcaccggtaaaaacattaagagcttttgaaagagctttaatcaaatctaaagaaacaaaaaatattcagctgatcctctccaaagattcatttgccttctatgatgaaaaagcagatgatctggtttcaaaacccggcgactataccattttttatggcggaacttctgacgatgcagggttaaaaagtattccgctaaaagtaaaataaaaattgattcaggacaaattgagacatgctttagctttcaaaatatacgatctatgacaaccaaaaataaaatattttccatcgcgatttccctcagtgttgcttttttttcggctcagaataatacagtccgtacttttaatctggatctgaaagaaactccggaacctgttaaaatacaacccaccatgtatgggattttctttgaagacatcaattttgcagctgatggcggattgtatgcggaactgattaaaaaccgcagctttgaatttgacgaaccatttacaggatggaaacagcccaacacaaaaacactttctcctaatctggattcggggtttctgaccatttattctgaccctgccaaaaccaataaaaattacgcaagaattactgttctgaacgataaaaattatattctcgaaaatgaaggattcagaggaataggtattcatcagggtcaaaattatgatttcagttttgatctcgagaatgtttcaggaaatattgctgcggtaaatgcaagtcttgttgatgaaaatggaaaggaaatttcttcagtttccacactcataaaaggaaagggatggcagaagtatacagccgttttcaaatcaccacaaactgtagaaaaagcaaaactgcggattacatttaccggaaatggcatcgtgaacatggatatgatctccctcttcccgcaggatacctggaaaggcagaaaaggaggattacgaaaagacctcgttcagaaactatacgatttgcagcccggatttttaagatttccgggtggctgtattgtagagggaagaactttggcagaacgttatcagtggaaaaaaacaataggaaatatagcagaccgtgaataccttatcaataaatggagtacaggatttccgcatcgtcttacaccggattacggacagtctttcgggttaggattttatgaatatttccagctttccgaagatctgggcgcagaacctgttcctattctgagctgcggaatggcatgccagttcaataccgcagaactggtgaaaatggaagaccttgatccctacgttcaggatgcccttgacctgattgaatttgccaacggggattccggaacaaaatggggtaaaatccgtactgaaatggggcatccaaagccttttaatttaaaatttatcggagtgggaaatgaacagtggggagcggattatattgaacgttataaagtatttgaaaaagccattcatgcaaaatatcctgacattaagatcatctccggaagcggaccatcacctgacggcgaattctttgaatatggctggaaagaactaaagcagcttaatgcgcagattgtcgatgagcattattacaattctcccgaatggttcatgcaaaatgcaggcagatacgaccagtatgaccgctccgggccaaaagtttttgccggggaatatgcagcccagtctgtaggcgtggtaaagcctgataataagaataactggctaaccgctctttcagaagcagcttttatgaccggtcttgaaagaaatgcagatgtggtctatatgacttcttatgcaccgctttttgcccacgctgatggctggcagtggacacccgatctcatctggttcaataatctgaaatcctatgcgaccccgaattattatgttcagaaattattttccaacaataaaggaacggatgtactgaaaatagaaaataacgggaaaactgtatccggacaggagaacttatatgctacagcagtaaaagatgcaaaaactcatgagattattataaaaatggtcaatactgatactcaggttaaaacggtaaatatcaaaccaggaactttgaaaacaggtaagaaaataaccaaaatccttctatccgcaccacagctttctactgaaaatagtttcgatgctgaacccataaaacctaaggaagagatttctgaagccaaaaatggagaaatttcaacggaaattcctgccaattctttaattgttttaaaggtgaaattaatttaataatttgatattcagtgttttgttaaaaataagtgtgttttttacatttatttaaaatagaatcttatatttgtttttatctcatcaggagaaattaatctcaataatcaaaaacgtttcatcaccatgaaaaaatatgttatcgggctggactatggtacagattccgtacgggccgttcttattgatactgaaaacggttctgaaataacttcttcagtcagctattatcaaagatggaaagagggtaaattttgtgatccctcagccaacagtttcagacagcacccttcagatcatattgaaggtctggagaaaaccatttcagaagttgtaagagaaagcggaatagtgccggagcagatcgttagtatttgcattgatacaacaggttcttcaccgcttcccgtaacacatgaaggaacagctttagcactggttccggggtttgaagagaatcccaatgccatgatggttttatggaaggatcatacagctatccgggaagccgaagaaatcaatacacttgcaagaacctggggtggggaagattatacaaaatatgaaggcggtatctattcctccgaatggttttgggccaaaatattacacatcagcagagtagatgcagaggtgaaaaatgctgcttatacctggatggaacactgtgattatctgacctatcttttatcagatcataaagacctggcaaccttcaaaagaagccgttgtgcagcaggccacaaagccatgtggcatgagtcatgggatggtctgccttccgaagaatttctcaacaggctagatccctctctgggaaagcttagaggaagattatacagggaaacgtatacatcagatgaagttgccggctatctgaatgaagagtgggccgctaaaaccggtcttaccactaaaactgttattacagtaggaacttttgatgcccattcaggcgcagtgggagcaaaggttgaagaaaatgtactgatcaggatcatgggaacttccacttgtgatatcatggtagcctcaggagaaaccatcggagatacaaccgttaaaggaatctgcggacaggttgacggctccgtaattcccggattgataggacttgaagcaggacagtctgcatttggagatgttctggcatggtataaagatatcctgatgtggccggttcaccagattatgatgcattccgaaaatatttcagacgagcagaagataaaactcgcagatgaaatggaggccgggcttatcaggaaattaacccttgaagcagaaaaaattcctctttcagatagtgttccggttgccttggactgggtaaacggaagaagaacaccggatgcagaccaggaacttaaagcggccatcagccagctttctctgggaacaaatgctccccatattttcaaagctttagtcaatgctatttgtttcggagctaagaagattgttgaccgttttgaagacgaaggtgtgaaaatcaataaagtgatcggaatcggaggagtcgcaaggaaatcaccatttatcatgcagacgctagctaatgttctggatatgccgattgcagtagctgcttcagaccagactccagctttgggagctgctgtttatgcagctgtatcagcaggaatttatcctaccgttcaggaagcaagcatgaaaatgggctccgcatttgaagcggaatatcagccgaaagcggaagaagtacagcactacagagaattaatgcagcaataccagaagctcgctgattttgtagaatacaataccaaactgaaaaacaacaggaaagaacttcagaactcctgaatattaaccttttgaatacactcaaatgaatacctataaagaactccaaagagaatgttatgaagcgaatatgcagctggatgccctgaagctggtggtctatactttcgggaatgtaagcgctgtagaccgtgataaaggcatttttgccattaaaccaagcggtgttccctatgatatgttaaagccggaagatatggtgattttagactttgacgccaatgtcattgaaggcaggctcagaccttcttccgataccaagacccatgcttacctgtacaaaaactgggaaaacatcggtggaatttcccatactcatgcgatctattccgtggcgtgggcacaggcacaaatggatattcctgttttcgggaccacccatgcagaccatttaacaacagatattccctgcgctccacctatgcgggatgagctgattgaaggaaactacgaatacaatacaggaatacagattctggaatgctttaaagaaaaacagctctctccggaagaagtagaaatggtcctaatcggcaatcacggtccgtttacctgggggaaaaatgcagaaaaagcagtctacaacagtaaagtgctggaaaccattgccgaaatggcgtatctcaccagacagatcaatcctgatgcagaacgtctgaaagattcgctcatcaaaaaacactatgaacgtaaacacggcaagaacgcctattacggacaggaatttaaacactaaacacttcaacataaacaactattaacgatcaacaaaactatgttaacacctctcaataccaaagaagtctggttcatcacaggaagtcagcatttatacggacctgaaacacttgcccaggtggcagaccactcacagaaaattgtggcagaacttgaaaagtcttctttcatttcggtaaaagtcattgtaaagccaacggtaaaaactactgaagagatatttgaaaccattgcagcagccaatcatgcagaaaactgcataggagtaattacgtggatgcataccttttcacccgctaaaatgtggatcagaggattaaaaattttacagaagcctcttctgcatctgcatacccagttcaacagagatattccgtggtctaccatggatatggattttatgaatcttaaccaggcagctcatggagaccgtgaatttggttttatggtaagcagactccgaaagaacagaaaagtcgtggtagggcactggtcagaagaaagagttcagaagcagattggtgactggagccgcgttgctgcaggctgggacgactggcaaggagctaaatttgcacgtttcggtgataatatgcgatttgttgccgtaacagatggagataaagtggaagctgaaacccagtttggtttttcagttaatacctggggaatcggtgaccttgtaggcgttatcaattctgtaagcgaaggagaaataaaaagccttatggaagaatatgaatcttcttatcacatggcagcatctcttttggagggaggagcccacaggagttcacttcacaccgcagcaaaaattgaattgggacttgaaaaatttttaaaagacggagggtttaaaggattttcagatacctttgaagaccttcacggattggaacagcttccgggaattgccgtacagcgcctgatgcagaaaggatacggatttgcaggcgaaggagactggaaaacagcagcgctggtacgtgccatgaaaacaatggggcagggactagaaggtggaaatgcctttatggaagattatacctatcatttagacccttccaatccttccattttaggctcccatatgttggaagtagaccctgtgctggccgccggaaaaccttcgtgtgagatccatccgctgggaatcggaggaaaagcagatccggttcgtctagtttttaattccagaggaaatattgattctctgaacgctgccctgatggactttggaaaccatttcagactgctgatcaacaaaaccagagcattggaaattacagaagagctgccaaaactcccggtagcaagggttttatggaaacctcttcctgatttatatactgccgcagaagcctggatactggcaggaggggcgcaccatacatgttacagtgaaaatatttcggcagaacagctggaggattttgctgagatagcggggattgaatcattagttattgatgaagataccaaaatgcgtgactttaaaaatacacttcgttggaatgaaatgtattatcgttaattaattttaaaaaatatgtaaataattatgaaaaaagcaatacataatagcatttttattttattatttttaattattttcggctgtaaaaaagaaaataacaaacaggatatttcaggaaaaatggagaatgtgcatacttcagactatggggtgacgccaaaaggcgattctattaaaaaatacacgctgaccaataaaaacgggatgaaagttgaggtcatcaacttcgggggaattatcacttctttaaccgctccggacaggaacgggaaatatgaggatgtggtactcggctttacaaaacccgaaggatatttcgatggcaacccttattatttcggtgctttgatcggaagatatggcaataggattgctaatgcaaaattctcactggaggggaaagcatacgaaattgataaaaatgatggacccaacagccttcacggaggaaaagaaggatttcataccagattctggaatattgaggcagtaaaagatgcaaaatttccgacattaaaattatcttataccagtgcagacggtgaagagggatatccaggaaaattaacaacaactattttttacacgcttacggacgataatgcattggaaatttcttacgaggctgagaccgataagcctacagtggtgaatcttacccagcattcctattttaacctgtccgggaattttactaaaacgattactgatcatgaactgcagattaatgcagatcattttcttccggtgaacgaaaccttaattcctacgggggaacagaaagttgtaaaagggactccttttgatttcacggtttctaagccgattggaaaagatatcaatgcagacgacgatcagctgaaaaaaggaaaaggatatgaccataactggattctgaatggaaaaggattaagaagcatcgccaaagtttatcatcagggaacaggaaggctgatggaagtcttcacagatgaacctggcgtgcagttttactctggtaattttcttgacggaaaatttgataccaaaacaggaggtaaaaatgaattcagaacagggttctgtctggagacccagcatttcccggattcaccaaaccagccttctttcccttctacagaattgaagccaggacagaaataccactcgaaaaccatctataaattctccgtaaaaaagtaaactatgggaaaattagcaactattgatattatcatattcctgatctatttcgtagtggtagcttcctacggattatggatctataaaaagaaaaaatctgaatccacaggaagtaaggattatttcctggcggaaggatcattgacctggtgggctatcggagccagcttaattgcttccaatatttctgcggaacagtttattggaatgagtggtgaaggtttctttgtcggaatcgctgttgccgcttacgaatggatcgctgctcttgcgctgatcattattgcggtctggtttattccgatctatcttaagaataagatctataccatgccccagttccttgaaagaaggtataataaatcggtttcattgatcatggccgtattctggctgtttctgtatgttattgtgaatcttacttccatcctttatctgggagctcttgccattgatactttattgggaggagaacatcttcacgggattatgatcgctcttctgcttatggcccttctgatcggtcttggaggaatgaaagtgataggatatacagacgttatacaggtggctgtcctaattatcggaggttttgcaacagtgtatatggctttgcagattgtagaccagagaatcaacggagcggctgtaggaaatgcgctggcaggattcaataccctgatcaatgaggctccgcagcactttaagctgattcttgaaaaacctacaacgaccacaactactttggcaatgcctcaaaaccttgatgtacagaagtatgtcgtgttaccaggtctggccatgtattttgccggtcaatggattgttaacctgaattattggggctgtaatcagtacatcacccagagagctttaggggcagatctgaagacggcaagaacaggaattttatttgcaggatttctgaagctattcatgccggtgatcgtaatgcttccgggaattgccgcttatgttttatattccaaaggacaccttccgggattcaacggagtgaaagacggtgcctactctgcaatattaggatttttacctgttggacttaaaggattggccattgcagcattgaccgcagcaattgtagcctcactggctggaaaagtaaacagtatttcaaccatttttacgttggatatttataaaaaataccttaaaacagacgctaccgaaatccagatggtaagaacaggccgctgggttatcattatcgcaatgatggcagcactggctttcacctggacagacgttttaggaattggcggtgaaggaggtttcacatttatccagaaatatacgggctttatcagtccgggagtttttgccatgttccttctgggaatgttctggaaaaggacaacaggtacagcggctttggtaggagtaattttaggttttgttcttgccattttcttcaacagctttgccgtgggaattttcgggaaagaaacatggatgtatactgcattcacttatgaaaagcttgaaaacggagtagtgcataccattaccgaaattcctttcctgatcaatatgggatggtcgttctttatcacgataatcgccatgatcctgatcagtcttgcaggtccgaaggtaaatcctaaagcttttgccattgatgtaacgatgtttaaagtggacaacagaactttagttttgatcgtgatgacactgcttttactgactgccttgtatgtgaggttctggtaaaagtgaatagtcaaaagtgaactcgtttcacttgtcaattttagaaattcaccattgacttgcgaagcaaattgacttttcacataagaaataaatttagtgtatgacaaaatgaatagtcaaaagtgaactcgtttcactagtcaatttttaaaaattcaccattgacttgcgaagcaaattgacttttcacgtaagaaataaatttagtatatggcaaaggtgaatggtcaaaagtgaacttgtttcactagtcaatttttaaaaattcaccattgacttgcgaagcaaaattgacttttcacctataataaaaaaaacaggatactttttaagcatcctgtttttttattatatcttaaacataaatccccttgagattttcttgttgtattttttttcgtcaaaccggtaaagaaaagacccttttctggaggaagtcatatcctttttgttggtgttaaccagaatatccatactgttgatcttgctggtaaagttccgtttgtcaaacttttcatcaaaaatagcttcatatagattctgaagatccttcatggtaaatttttcaggaagaagctcaaaccctattggcccagtggaagctcttctcctcagtctggccacagcatcttttaccatcttattatgatcgaaaataaggtcaggtgctttctgaagttccacccattttgcactgtattgctcattgatttgaatatctttctcaatattgatcagtgcgtaataagagatagacataattctggctgttggttcacgcttgatttccgtataacacttcagctgttcaagataaatattttcaagaccggtcagcgtatacaaaaccctgttggctgcctcatcagaagtttcgtcactgccaatgaagccacccatgagtgaccattcacccatttgcggttcaaaatttctttttaccaaaaggattttaagattttcgccatcaaaaccgaaaatgatacagtcaacggcaacaaggtgtttgggatattgggagtaatcctcagtcatcttttatattttattgcaaaggtaaagcttttataaatacgatattatataaatgtgatttatacacttttaaatttgaatgatttatttcattaaaactattccttaaggatattttgggaggtaaaactgtcatcaaaactgaaaattatcactgaaatcaggttaatcatagatgaattcaatgttaaaattgtgttaaaattaaaaataagatttataataatcaagaaaagggacttaacgttaaaaatacgataaggtatttgctgtatggttgaaatttttgccaaaacagatcctgaattcattttcatagggaatcatatgattttaatgttttgtttttctgcaaattaattatcttattttttatgataaggtaggacgttttttgttgtttttagggatttatagaaagttttaaatgaaaaaataagtcaaataggcgcagaaaatgtttcgtatattgaatctttccattattttagaaatgttgaattaacatttataatggccccgaaactttctgcttttttattgtgttttgcttcatttgcctcggctcaggtgaaggaaaaaatccattattttcctttggaaactgtcaggttatcagagagtgttttcagcaaagcgatgaaggcagatcataagtacctgatggccctggaaccggacagactattggctccttatcttaaagaagctggattaaagccaaaagcaaataattaccccaattgggaaaacacagggttggacgggcatataggaggacactatatttccgcattatccctgatgtatgcttctacaggagataaagcaatacaagagagaatcaattatatgatcagtgagctggaacgctgtcagaaagcctctccggacggatatatttcaggaattcccaacggaaaaaagatctggaaagaaataaaacagggaaatatacgtgcttcaggcttcggtttgaacgaccgctgggtacctttatataatattcacaaactgtactcagggctgcgcgatgcgtattggtatgccaaaaatgaaaaagcaaaagcaatgcttataaagcttacagattggatggcaaatgaagtttcaaacctttctgatgaacagatacaggatatgttgcgcagtgaacatggaggactcaacgaagtttttgcagatgtttacgatattactcatgaccggagatatctgaaactggctcaccgtttttcccatcaggctatccttacaccgcttttatcaggagaagataaacttacaggacttcatgccaatacacagattccaaaagtaatcggctacaagcgtattgccgatcttgaaaacaatacgtcctggagtaatgccgctgattttttctggcataacgttacagagaaaagatcctcagttattggaggtaacagtgtcagtgagcattttaaccctgtcaatgatttcagcagcatgatcaaaagtattgaaggtcctgaaacctgcaatacatacaatatgctgaagctgaccaaagagctttatgcaaccctgcctgaatcttattatatcgattattacgaaaaagcattatacaatcatattctttccacagaaaatcatgatcagggaggcttcgtgtactttacgccaatgcgtcccgggcactaccgtgtgtattcacagcctcacaccagcttctggtgctgtgtaggatccggaatggaaaaccatgccaaatatggggaaatgatttatgcaaagtcagataagaatttatatgtgaacctgtttgtcccttccacattgacatggaaacagcaaaatgtagtactccgtcaggtcaataacttcccggaagctcctgaaacaacattgatttttgatgctgcaggaaagtcagaatttgatttaaaattaagatgcccggaatggacgccgccttcggaagtaaaaattctggtcaacggaaaacaggaaaaagtacagcgtggttctgatggctattttacactgactaaaaaatggaaaaaaggtgatgttgtgaaaatgaccttgccgatgcatctttctgcagaacaacttcctgaccattccaattattatgcatttaaatacggtcctgtagtgcttgccgcaaaatacggtaccgaaaaccaacagggacttcttgcggacgatagcagaggcggccatattgctcatggtccgcagattcctttaaacgaaattcccgttatccttggaaatccttccgaggtagtcagccatgttacacctttgaacaataaaccgctcaactttgccgttacagggctttatccgtctgaaaaattcggggaaggactaaatcttgtgccgttttacagtattcaggcagaaagatatattttgtactggcctcaggctgacaaaaacgaaatagaaaatacattgaagcagaaggcaaaagaagaagcggaaaccagaaagttggatatgatcaccatcgataagatccagttaggggagcagcagccggaatcagatcattttatagaaagcaaagactctggcacaggatatatggaagaccgacatttccgtgatgccaaaggctggttcagttaccagatgaaaaataacggaaaaaatgcttcatacctttacctgctttattttgatgcgaatgccaaccgcacgctgaatattgagatcaacggaaaaaaaatcatgactcaaaatctggaaggaaagtccggagccttacctcaatatctggttgttccaataccggattcagaaaagaataaagaaaatcttagtgtaaaatttctggcagacgaaaaactcatgactgctaaagtcattgaagtccgtttactgacagaaaattacggaaagaaataaatacagaattaaaacagattttttccatgaaaaacaaaatcctatacttgttattttttcttgcagccatttgcagttttgatgcaaaagtaaggctgcctgctttggtttcagacggaatgattcttcagaggaatcaggatctgaaaatctggggatatgcagatacaggagaaaaaattacggttaagtttatcagtaaaacctataatgccaccgctgatcagaatggcaattggtctctaatgcttccaaagcttaatgccggcggcccatataccatgaccattaatgagattacccttaaagatattcttattggtgatgtgtgggtggcttcaggacaatccaatatggagcttccgatgcgcaggctgacacctctgtatgaaaatgaaattaaaaacgccaataatcagaatataagattcttcacggttccgcagaaatacaattttaaagctccccaaaatgatcttgacggcgggaaatgggaaagtacaaatcctcagacgatacttgatttttccggggttgcttatttctttgccaaagaactgaatgaaaaaaataaagttccggtaggcatcattcataccagtctgggaggatctccggttcaggcctggatggatgaaaaatcactgaaaaaatacccggaatatctcgctgaagcagaaaaatggaaaaatgatgacttgatacaatctacagaatcccaggaaagatcattaagcaaagcatggtatgcagagctggatcagagtgatattgggttcaatcagcactgggaaaaagataacagaaatgatgcaggatggaaaaccataatgctgcctggatcatgggaagaccaggaaggctcatttgacggttcggtatggttccgtaaagaaattatcttgcccaagggagcagatcagaaagcagcatttttaaatctgggaaggataaaagatgctgatgttacttatattaatgggattaaagtaggaaatgtaacttatgaatatccgccacgctggtacgacattcccaaaggcgttttaaaagaaggaaagaatatcatcacagtaagagtcatcaatggcagtggaaaaggacagtttattgctgataagccgtattatctggaaatcgacggacaaaaaacagaccttaaaggcgagtggaaatataaaataggagcaaaaatggaaaaaatggctcccggacagacatttatccgctggaagccggtaggtctttacaacgccatgattaatccgctgatcaattataaaatcaaaggatttatctggtaccagggcgaaagcaataccgggaaaccaaaagaatacggagatttgctttcaaccatgatctcagactggcgttcaaaatggaataagaacgatttgccgttcttcattgtacagctggccaatttcatggagaaaaaagatgaacccattgaaagtaactgggctgagcttagagaacagcagagacaggtttctcttaatgttccttattcaggacttgcggtaacgattgatgtaggagaatggaacgatattcatccgctcaataaaaaagcagtgggtgataggcttgctttacaggccctgaaagttggggaaggcaaaaaaatcatagctgacggacccgtttatcagtcgatgaaaacagaaggtaataccattattttatcctttaaacccggtacagatgatctggtacagggaagccttaaaggttttgccatacagcagaaagagggccgttatcaatgggcaaaagcagaagcaaaaggtaataaagtcattgtctggaatgatcaggtcaccaatcctgtcaatgtacgttatgattgggcagacaacccagacggcaatcttaaaaacaaaagcgggcttcctgcttcaccttttacaacagaaaaaaattaatttaacatagaaaaccttatcaaaatcaatggatcatcagccacaaaaaatatcggtaatagaaaaagtagggtatagcctgggagatctggcagctaaccttgttttccagactttagttacttaccttacttatttttatacagatatttacggactcaaagcagaagatgcttctgttatcacccttacggtaggattaattgccggatttggttttaacccgcttatcggagcgctggcagaccgtacaagttcacgatgggggaaattccgtccatggattttatttactgctgtaccgcttggtattgcagcactattagctttcagtacgcctcacttttcctatcagggtaaaatgatttatgctgcggttacctattcattattattgttattatacgcttccaataacctgccttatgctgcattgagtggcgttatcacgggagatatgggagaaagaaacagtatttcttcataccgttttgtagcagtaatgtttgcacagttttttgtacaggtatttatgcttcctatcattttatatgtaggacatggagacaaagcacagggaattgagactgttatgacttggctggctgtgatcggatctataatgttactgattaccttttttacgaccaaagaaagaattattcccaagccggagcagaagtcaagtctgaaagaagatttaaaagatttattccagaacagaccctggattattatgcttaccgtgactgcattcatattcatcacactggccatgaaaggcggagcttatgtatactatttcaataattatgtggatgaaaatgctctcaaaagttttatctcacccattacagcattttttaactctgcagggatgaatttctttggagaagacccgaaatctgccgggttcggattatttaatgcaggaggaattgtgatgatgattgtcggcattaccttctctaaaaaactggcagacagatttggaaaaagagatacttttattgcttcattattcatttctaccttgtttatcctgttctttatattttatcctccgaaagctgtggaaattatgttcctgtcccagattttacacggattcttttatggaatcagcacaccgcttttgtgggcgatgattgctgatgttgccgactattcggaatggaagaacaaccgcagggcaacggctattattttctctgccatgatggtaggactgaaagtaggtctcagcattggaagctctctggtagctttaattataggaaaatacggatacatttcagtacacgggagcgaacaggtgattcagcctgaaacagtggcagcaggagcgaaaatgctcgtaagcatattcccgtccattccgttttttattgcctgcggactgcttttattttacaaaatcaacaaaaaaatggaagttcagattgaaaaagatctggctgaaagaagaaaataaaacaattactatgaaacgtattttaattggtttggcggctcttaccgcttccgggctgtcggcgcagaaatccgatggtactttaaaaaaagcatttcaggataaattctatatcggaactgccatgagccttccccagattgacgggacagatcagaaagcagtagcgattatcaaaaaacaattcagctctgttgttgctgaaaactgtatgaaatctatgtttctgcagccaacggaaggaaagtttttctttgatgatgctgataaatttgttgatttcggaataaaaaacaatatgttcatcatcgggcatacgttaatctggcattcgcagcttccaaaatggttctttttagacagtaacgaaaaggatgtttctccggaagtgttgaaacaacgtatgaaaagccatattacaacggtagtttcccgttacaaagggaaagtaaaaggatgggatgtggtgaatgaagccattcttgaagacggaacctatagaaaaagtaaattttacgaaatcctgggtgaagactttattcctttggcatttcagtatgcacaggaggcggatcccaatgcagaattatattacaacgattataatgaatggtatcctgaaaaggtaaaaacagtcattgcaatggttgaaaaacttaaatcaagaggaatccgtattgatggagtaggaatgcaggcccatgtcggaatggatatcccttctatcgatgaatatggaaaagcaattctggcctattccaatgcgggagttaaagttaatattacggaactggaaattagcgcactgccttctccatggggcagttctgccaatgtttcggataccgttgcctatcagaaagaagtgaatccttatactaaaggacttcccaaagaagtagaagcgaaatgggaaaaacgttatcttgatttctttggcttgtttttaaagcataaagataaaataagaagagtaaccttatggggagttactgataaacaatcctggaaaaacgatttcccggtaaaaggaagaacagattacccgttactgtttgacaggaaagaccaggaaaaacctgtagtacaaaaaataataaaattggcagagaaaaattaaaatcaatagaatttttacttaatgaaaaaatcaaaatatttattcccggaagattatatggcagacccttccgttcacgtttttgaagataaaatctatatttatccttctcacgaccgcgaaagcggaattgaagaaaacgataacggggatcactttgatatgaatgattaccatgttttctcaatggatgatgtagacagaggagaaattaaagatcatggcgtagtcctttcggtaaaagatattccatgggcgggaagacagctttgggattgcgatgtagcctttaaagacggaaagtattatatgtactttcccctgaaagatcagaatgatattttcagaatcggtgttgccgtgagcgacaaaccttacggtcctttcatccctgaaagacatccgatgatgggaagctacagtattgatccctgtatttttgaagataaaggtaaatattttatgtacttcggaggaatctggggcggacaattacagcgttacagagataataaagcacttgaatctgctgtaattccagaaaatgatgaacccgcaatccactcaaaggtagctttgctgagcgatgatatgcttgaatttgcggaagctcctaaagacgttgtcatcattgatgaaaacggaaagcctctgcttcatggtgacaaacaccgtttttttgaagcatcatggatgcatcagtacaatggcaaatattatttttcttattcaacaggagacacccacttgatttgctatgcaaccggggataatccttacggtccgtttacttttcagggagaaattcttactccggtggtaggatggactacccatcatagtattgtggaattcaaaggaaaatggtacctgtttttccatgattctgttccgagcggcggtaaaacatggctgagaagcatgaaagtgattgaactggaatacgatcatgaagggaaaatcaaaacgattgaaggtctggaagaccagtcatagtcatctgtaataatttaaaatttttcaatgcgatatctgagactcaatattctattttttctgatatttcctttgctggtttttgcggaggacggaagtcaactctggcttcggtttcctgcaaaaaacggaatatcggcagataaaattatttccaaagggaacagtcccacgctgaacattgccagaaaagagctgagcggccactggcagggacaggcggtggaacttcgtacagaaaacaaagagaaaaacctgaaagacggctacaaaattgtttccacccctgaaaaaattgttatttctgcaggaaaagaaataggactgttgtatggagtctatcatattttgcgattacagcagacaaaagctgatctgtctcacttaaacacgattgaaaaaccttcatatgatgtaagaattctgaatcattgggataatctggacggaagcattgaaagaggatatgccggaagatcactttggaagtgggaagatctgcctggaaaaatttcgtcgcgttatgaagaatatgcaagagccaatgcttctgtaggaatcaattccgttgttttgaataatgtgaatgcatcacccaatatgcttagggaagattatcttaaaaaagtaaaggttctggccgatatttttagaccttatggcatcaaggtatatctttccgtgaatttttcttcacctaaagtgctgggtggattacaaaattcagatccattgaataaagatgtacaaaagtggtggaaagataaagcagctgaaatttacagattaattcccgatttcggcggatttttggtgaaagccaattccgaagggcagccggggcctcaggattacggaagaacccatgcggacggagccaatatgatggctgatgccctcaaaccttacaacgggatcgtcatgtggagagcctttgtctacagtccgagcaaagacgacagagccaaacaggcttatctggaatttgttcctcttgacggtaaattcagggataacgtaattattcagattaaaaacggacctgttgatttccagcctcgtgaagcgtttaatccacttttcggagctttaagaaaaacttctgaaatggtggaatttcagatcacccaggaatatctgggcttttcaaatcatctggtttatttggctcctttattcaaggaaacgctggatagcgacacttattctgacggccagggttctacgattgctaaaattacagacggcaccttaagacatgcaaaattgacagccatctctgccgttgccaatatcggggaagatacgaactggaccgggcatcattttgcacaggccaactggtatgcatttggcagattagcatggaaccatcagctgagctcagaacagattgcagaggaatggattaaaatgaccttcacagatgatcagaactttctgaatccggtaaaggagattatgctttcttccagagaaactgctgtggattatatgatgcctttaggattgcaccatatctttgcgggaggacatcattacgggcctgaaccgtggggcgattataaaggcggaagaccggactggtcacctgtctattatcatcaggctgatgcccagggggtaggtttcaacagaacaaaaacgggaagtaatgctgtttcacagtattttccaccactgaatgaaaggtatggaaatatctcaacctgcccggaaaatcttattctttggtttcatcatgttccatgggattatacaatgaaagacagaaaatctttgtgggatgagctgtgttatacctatgattccggggtgaagaaggtaagggattatcagaaaacctgggatagaatggaaccttatattgatagacagagatttaccgatgttcagtcaaaacttagaattcaatctaaagatgcagtctggtggaaagatgcgtgcctgctgtatttccagactttttccaaaaagccaattccttatgacattgaacggcctgttcacgaactggaagatctgaaaaagattaaactgaacatgggccatcacaattaaaaaatgaggcagctctttttctgttaggaaatggagctgcctcaaaacaataaactgtaagtaaaattttaatccaaaataattggaatgatcgataggtcaatctatctgtatatattccgttttatcggagagaaattatcttattaaaaacatttccgttttcttcaacctggatgatgtattgatctgctgttttaggatcaagatcaaaagtgatatccaccttgccgtcagcatattttttgttcgaagtataatatgttgtattggaaagatcataaactgaaatgcttacaggtccttttacatcagacatgtgaagcttggccatatgaccggaaatagtatattcaggcttatgcacagcgcttacaggtgttttttccacctccattacattatcagcattgattttaatcttgtatttctctatcttcgcttctgattctgctaccagataatacgttcctggtgtaaaactttgaaaatcataagtcttcatcacatgatctccatctgcaagattttcggaaaatagctcgtcatgtgcagtgttatagacaaaaacagaaacacttttagcatttaaaagctcaaaattcaaggttttgtcttgtacgtttccaaaggaaagggaaaaatctctgtccttactcattacatttgctgaaaacaataaggctcctgcaaaaaatacggctttaaataatgtgctcatgggttaaggcttttaggattaatactgcaaagctatggcagcaatacttctcaggctataattaaattttcatattgatgtactatattaactttgtttaatgatattaatgtattatttgttaattttgcatatgaaattatttgtgtttggcctatgaaacatgtaaatccttcttttgaggccgtaagacctactataggaagcagttttaccagtcttaaatttctgactaatgagaatataaaatctcatgtctggcattaccatcccgaggttgagcttatttttgtatgcaaaggctccgggaagagacagatcggaagcagtatcacttatttttcagaaggagatcttgtattgataggaagcaatcttccgcattgcgggctgaccaatgaaagtacgcataatgagtacgaaatggtaatccagtttaagcctgactttctaggagaaccgatctgggatattccggagatgcaaaggatttcagctttgctggaaaagtcaaaggcaggaatcgtattcggggaagaggtgaagaaaagaatcgggaaagagattacggagatgcatgaagcttcctcactggacaagctgtgcagatttctgaaaatattggatgaactttctgtgactcaggattacaggattttaaatgcaggaaaatattaccttcagacacaggttgaagacaatgaaaggatcaatcttatattcaattacgttaaagatcacttcaaagaagccataaccctcgaagaaatggctgatcttgccaatatgaaagtaccgtctttctgccggtattttaaaaaaattaccaataaaacctttacacagtttgttaacgaatacagaattacccatgctctcaaacttttggcagaacagcctttgagcattacggaagtctgctttgaatcagggtttaataacttcagctattttaacaggacttttaaagaatatatccaaaaaagcccctcacaataccgtaaagaattcaattattttatggagtaattcacagttgggtttaaaaataaattgctgttttggaatgtattgaaatataagtgtatatttaacacttataaacaatatttacaaagtataatttctctgttataaattcagtagttttatacttaggatccccaggatctgtttgatcagataagattgatatgcatgaacagttaatcaacccaaccctagaaaagtttaggaccgaattcaaagaagagcctgaacatattttcctttctcccggcagaattaatattatcggcgagcatgtagactatagcgatggcttcgtattgcctgctgcgatagataaatacatctgttttgctgtccgtaaactccctcagacaaatctttgtaccatcatagccaaggatctcggagaagaatatacatttgatgtcacagcggagataaaaccggtacggcaaatgtgggcaaactatattctgggcgttttcagtcagctgcagaaacccgaaaatcaattttgcggaatggaaatagttttcagtagcaccattccgatgggatccgggctttcctcttcggcagctcttgaatgtgggtttgcctatatccttaatgaactttttgatctgcggctgtcaaaaaaagaaatcgcggtgatcgggcaaaaatccgaacatacttttgcaggagttcagtgcggaattatggatcagtttgcctccgttttcggaaaggaaaataaggtcattatgcttgattgtaattccctggaacatcaatattttgatgctgaactcaagggatacagcttattgctttttgacagctgtgtaaaacatagtcatctgacatccggctataacgaaagacgcaaagatgttgagcatggaaaaaaagttttatgggaaaaattccccgaagtagagaagttccgggattttaccacaactatgcttgacagtgttaaagagaaaatgggaagtgtttcacataaaagatgtctctacttactgaaagaaataaagagggtagaaatggcggcaaaagctatttcagaaggaaatgttgagcatctgggaagacttctcacggaaactcacgccgggctgtccactgaatttgaagtcagctgcgaagaacttgattttttggttgaaaacacattgcagcaggaaggtgtgctgggagcaagaatgatgggaggcggtttcggaggctgcagcatcaacctgattcaggaagataaagttgaggaagtaattcaggctatcagtgaaaaatatcttgaacactttaatattgagatgaaagtttaccaggttaaaatttcagacgggataaaagaatacaccaatgaatacattatttgaccctaaaaaacatccccacagaagatacaatcctcttttggatgaatggatactcgtttccccacaacgggcaaacaggccatggcaggggcagagagaagaaacagtaacagaaaaccgtcctgaatatgacccggactgctatctctgctcaggaaatattcgtgctaacggagaccgtaaccctgaatataaaggaacctatgtctttaacaatgactttggagcattgctgaatgaagaagttgatttttctgagcaacagtcaggattttttactctccttccggaacgaggaatcaacagggtggtttgtttttctgaaaaccacagccttactttgccggaaatgtctttggaacacatcaaaaatgtggtggatgtatggcaggagcagttcaatgagctggccactctggaccatatcaactatgttcagatttttgaaaataaaggaagcattatgggctgcagcaacccgcatccgcatggtcagatatgggcccagtcgtccattccggcaatggttcagaaaacccaggatcagctgaaatcgtattttgaaaaaaataaaaggacattgctggaagactatcttcggcaggaaatcacggctggtgagcgcatcgtcacagaaaatgaacactttgccgcattggttccgttttgggcttcgtggccttacgaaacaatgattgtcagcaaacagaaaagagaaaatattgcggaattttctgaagcggaaaaagaatcttttgctgctgtcctcaaggatctgaccacaatatatgataacctttttaaaacgtcatttccttattctgcgggaattcatcaatctccaacagacggaaaagagcatcctgaatggcattttcatatgcacttttatccgccgttgctcagaagcgcggaagtaaaaaaatttatggtaggatatgaaatgcttgcagagcctcagcgggacattacccccgaacaaagtgccgcaatattaagaaacctttccaccattcattacaagaaaaaataataaatcaatatctttgaaaagaataagcaaattatgattctgctatgtacagaattacgcttttcccaataaaattatggaacagattaaattaattgtgacggacatggatgggacgtttcttaactccagccatgaaatgagccctgagttttcagaagtttataaagaactgaaaaagagaaacattgtatttgtcccggcaagcggaagacagatgccgggcattacccattatttcggagaaatagaaagtgagatcggttttattgctgaaaacggaggatatgttatttataaagaccaggaacttttcgctgatacgctggaatacaaatatatcgttgacatcattaaagcggtccgtgaaatacccggtgccaaagccgtattatcagccaaaaagatggcgtattacgaaaccgaagatcagcagtttgtggattttttctcaaaatattacaccgaaaacatgaaaaaggatgacctgacggaaaaaattgatgataccgcctttaaaatagcagtttatcatcctgaaggttctgaaaaacatctgtatccggctctgaaaaaatttgaagaattcggtctggaagtagtggtttcaggagcgtattggctggatgttatgaataaggacatcaataaaggaaatgctctgaaaatccttcagaaatcgttgggaatctcacctgaaaatacgatggctttcggagactatatgaacgatattgaaatgctgaagaatgccaaatattcttacgctatgcaaaatgcccatcccaatgtaaaacaggtagccaattttgaagcatgcaccaatgacagcttcggggttctgaaaaccattaaagattatctgcatctgaattaatgcatccaaataacaccaattaaactaataatatgaatacatcaaccggaagaaagcccgctaaggtttgctatgagcacatcggcggaaaattaggacagcttctcttggaacagttcgttgagaaaggctggattgccaaggaaaatcctgcagaccgtaactattatattactgataaaggacaggaagaatttacaaaactgggtattgatctgtcacaaataaaggtagaataactttccggtattgcaaatagtatatatttaaaaatcagactcaggtctgattttttttgtttttaatcgtgggaaatttcaatttagatttgtactgcatgctttttggatggtttccattgttaaattttatatgttttttatataaaaggtaaagggtaaatcataaaactacgatatttcgtagtataatttacaaactgtttttaataatatattgaaaaccaattactttattgttttgggttattttttggcattatgctcataagtttaattcaaaaaatactacaacaatgagcacattaacattaaaagacggaacagaaattttttacaaagatcaggggcagggacctgtattaatgtttcaccacggatggcctttatcatctgacgattgggatgcacaggtgatcttctttttacagaaaggctacagggtaattacccacgacagaagaggccacggacgttcaagccagaatatttataatcatactattgaacaatatgcttctgatgctgcagaactggttgaattcttagatctgaaagatgtcgtacacatcgggcattcaacaggtggtggtgaagtgatccggtatgttaacaaatattcaaacgggagagctaggaaagcggttctgatcagtgccattccaccggtgatggttaagagtgaaaacaatcctgacggtgttcctatggaagtttttgacaatatcagggaacagacgatgaacaacagaaaccagttttattacgaccttactattcctttttacggctacaacagagaaggtgctgatgtaaaagacggaattcagagaaactggtggagacagggactgatgggtggaattgttgctcattatgatgggatcaaagccttttcagaaacagatttaaccgaagatttaaaagctgttgatattccggtattggttcttcacggtgaagatgaccagattgtaccgattgaaaattcagcgataaaatcagccaaattactgaagaacggaaaactgataacgtatcctggtttccctcacggtatgccgactacagagcatccaaccatcaacaaagatattttagcttttatcacagaataatcagcattctttaccaatgaatacgatacagccagcttttgatacgttgactgaggccgttcagtggcttaatcaaaacggatatacagaagattttaaccttaaaaatgattgcatcaggctcaataattttcttgatgtttctccggaagactttaaaatacgatatacattccgctttgaaggagataccgatcagggagatgaagaagtagtctacggcatcgcttccgacaagtattctgtaaaaggcatcctgacgagcgcttacggaatctatgcggatactgtaagtacagaactcatcagaaaactatcatccaattaacttaaccccaattatttaataaaataaactttatgaaaccatcatcaaaactcctttcccctgaaaatcatgcactggtactgattgattttgaaggacaaatggcatttgccaccaaaagtatctccatgaatgagctgcgtaataacgttgcggtactgtgtggtgcttctaaaatatttaatgttccgaccatcgttaccacagttgctgaacaaagtttttcaggtcctgttttccctgaaattgaggaagcatttcctatggcaacctcaggatatatcgacagaactactatgaatacatgggaagatgaagccgcttataaagcaattgtgggaacacagaaacagaagctggttttcgcaggattatggacaggcgtttgtattgtgggtcctgcattatctgcgcttgaggaaggctatgatgtgtatgtcattaccgatgcctgcggagatgtaagtgatgaggcgcacgaaagagcagtacagagaatgatccattccggagtaaagcctatgacttccattcagtatatccttgaacttcagagagactgggcacgtcaggaaacatacggtcctgtaactgaccttatgaaaaaatatggtgcttcttacggattagggatccactatgctcaccatatgctgaaccattaaaatctatataccattttcaatgttgaaatctgcaccttcaatactgtttttaaaagcttttttcataacagttcttttatgttctgaaacgttctcatcccagagctttaaacttctgcggtatgacgaaaattatgaatatctgaaagattccaccaaaagcttttatgataacattaaatatctccctctcaatgaaaaaaaagatatctatctctcattgggtggtgaggcaaggtatgaatatgtggatttcaacaatgaagattggggaaggcttaagataggacacaacgatttttttctccaacgttatgaccttcatgcagactggcatttcgggaaaaacttcagaatattttcacagatcagaagtgctttacaaaacggaagaaaaaacggttcaagaggcattgatgaagatcagctgagtattcagaatctctttgtggatgcaggtttggtgaataaggaagatcagaagctgatagtgagactgggaagacaggagctggactacggttccggaagattaatttctgtaagggaagggccgaatgcaaggctgtcttttacaggagctaaaatcatgtattcctataaaaatgtttccgtagatgcttttgcaatgatggcagactctgtcaagactggcgtttttgataataccctttcaaagcagcttaatctttggggactttattccaaaatcattattcctgaagccggaaatctggatctgtattatctcggaatccgtagagacgaatctgtttttgaagccggaacagcaagagaaaagcgccatacagttggtggaaggttgtggaaatatggcggtggatttatctataacctggaagcggcctatcagttcggacgctttggaaacgaaaagatcagtgcctggacgggatctgtagatatcggttatctgtttgaaaatcttacattcagcccaagcatcaatctgagaaacgattatatatcaggagatcattcaaaaaacgacggcaagctcaatacctttaatcctttatatccgaaaggaggctatttcggcttcagtccgcaggtgggtcctgtcaatttaattgatattcacccatatatgacccttgatctgacttccagactcaaaatgcagatggatgttgtcttcaactggcgatattccctgaacgagggagtttaccggccaagcggagcattgaaccgtcccggaagcagttcagataaaaggtatatcggaacggcttatttaaccagctttacctataatttcaacaaacatttctctttggtgagcggacttcagtatttccacaaaggatcttttattgaagatatcattcaggatgcaaaaagcggtgttttctggaatgtccggctgggattcaaattttaatcattactaaatcatttattatgcaaaattcaatttcaaaatacatcaattggtcaaaaacactctttacagtattggtgttggcaactgctggaacccaattcgtttcagcacaggctgctgcagaaaaaacagctattggaacctcaaaaacatggggaactgttgacggaatttctgttgtagggctggtgcagggaccttctgctgccaaagcagatttacagatcgcctgtgttttcgagtatacggaaggagatatttttaatccgccggcgcttcccaaagaactgaacggaatggttcatctggatgaggcactcaaagggattattacagaagtccgtaaaaaaggacagttcaaaggacacgctttggaaaccttattaattaatcctccgaaaggaagccttgcctccggaaaactgctgttgatcggcctggggaacagaaattctttcgatgccgagcttatgaaagaagtaggaagtgttgcgatgagagaagctttgaaactgcaggtacataccgtatcatttgccagcgatatcaaagatgcaggaatcgattctccaaccgctttagtggcagaaaatgtggttttgggcgcttttgacgcctatcgtgcccagttatatttaaatagtcagcacctatccgacaaaatgaaattaaaaaaactgattctgctggccgggccgtcatttttcaccgttgccggaggaggaattcaggatgctatttcgaagttgaacaccaaataattacaaatgaaagcagatcttatcgtatacaacggaaaaatacacactttcaataaagaaactccggaagtttctgccgtggccattaaagacgggaaaattatcgcggttggaaatgacggactggcagaccggttcgcagatgaggccacaaggctgattgaccttaaaaagaaaagagtagtaccgggaatcaatgattctcatatccatctgatccgtggcggattgaattacaacctggaattaagatgggacggagttccgtcactggccgatgcgctcagaatgttaaaagatcaggtagaccgtacgccttcaccccaatgggtacgtgtagtgggaggatggtccgaattccagtttgcagaaagaaggatgccaactctggaggaaattaatgccattgctccggaaacacctgtttttatcctgcatttgtacgacagggctttaatgaacagggcagcattgaaagcggtaggatttactaaagataccccggctccggcaggtggacatattgaaagagatgctaacggtgaacccacagggctgattattgccacacctaatgccatgatcttatattcaacattagcaaaaggcccgaagctttcttacgaacaccagctgaattccacaaggcattttatgacagaactgaaccgtttcggaattaccagcgttattgatgccggcggaggatttcagaattttccggatgattatcaggtagtgaacgaactgaatgagaaaaaacaacttaccgtaaggatcgcctataatctttttacccagaaacctaaacatgaatttgaagatttcagcgattggatcgacacggtaaaattatatcagggcgatgatatgtaccgccataacggggcaggagagatgcttgtattttcggcggccgattttgaagattttctgcagccaagaccggatctgcctgaaaacatggaagcagatcttgaaaaagtagtccgtttactggtagaaaaccgctggccattcaggcttcatgcaacctacaatgaaagcatcacccggtttttaaatgtctttgaaaaagtaaaccgcgacattcccttcaacggtcttccatggatttttgatcatgcggaaaccattgatgaaaaaaatattgaaagggtgaaaatgcttggcggcggaattgccatccagagcagaatggcttaccagggagaatattttgcagaccgttatggttctggcgccgcagaaagtacaccacccgtaaaaaaaatgctggaaatgggagttcctgtaggcggaggttcggatgccacaagagtaagcagctacaatccgtgggtttccatgtactggctgaccgcaggaaaaactgttggcggacttcaattataccacgaaacaaagctggacagagcaaccgcattagaactgtacacaaaaggcagcgcatggttctctcaggaacagcagaaaaaaggtgatatcagagtaggaatgtttgccgatctggcagttcttgatcaggattatttcacggttgatgatgaagagatcaaaaatattgaagcggaaatgaccattgtagacgggaaaatagtctatgccaaaggaacattctcatcctatgcaccaccatctatccctgtgcttccggactggtctcctaccaatctttataacggatattaccctgcaggcggacattttcagaaagaaattgagaaaaatgcaaaacaggatctaaaagctcctttagcttcacaaattcatagctgtgcaggaagctgcgatatccatcatcataaccataaccaggcaagaatgagcaatgtgcctgttaataattaccacacattctggggagctttaggctgttcgtgctttgctttttaactatcaatacatatggaaattttaaaacagatcctttcatcagatttaggttcaccattcaatgatgcttcattcctggttttccgggtactcattgccattcagctgttcagagtgcatggtttaaagaaattcaggctggaaaacggacaaagggaagtcattcccaatcctctgggattgcctgatcaactcaatgccatagtcgcttcatttgctgatctggtggttccgtttctgattattttaggattgggaaccaggcttgcagttttaccgaccattggtgtgacggctatcggatattttgtagttcacagaaaagattcactggaagtacgggatgttccttttatgtacaccctttccctgttactgattcttacattaggggcaggaagatattcacttgattattacttattaaatattttataaaatgaaaacttcaatcggaattaaaaacgaaaatttagcaaaagttgctgaagtactggttaccactttagcagacgaatttgtattgtataccaaaacaagaaaagcacactggaatgtggaaggaccggatttttacaataaacacctgtttttcgaggcacaatacggacagctgaacgacatcatcgatgatctggcagaaagaatcagaacgcttgggcattacgctccggctactttaagggaatatcttgcattaacccatttgtctgagaatcatctggaatcgaacgacagcctgacttacatcagagcacttctttccgaccatgaaagcatcatcattcatcttcgtgaaaatattgaaaactttgctgttgaattccgtgattcaggaacaagcgactacatcacaggattacttgaagctcatgagaaaatggcctggatgctgcgctcacatttaaaatagaagcatggaagtaaaacataatatcggttttgtcaccttattgttaaccatgattgccggatattgcgataccgtgacttttgtatcggcagacgcccttttttcggcgcatgttacgggaaactttattgtatttgcctatcagtttgtgaaaggatcggatattcatgcctgggtaaagctgcttacgtttccggtatttattcttgcggtcatggcaggagggaggattgccgggaaagtcatcaatcattatacgctgttattctgggaaggagcgctgcttttgtcggccggaattattgttgtcgttttcagttactatggaacattttcagaagtcgtgatgtatactgtggctatgattaccgtttttgcaatgggacttcagaatgctttcggaaaactttatgcaaaagaaacccatggcccgactaccatgatgacaggaaatgtaacccaggcttccctggatttcggtacgcttctgtcaagtggctttcaccaccctgaagcatggacaagcctgaagaaacagctgattaccattcttggatttctggttggttgttttttaggggcttatgcaggaaagcaatatgggctggtaacattgattttacccggactggcaatgattatctgctatttttaccaccgtaaaaactagcataggactatggcagattacaggataatagattacctttaaaaaatgaatttcggcctttattttttatctaaaaatccactaaggatagtatttttttcgttggttttgatgttttcatgcaatacaaaagcacagatccaggaaaatcctgcactgttgagaaaacagatttcctcttccaccaatacgattcagaaaatcactttattactgcgtttgagtaactattacattactaaaaaaggagagttgaaagctgacctcgacagtgccgctattctgaaccaacaggcaaaagtactcaatatgaaatccggggatccgttgtctgccggaaaactcatatttctggatgccaaaatagataaagaaagaggccgtaaaacgattgctttttccaatatgaaacaggcgctttcttattttgaaaaaaatcattttaaagagcaggccggagaagcatacaatgaattatcatatatgtatgacaataaacccgaatattttgatactaaaatcaaactgaaagaaaaagcattggaactgtttaagaattcaggatcaaaactgaatcaggcaggcattttaaaagatcttggtgagctttattacatcaaggaaaatgctgataaggctctgggcttgctcagacaatcactgtctgtttatcagtctgtgaaattcagaaaattgcagagtgtgtacaatcttatttcgcaggttgaaattcagaaggcggattatgaggaagcgctccgctatggtcttttagcagaaaaaacagccgaaagtgtgaatgattattctttgcagatgtgctctatttacagcaatatcggaatggtgtattattatctccgtaagaatgacgatgccatgaagtattgggaaaaatcactggccacggcaaagaaaaacaaagataacggctatataagaacggtagccaataatatttctacgatgctgatcaggcagaaaaagtttaagcaggctattaccatgattcaggaatacagagaaaagtatcctattgtagatcagaattttgaaatgtcagagaattatatcctgttcagtacgtacactattctaaagcagtttaacgaagcggaagcctactacaaaaaactggtggcctattatggtgaaaatgcggaaaaaaataaccagcaggcctctttgctgcgaagctttgttttctatcactaccaaacccgggactttaataaaatgtatcgtgaagccagactttttgattcaatagccaaaaataacgggaatgatatgcttcgttcggaaaatcatttaatgtggttcaaagcagattccatacagggaaaataccttgatgccatacagcattatcagctgtacaaaaaactttccgattctgtttttaacggtgaaaaaagcaagcagatcaacagccttaaaattcagtttgaaacagagcagaaggataaaaacattcagctgctaacccagaaagcaaaactgcaggatattaaaattgcgaatgatacctttatcagatatgtcttcatcggaagtattctggcgctgatcctttttgctgctttgctgtataaccgttcaagattaaaaagcaatgccaataaaaaccttgaactgaaacgtaagcagattgatgagcagaatgagcaactgaagaaattactttctgagaaagaatggctcttaaaggaaatccatcacagggttaaaaataacctgcagattgtgatcagcctgctgaatacgcagtcggcttatctggacaatgaagatgccctgatggctatccagaacagccagcacagaatgcatgccatgtctctgatccaccagaagctttatcagtctgacaatctttcaatgattgacatgtcgtggtatatttatgagctgattacctatatcaaagaatgttattcatctgacaggaaaatcaactttacagtagataccgataaagtgtttcttgatgttgcacaggcagttcctatgggtttgatcgtcaatgaagcggtcaataataccgtaaaatatgcttttccggatgaccggaaaggggaagtttttgtttcattcaaaaataccggtgaagatctttgtgaactgatgatttcagataatggagtagggcttcccgaagatttcaatatcgaagaaacagattctttggggatgaatctgatgcgtggacttaccgatcagctggacggaacctttcatctcgaaaacaaagggggcttaaaagttacgattaccttcagaaaaaatacagaaataactccttcaaattaaaggctgattattatgaaagaaaaaatattaattgtagaagatgaatttattgtagccaatgatctgaaactgatgctgatgaaagccggttatcaggttacaggaattgcatcttcagtggttcaggccagaaaactgattgcagataataagccggattgggtgcttcttgatatcatcttaaaaggtgacctcacaggaatcgatctcgcctgggaactgcgtgaaatgagcctgccttttctttatatttcagccaataccaaccagtctaccctggaagcagtgaaagaaacacagccttacggatttatggtaaagcctttccgggagcgtgatatgattgttatgcttgatattgccagataccgttatgatatggaaagaggctgtgaattgtgtactgataccggaaacaatgaagtcattgaaggaattatcgggaaaagcaaggtacttcaggatgttgttgaaaaaataagagtagtagctcctacagatacgtctgttctggtggtcggggaaagcggaacaggaaaggaaaaagtagcccattccgttcatgagctttcagaacgtaaagcccatcctattgttgtggtcaattgtgctgcactgccacatgcgcttatcgaatccgagcttttcggacacgaaaaaggaagctttaccggagccaatacattgaggatcggaaagtttgagcaggccaacggaggaaccgtcttcctggatgaaataggggagctgccattagattcacaggttaaactgctgagggttttacaggagaaagaaatcgaacggctcggaggaaacaacactattaaagtaaacgtaagaattgtggcagcgaccaaccgttctctggaaaaagaagtggcggaaggaagattcaggctggatctgtattaccgattgaatgttttcccaattgaactgcctccgctgagagaaagaaaggaagatatcgtcttgctggcccattttttcctgaataaatatgccgctgcttcaagaagaaatatcacatccatcagtgaaaaagcactggaacagctgttaaattatcactggcccggcaatatccgtgagctggagcatcttattgaaagaagtgttcttctggccaaaaccacagaaatagaaagctttgatctgccaaaaatcgttgaaaaacctacagaaacacaagggccgctgaaatcattggaagatatggaaagagatcatatcatgagtgcgcttcagacttccaaaggaaaagtttccgggccgggtggtgccgcggagcttctgaaaatacaagctcagactttatattccaaaatgaaaaaactgggaattgacaaaggctataaataatcccggggaaagctagccggagaccctattttcttacaattttttaattataattcttcaaataattggaggatacaatcatcatgtctttacaatattaaatcaatcaggtaattatggaaaaagaaacgctcagaatagaaggattcagcgatggtgtttttgcaatagctgttacgcttttggtgctggatcttcactttcctgaagaacattcaatacagaacgggaatgatctgctggtctttctgaagaatcaatggccggcgtttctggcatttatcctttcatttttcagtatttttatcatgtgggtaaaccatcataagatcttcaaacagatctacagccggaattcagcgattatgtttgccaatggactgatcctttttctggtttcagcagtttcttatcctaccgctttgctggcaaggtattttgatggtgaagcttcctcagttgttgtggcactttataccggtatttttgttctgatcaatcttgcttacaatttattatggtttctggctacccgtaacaaaaaacttttacgcccaggtattaccgatgctgctataaaaaagatccataataattatttatatgggcttcccatctatgttattgcattaatcctgtcgttctggataccggcagtttctttgatgatcattttaggactctggattttctgggctttgtcttccgggaaaatagaaatggggcttgacaaacattattcagattccctgaaataatgttccttctctattccaagtttctgcattttggaaataagcgttgtcggaggcaatcccagtagttttgcagcgcctgtttccccgaaaatacggccgttacattttttgattatttttaaaatatattccttttcaaattcctgaagcgttttaacctgaacatcctgatctgtattttgagcgttcataactttcggaaaatccatttccctgatcatatctccttttgccgtcagcatgcttctttcaaccatattttccagttcacggatattacccaaccatggattagcaatcatcattttgaccacgttctgagaaaaaccattaatctttttgcctgtcttaggatagagtttttcaaggaaatagtctgccagcaaaggaatatcctcttttctttcccgcaaggcaggaagatggataggaaaaacattcagcctgtaaaaaagatcacttctgaaccggccttctgccacttctttttcaagattcctgttggtggccgtaatgatccgcacattcaccttaatccttttgtttccgccgattctttcaatttctttttcctgaagaactcttagaagcctggcttgtaattccagaggcagttcgccaatttcatccagaaaaatggtgctgttgtgggcctgttcaaactttcctttccgctgttcggttgctccggtaaaacttcctttttcgtgcccgaaaagttcggattctattaagttggcaggaatagccgcacagtttatcctgatcatcttctttcccgaaaattctgaaagttcatgaaccgcctgtgctataagttcttttcccgtgcccgtttctccatagatgatcacattggattgcgatggagctgcctgtgagattttttcgaaaatgagctgcatggcttcgctttgccccacaattccatgaaagccgtgcccgtttttcttttcttcttcaacttctttcggaaaattccggatatttccctgaaatattttcaattgctcctgaacatccatattatgaagggtaatggaaagctgggtagaaatgccgtttaaaattctttccggaattgtatctcttgaaataaagcttttgtagaaaaggaaaagtacatttttactttcactgacagccggcagtcccagtccgacagccatccgcattcccgaattttttgcttcggtaaaacaggaaggaagcggtgacagttctttcagatcaaaaagcagtggctctgcggaatcaagacagttttttacatacctgtcaagctgttgatctgtggtatggttctgattttcaatccggctactgagtatttcaatagttcctttatcatctctgatgatcatataatcattgaatcccagttcagttttgaaagatgtgttgataacaagctgaagctgtttcttatctaaaatggtagacaactctttggttaaacgggaaatcataagctgttctttctgcatttcctgcaggcgttttatcatttctgcattgggatcagaaggcttactcatagaaaattcttacttgaaagtttaaagataggaaaaattgaaaaagatttgcatgtgagtggttacaatacctgaaataaaaaagatgaaccattaaagttcatcttcaatacatttaaaagagatcgttttttaagatctgataaattccaaaaggtctttgttgatggttggatgctctgtagtcggcatcccgtgagggaatcccggatacgtgatcagttttccgttctttaataatttaattgattttaatgcagcattggcaatgggaacgatctggtcatcttcgccatgcattaccaaaaccggaatgtcaacagcttttaaatcttccgttaaatctgtttctgaaaaagctttgatcccatcataatgtgccacgattcctcccattaatccctgcctccaccagtttctctgtacgccgtcttttacatcagcaccttctctgttgtagccgtagaaagggaaagtaaggtcataataaaactggtttctgttgtttagtgtctgttccctgatgttgtcaaaaacttccataggaacgccgtcaggattgttttcacttttcaccattaccggtggaatggcgctgatcagaaccgctttcttagctcttccattggaatatttattcacataacggattacttcaccacctcctgttgaatgcccgatgtggacaacatctttcagatcaaggaattcaaccagttctgcggcatcagaagcgtattgctcaatagtgtggttgtagatattctggcttgaacgcccgtgacctcttctgtcgtgggtaaccactctgtagcctttctgtaaaaagaagatcacctgtgcatcccaatcgtcagatgataaaggccatccgtggtgaaacattaatacaggcccttgcccctgatctttgtaaaaaatttctgttccgtcttttaatgttaatgtgctcatgttgtttatttttaatgttatgaattgatttttaaatatttttctgattaataggctgtattttctcgtaccaactgaaaaagatcttctgcaccgccgttgaatttatttccgttaatgaaaaaagaaggtgttccgtttacgccgctgatgatgccgctttcaaagtctgtatctactttttctgccagttcctgcttatggatatccgctttgaactgagggatatttaaacccaatttttctgcaagttttaaagggagaccgtcattaagaaattcctggttttcataaatagcatcatgcatttcccagaattttccctgcaaagctgccgcttctgctgccagcgctgccgttcttgcatactgatgcatttctgacagcggaaaatttctgaagacaaatctgatctgatctccgaattccttcattaattctttaagaaccggataggctgctccgcagtaaggacactgataatccccgtattctacaatgactaagctggcatctgagctgccctgagtatggtcagcattgctgactgatggtttaagtgacataattattttgtgttaaggttttctaatgcttctaaaattctgtctgcgccaggattgatggcggtgggagagaggtagctccattcgatgagaccgtctttattgatgacaaacagggctctgttgcattctccttcttcgtcattgtaaacaccatatttcctggctgtttctcctttggcttcaaagtctgcaagcagtggaaagtgcaggtttctggattgtgaaaatgccagatggcaccatttgctgtctacggaaatcccgaaaatctctgcatcatattttttgaaatacttcagcatttcgttgtataatgccatctggtcactgcacaccgggctccagtctgccgggtaaaatgcaaggataacgtttcgtcctctgaattcggataaggtaatcttctgatccggggttgcaaataatgtaaaatcaggggcaaccatatttttttctagcataggattagtttttaaatgttggaattggtactgtaaatgcacagatgagcagtaaggctgccggaaagatcagtgtccagtttcctgaataaaagcacaggaaaggagctgctgaagcaccggagagaaagcccatccataagaataacaaatgaaagatatttactttgtattccttccgctcctctgcgtgatcactcatgacaaaaagagcagctgttcttgccaggctgtttaaagttcctgtcacaaaatcggtgttgatcttttggttacctaccgatgtgacaatggtgttcataagacccattgagaagccgataacagctatagacacttcattggcaatatgctcataataatcagtgatactgtaaaggatcatgatgccggaaactgtgtagaagatcatctttgtgcttctgagcttctttgacaatgatagacacgttcctgtataaatccccgccagaaaaaagctgattacaatgacagaactgatgataatatcatatttttcactgaaaattgctgcacctaactgggtcgtattgccgctcataaaagaaacgtaggttttccattgtatcagccctgtagcatctgtatatcctgcgataaaagcaaggaatactgccagtttctcctgtgttctgacggtcttgtcaggaagcaggatttttgtttccggaagcacaggagttattttccaggtttgatgaatactttcttttccggaaatttttctatttctccttccttcaatccgaaattggtgatgaccacatctttagggtttcctgccaaccactcgctgatatcaatggattcataggtgccgctgttaaatccgatcaatactttacagacggtatctccggtatttttgatataatgcccggctcccatagggacatagcctacatcaccggcattgaactgttctgtgacagaaactccttccgccaggaataccgacatttctgcctgtccggatataaaatactgccactcatccgcattcggatgccagtgcatttctcttaaagctccaggttgcagctccagtacagaacctgccattgtggtgctgatcggaaattccttacttgtaaccaatctttggagccctccgccgggaatgattcttggctgctgggaatgcagaggatagcggtgaaggcttgtcagttcaatgtctgattcctcaggacgggctgtggcattcaccgagagttcgtccggaacaactcctgctgcaaagtaaacttctttctgaggaagttctgctacttcttcaaggcttagtcctaaattctgtgcaacgatttcaggaggcatacttgacacaaaatcggtaacgctgaaggtatggtcttccgaaaaattaccgttgtcgaaaatcaaaataaaatggcattcctctgttccggtagcctggatggaatgtccgtagcctttcgggaaataccatacgtcaccgggttcaaaattgtcagtataactctgtccgtccggatggataatcgttgtacgtaccgttcctgaaatcacatacgcccattctgcggcgttggcatgccagtgaagttctctcatacttccgggctgtaatctcatggaaactccggcaatgcctacagaagcagggaattcctttacagaggcacctcttgttgtaccaccgtcattggtacgcggttcttttttttctaattcgtatctgaaacttaatgatgaaggattcatagtattattttttgtgattaatgctctttgtttttgttattgtaaagctactcctgaattttactttttcttgatgtcattcggtgaaaaggcaaaatgagtcgttgaggatatagagggtttggttgctttaaaaaggctggttatattgccctgtcagtgctttattttcaatgctttttgcaaaatttggtgtttcctcatgattgtgggcgtcagaagcagcctgtctggatgcggcagcatctgcaaggttgatcccgtgttctttcagatattcaaacatttcgggtgtggctgtcgcatgaatttcattggtgtaaagacaggtgttttcatcgatctttgtcactttcagttcccataagacctgaacttttgtgcgcccgttttgggtaattgaatccgagatggaaagcatgcggcagtaatcaggacggtgaacatctgcaacataatgctgtaccatcagtgcatccccaatagtttctacgtttaaagataccggcttaccatcaaaagtgaaagaaatagcggctccgatatgctgggtagagcagcgctggtattcggcgtccggcagattaagcagccagtctgcgatatttactttttcaatgggtgcatggatgatggcacttacgcttgagtgagatagcgcgttttcgggagtttgtaagatttccatagttgttgattttgattgttatgttatgttatgttatgttatgttatgttatgttatgttatgttattgatgatgtaaagctacaaaccggttgttttaatttttaatgctgttcggtcaacaggcgaaaactgtcgttgaataagttgatgatgttcaaatagcaacagggcagggttcctgaaaacaaaaaaatcactgtaggttacagtgattgataaaggataatttttaaatgaggttatttatatagccattttttaatcagcctggtataattgggcatcacagaaaacaccatcagaaaaacaataattccggaattgatgaatccatcagaataatgattggctgtaatatgtaaaaactgtaaaaaaggaatgatcaaagcaggaataagtacagacagcggataaatggcagaccacgttgccagaaactgtttccagcgtaccggaactttattcccttcattttctgtcgtaaaaagaaaatcaagcccggatctgatctgataatggtcgtttttcctgaacagcggattcgctttctcaataagttttttccggttatccgattccatccaatttttaagatggttaatcgtatcaaaacggatgataacagtgtacacaaaagtcagatcaggaataggacgaataatctgaagatcaataaagccttccgaatgcctggtgacaggaataatttcgtccagccatttttcatattgtgattgttttccatccagaatatgatgggtaatgactactgaggcaccccgattttccataactgattttttataggttaatttaatacgctcttttatactgccacggaatttctgtttcaatacctaatgccttggcagaatgaatagcaaaataaggatctctaagatgttcccgggcaatgattaccagatctgcatctcctttgacaataatatcattggcctgttctgcttccgtaatcattcccacagctcctgttaaaatcccggtctgttctttaatggcttttgcaaaaggaacctgatatcccggaaatactttatccttgcttacattggtaaatcctccgccggatgctgtaatgaaatctacaccgttttctttaaggatttctgaaagtttaatgctgtcttccaaagtccaggcttcatccgattctatatagtcaactgcagaaattcttacgaacagaggcatttcagcaggaataactttcctgatttcctgaacggtttctacaagaaaacggattctgttctcaagacttccgccatattcatcctgtcttttattgattactgcggaataaaactgatggaataaataaccatggcctgcgtgaagttcaatggtatcaaaacctgcttcaatggcacgaagagctgctttaacaaatttcgtcttcagttcctgtatatcatcaatggtgagttcttctgcaaaaactccgttgaactcatgagctgaggaggattttaccgtccaggcaccttcttccggagtgaggggtttcattctttcattgggatgtttcaggcttccttttcctcctgcatgccagagttgaattcctattttagcatcctgttcatgtacaaaattcacgatgttttcccaggcgtttttctgctcatcattccagattcctacatcagataatgtagccagaccttcttctgaaacggctgtacattcggtaagaatcaatcctgcgccgccaactgcacgacttccgagatggacaaggtgccagttgccgggaattccgtttttagcgctgtattgctgcattggagataatacaattctgttctttagggtaagattgcgaatgtgtatgggtgaaaataaattcattttttctttttttaaattgtttttgaaaatgcttcagcttcggaaaccgcttctgacagaactttctgtacttctgccagtattttttgcagatcagtattttcttctgatgctgtttctagaatatcgagtttttcctttaaaagaggatgtaatcccataatggcaatactggatttcaaatcgtgagcccacagtttcacctcatgaaaatctttgttttcgtaagccactatcagtttctgtagatgattgggaatattctcaatgaactgttgcgtgaccattttttcgaaacttttgtcgccgccgctcaccgtctgcatataagagagatcaatatactgatagtcagataatggattttcggttttcttttcgtttttattcgtttctttaaacccgaacttcgaaatcagcataaacagctcttcttcattgacaggcttggaaatatattcgttcatcccacggctcaggcatctttctctttcgcctgccagagcatgggcggtcattgcgatgaccggaatatccagtctgagttcttcccggattttctgggtagctgcatatccgtccatgtgcggcatctgtatatccattaaaaccagatcgcatacattgcttttaagataacttacagcttcaagaccgttcgatgaaatatgaaaatcaatattccattgtgaaagcagatgtttcatcaggctttgattgatcacattgtcatcaactaccagaactttcagaggtgtgttggatttatccttaaaatagtgcggatcagcagctggcagaacagtaagctgttcctcagcaactccgtaaggaatgtagaaatgaaaggtagttcctttccccggttcactgcttacttcaatgtttccgttctgcaggagaattaagctttttacaatggataaacctaatcctgttcctccgtaatttcttgtcgttgaatcttctccctgattgaatctttcaaagatttcagtaagcttttctttgtcaattccaattcccgtatctgaaattttaaatccgagaacagcttctttttctgtttgctgtttactgtagatttcaacagaaatatttcccttgtgggtaaattttatggcatttccgatcaggttcactaaaatctgcgtcagtcttgtggcatctcccaccaatgtgtcaggaatggaaggatcaatcgtactggaaatggtaagtcctttttctttggcccgttcggtaaaaaatgtttctacggaattaaccagtccgttaatactgaaaattccaggggtaatgcgcatcattcctgcttctattttggataaatccagaatgtcattgatgatggccatcaggttttctccggaacgctgtatggaagagacaaattctgctgaggtttcatccaaaggacgtttttgcagcaaattggtgaaaccgagaattccgcttaaaggagttctgatttcatggctcatattggcaaggaagttttccttggtttgtgccgccaccaatgcttttttctccgcaatatcaagttcgcttatgagtaacctctggcgtttaaactgtctcagaatgtgatatccaacgacagaaccgcccaaaatcagtaagaccaatattgaaatgtcataaaatcttgctttctgccccatttcctcacttttctggctgagttcaaccatattcagttttctgctttcatatattttagctgtgattctggtgatttcattggaaatattccttgcacgcggattggcaatggaggtattgtcgtccatgtttcctacagacaggtaacggtgcaggagtttatctttggttgttttcttttccatggcaagaacgcttaatctgtggatcagcttttcttcctcagcatttacattgtccttggaaagagaatccagaaaattttcgatctgactgattttttggtcgataccttcaagatgagtggtgtcattcgttgcaatagaagctctgattctgctttccaccccaagaatatcacggtcaatctcccttaaatgattgctggaacgtaattcgctcagcaaagtattgttattctggatcagcgctttggtatttcctgcagaattgagctgaacagctatcagcaggagtgagcctgcaataaatgtcaggataataaaatagctgaatcgcttgttatccattactgaagatatatttttcataataacagtctgatttaaataaaatacagataaaggttgattaaaccctaacctgttcagggattgagatcaaaaaaggaagtcagattttctgatggccggcaaaggctaaaagacattcattctcgtgttgagtgctttcctgtaggcatctgctacaggaatgaatttaccgttgatcataataccgccgtcctgaagggtgtcaattttgcctacagaaacaatataggaacggtgaactcttataaaatgatctttaggaagacgttcttcagccgttttcattttaccgtgaatggcaaacatcttttctttggtgtaaaactttacataatcacccatggcttctgcgtagaaaatatcatccagttttaagcgtcttgtaatattggaatccctcacgaaaagaaactcatcccttgtaatttccacattctcttttctgctttcaagaatcgtctgtgctttgcttactgcctgcagaaatcttaccggcataatgggcttcagaaggtaatctgcaatattaagctcaaatgcttccagtgcatattccttttttgaggtcgtgaaaatgatgatggtctctttaccggaaagggttttcgtgagttcaattcctgtcatttccggcatttctatatcgagaaatatcagatcgacggaattggactgaaggtaatgataagcttctatagcattggaaaactcactgacaatggaaagatccggaacctgtttggcgaggtgtgctaatgttgttcttgcaatatcattatcatccacgattaaggctttcataggtatagttgtttatggtttacacaaagataattataacttttttattttgtgttatctgaaataggaacggatcatccatgccatttcttcatgggtttccatcagacctgtaataaaatcgctggtaccgtaatctttatacttttctgcaaatggagtgatgtttccgcggagaaattcaatgatgctttcatgatcacttaacaagtctctcatgtatcccaaaccatcgtttgttctttcactgtattccgttaaatgagtcagttccagatagattttcattgtcgccggtgcataatgcccgattttacgcattctttctgcgacactgtctatcagttcatccagttgtttgtattgttcttcaaagaaaatgtgattggcatggaagttatctccggttacgttccagtgggcatttcttgttttgatgtaaagcagtgtttcatctgctaataattttgctaattgttctgcaacagcttctgtgtttttttcagtaattccgatttttgttttcataataataagattttagttgagcattattgcctttttctgatgtaaaggtcagccataatcctggaaaacaatctgtattttcggcgaacgggcagaatcaatcggtgaaaagcggacaatttccgctttccataagtttcagaataatataacagataattttataagctaagatgcttctttaaaaaggcaagacttccttctgccaatgtctgagcatcataaggtgatttctgccataatgaaaccttttcctgcattcccggaattgaggaactgaaattttcaagaaccagatttccttcaaaattgatctttttcaatgccgagaaaaattcttcccagttgacagttccttctccaagcatgccccggtgagactctgtaacatgaatatgcttcagcattttttcggatttgataatcgggtcataaaaattatcttcctcgatattcatatgaaaggtatcaaggtgaaggaagagattatttcgccccgttttcttaataagttccaggacattttctgccgtattgcagacataagattcatagcggttaataggctctatggcgatatctatacttttggcctgggcgtaatccgccacattgcaccacacatcagcaatgatttctttttcgttttctgtgagtggttttccggtaaaaacaccgattccgccatgcaggacaccagccagaagatgggtttccagttcatatactttatcgatggcttttttgataagcttttccgaagcttcaggatagaacgcaatatgagcatctttaggaagattcaacgaacatactgcttccagatgattgtctttcaattgtttttttaccgtggacgcatcaaaatccattgatccgggtaacagtatttcgataagatcaaacccggcctgtgacgttttttctatagcatattttcctgattctgcattccataacgccgtgatccaggagagtagggaagctcctaattttatattcatcatatttctttattttaatttaaaaaatccaccattctgtccgtactccgaaataggtcccgaatcttttggctcctgactgctgtaaaaacggtgaataaagactgttcatagcctcatcattataccttgatacttctgcaataaaacggatgtgaggtcttgcccagacacttcgttccgctgtaggaacaatggtgggagccagaacaagtttcatcatcgatgctgcatcctgcgttccgtttttacgggttgcatagtgaaactcggagagaatatggaaccagttgttaaaatagtaagtagctctgatccccgtattaaattctgttttcctgttgaaaatctctcggttataataatccagcgctttatcagtattggctgatcctcctttgcttttggtgaaaaccgcatagggattaagtgaccagcggtttgagatattccagaggaagtgttcaacaaccgtaaaagagtaagctcctttgtatgtttttgtgatctcatcaggagctccgtaggtgcgccaggtctgggtattgccattatcacctccattggcgattccggtcccgtatcgtacagaaagctgattgaatgaacccggaattgtcgttgcaatatctgtatttaatttagctccaaaaacccaaccatgatccgatggatattgctctacagaattttctcctgatttttctacatgatgaaattccgccatcagtttcaacttgtgttttgtatttttaaatggcagcgtctgctccaggacaaaaacttccctttgcctgtagatgaggttttttgaaccgctgatcacattggtgtaagagtagggtgtggagttgctggccgcagtatcaatagctgccgggaaaaacattgaaaatctggtgtttttatgtctcagtccccaaccggttgccgaatggtcatcaaaataaaaataatctgcaatgtgaatgtcatcatatctcagccatcttgaccctgcccagacatcccaatcacttcccataatgtttcttgcttctacaaaggcttccggcaaggcaataatcatcccctgattggattttgaatctacatttcccaggaaagttcctcctgaataaaagctcagtcttgcctgcatatcgatctttgtactttttgtactgtcaccgtttaccactggactaaaatggaaagccggtaaaaagtcaacataatctccctgatccattctgcctcctaaagatccctgattgttcagattcagctgtcttcctgtttttccatcggcattcggagaataaccagctccgattcttcctgttgtcccaaaggaaaattttttgttggttattgtgatctgggcattaattccccttccggcgcatacaagtaaaatgcaccaggctaataaaagctttgttttcatagggattatttaagtgttttgggcttgtagaactttaatgcaaataataaaatgacgacatagcagagaataggaagaaggtaagcatgggcaatatctttttctgcaattctgcccatgatcggagggaaaacagcccctccaaacatcgccataaccaggaatgaggaagcctgctgaacttttgatcctaatcttttaagtccaagactgaaaatagtaggatacattacactcaggaacaggttgagcaaaataaggcttataaatgatacccatccgaaactttgggaaataatcagacacagaacgatattacaggttgtaaagatagccagcagtttgttgggagcaataaatctcatcaggaaggttccgataaatcttccgatcatcatcatcgccatacttaaagaaaaataataagaagcctgtatctccggaaggtgcattttctctacaccgtaattgataaaataagcccatgttccaccctgtgcggcaatattaaaaaactgggcaatgacggcaaatataaaatgtctctgtttgtaaagtggtgcatgaggatctgatacggaaacatcttctcctttttcattttctgaaatgatgatatcttccgcatgaggatctttaaggtccggcactctgataaaactgaaaattatggtaatcgcgagaatgacaatcccaatccatgtataaagattttttacggaatccagggatcctgatcctgtatcaggtgttccgaaaatgaagtaccctcccagcaaaggtccgataatggctcccaaaccattaaatgactgggcaaaattaaccctctggtcacttgttctttcatcccccaaagcggctacaaaaggatgagctaccgtttcaagggttgccattcccattgccagaacaaaaagagccagtctgaaaaagttaaatgaggatgtgtcggcggccggaataaacagaaaggctcccagtgcaaacaatgaaagccccagaatgacccccgatttataaccaaatcttttcataaacagacctgcagggatgcccatcaatgcataagctccaaaaatggaaagctgcaccagccctgatttggactttgaaatatgaagaacattctgaaaatgcttattcaatacatcgcccatggtgagggcaatagcccagaaaaagaatagagaggtaacaaaagaaaggatgatatagtatttcttatctgtaaattttggagtattcatatcataagttttaagaggttttacagctgtttttttctctgaatgccttgaattcttcataagtataatcagggcatgccccagatttggaagtgataaaagcacctaatgacgtggcctgtttcataatttcttccggagatcttccctgaattcttttagacaggaagccggccagaaaagaatctccgctacccactgtgtctgcaatttcaatatgaaccgccggaaaattataggcagtgtctcccacaaaatatctggcgcctttacttcctttggtaaggacaatttcattcagattaaaataagtctggagatgtctgatgctggtatcttcgtcaatatattcttcaccgagatattcaagaatggttctgagttctgccttattcattttaacaagatcagctttatgcaataattttttaatgaattcaaaatcaataaaaggagggcggaagttaacatcaaaaactttgaattttgaatattccaaaagttccagcagagtattccgggatgcctcatttcttgtgatcagacttccaaaaacaaatgcttctgaattttgtatcagttccttatgctccggcagtggctgaatataatcccaggcaacatcctgcacaatgtcatatgcagcctctccatgctcatcaaaatcggcaatgacagttcctgtggccttttcctggtcgatctgtatgaaatctgttgttattccccaatcctggatctgattaagaagtcgatgtcctaattcatcatttcctgtacggcttagcattttggtatcgattcccatttgaaaaagattgtaagcaacgttaaatggtgctccgccggctctggatcctgtaggaaagatgtcccacagaacttctccaaagcaaacgacatcgttaaatttatttgttatcatattaggttaaacgtttaagttgttgtttaaaaaaaatggtttatgtcaaattacttattttaaagacgctttagcaaccagtcttgcggataatgttattctttttccggttggcacataattgttgatttgtccatccagtagcttaattgcttcttcggccatttcttcaatcggctgctggatgtaagtgatctccgtagggaagagatcataagcatcggtttcatcaaatgcgattacagagacctgttccggaacttttatattgtttttaacgaggtaggaaagtcctgctactgcaagtttattactggaaaaatataatgctgtattttcaggtttttttcccaggcttttttcaagttgtacatgtacttcctgtgcaatattttccagtcctaccaggagatattgtatttcagctgtttttctggaagagcttaccgctttttcaaagccatgctgacgatcaagcaggtgtgggagcttagtgtcatagcccacgtagatcattttgtcaaaatccttattaagaagcaggccggctgtgcgctctgcgatctcctgattatcaatggtaattcccggaacagaaacacctttaagatacctgtcaatcgttacaacagggtatttaagctgaataaggttttcaagtgtcttttctgatcctgccacaggagcaacgatcattccgtctacctgctgctgcgaaaatagttgggtaagtttttcaaatttttctgcattttcatcagaactgccgatgatcagggtatagcccagctttaaagctttatcttccagattccttgccatgtgggaatagaaatcgttggagatatctgcaacaataagccccagcagcttggtcttattggttttaaggctttttgcgatcttattaggggtgtagttaatcgtttcagcaatttcaaaaatttttttccgggtctcctcgctgattcgctgtccttcctttcggttgagaacataagatacagtggctacggaaactcctgccagcttagctatatcttttatggaagaccttttcattttaatttttaatgcacaaaaatatttcagaaaatagtaaaaaaacaatagctaggtttttttggtggtttcagaaaaaagtgtaatttagcgcaattttttaaaatcgatttaattgtttgtatatcaattaattatatatttgcaactgtttttaatatgaacaaattgttaactgatttagtcagattgattaaatttggttaaacgtttatccttaaattttttaaattaacttttaaattgataaagcgtgtaaaatttttcgccggatccaccactgttttttgattatagctgtaaatatatttctgagcttgtcttctgaaattggaaatgcagaacagaagaaaaaataaaataagcttcctgctaaaggaagcttatctgatttcaagtaagatgtaattataaacaagactcaaaaataagataaataggaccggataattatgagtgtgatcatattcggtaatgattgttgaaattgcatagtattattttcagtatcttactggtttattaatgttatagagaaaattcagaataagaatcttaacttagatttaaatcttaaacatgaaagaaatgaaaaaaatactatttttcatcatcactataacaagtatagtctttacgaaagggcagactattgaatctgtcagccgaagtaccatcggatacattaaaagtgacgggacaattgaaaacagcagtcatgcgaccacaggttatatcagaaatgacggaaccattgagaacagcagccattcaacgattggatatatcagaaatgatggaactattgaaaacggcaatcgttctacagttggttatgtgagggaagatggaaccgtagaaaacagcagccgtgctactttgggatatattaaaaatgatggaacagttgaaaatgcaagccgaagtacgatagggtatgcccgtgggataaaaaaagaatgggtggctgtagtctatttcttttttaagctctagaagaaaattttattgccggacagctttattgtttctgatattttttttgctttttatatgcttaaagccttttgttggcttgcaaattgatactacaaactgaattgaatttttgatgactaatggctagaacgactgtaactctgattttccttttatgtggttttttctttttacaagcacaggagaagaaagactcactttattataaaatagaaaaattttcagacaaaagaaaggttaccaaattcatccaccggtttatatttcgtagagaaccggattctacatctgtaaaatccaatactgaaaagctttcgcagaagacttatgacaaaaaaatcatcagaaatatcaggatagaaaccattgaccctttcggatataattccaaagacagtaaagaaatgggcagatggtatgattggataaaggatcatcttcattccagtaccaggagatcaacggtcaataattttctactttttgaagaaggagaagagtacaatgcccaaaagctctacgaatctgaacgtttgctgagagcaatgccttttataaacagggttaatatcagtgtttccgatagtacttcgagtaaagattctattgatgttgtggtaagggtacttgattcctggagcctgaagccgagaatcagttattccggaagtaaaattggcctcggtgttacggaagagaatgtgctgggactgggacatacactggacttcctttacagaaacgattccaaagaaaagcagaactatctattagggagctatactacccataatcttttcggtacctatatcaatgcccagattcttggagagcgggacttttcgaaaaatgaaagaattaatttcagcctcacaagagactttttctctcctctgacgaagtgggcgggaggttttacatttgaatattttatgcgaaaagttctacttccaacagatacagctaacacttttcctgaggttcaaattaaagtatacagccaggatttatggggaggttaccagattccggtttcggctgatccgcgtgaaaaagtatccagtaatattgctattataggaaggtttcagaattatcagtacaaagacagcccgggaatagaccagtataaatatttcagctcctacaacagttttctgatgtctgttgggtttattcagagaaacttctctgttcagaagaatattttccagtatgatttgccggaggatattgcttatggtaactctgtcaatattattggaggaggtttatcaagaaataaagaagtgaatccatatgtgggaatttcagcatcttacggccgttttacgaatctgggatatttcacagtgaaagcacagtttggaagattctttaatgaagacagccagaacagggagtctttccgctttgacggaacgtattttactaatcttatggactggaaatttgccaaagcaagacatttcttttctccgactttagcactgggaaatccgcagcataattactcttataaagaccgaataaacctttcatccccggacgaatttccggtttacaattcagattacatcggaactaaaaagcttgttttaagatatcagctccagttgtttataaataagacctggaaaaattttcatttcagtccttatttaacaacagcggtgggctggctgggaatgcctgatgataagctgtttaaaacaaaagccaatgcaaaaatcggaatcggtgttttaattaataatccgtatctggtgttcaacaggattcagatttctttcatgtactatccacgggttccgtttgataataactctgtttttgattttaacagtaaccgtaataacctgttaccattgaacagctttgcaacggagattccgcattttgtgaatttcggaaattagtaaaagttaaaacttccttactcaaaagcaaggaagtttttaaatggcataagaatattttggtcttagactactacgtcaatcttcacattaatattacctctggtcgcttttgaataaggacatgttgcgtgcgctgtttccaccacttttctggcttcatctaccggcagacctggcaaaacgatttgcagatgggcctgcaggaaaaatccgtcatcattggttgccagatctattgaagtgttgacagacagatccggaggaagattaatcccaattttaacggctcccaaatgcatagctccgataaagcatgccgaccaaccggctgccaacaattgttccggattggttccgtttccttttgaacctggagatgtcagttcaatatctaattttccgtcactgctttttgcttgtccgttgcggcctcctgttacgataacattacctgaatacagtactttactgatgttgacaacggttgtgttttctacttcctgaatggtatttaattccatatttttattatttagattagacgatattgttgattgatatttctattaaagtttttttcttaaatctttgaatgctgctctaagctcttctgtaaagacctgtggctgttcccacgctgcaaaatgtccccctttcggagctttatggtaataatataaagtcgggtaagcactttttgaccagctttccggtgcctgatagatttcatgagggaataccgaaatggccacagggattttaatgtctctcgttttctgtgcctcagcactgaaattgtttttattgttttcccaatagaaacgggaagaagacgctcctgtattggtaagccagtaaagggtaatatcatccaggatcgcatcacgacctattacattttcaggatgaagatcactttcgctccattcagcaatcttttcataaaggaatgctgctaaagcaaccggagaatcagaaagtaaatatcctgttgtctgtggacgtgttaccatcattcctccataggctgcatttcttccaaagaatgtactcatcgcgttataagcttttgcttctgaagaggaaagtcctgatggagtaggatctcccgcatttataggttttacaagctcagcaggaatagtggcgggcatagtaagatgaatccctaaaagtcctgaaggagcctgtttggccaatgcatcggatattacagaaccatgatcaccaccttcggaaacatattttttgtatccaagacgcttcatcagcacatcccatgcacgggcaacgcgatcaggattccagccaagttcagtgggtatttctgaaaaaccatatcccggaatagcaggaatgatcacatcaaatgcatcgcttgcctttcctccatattttacgggatcggttagcgggtctattgcattaataaactccagcggagaacctggccagccatgggtaaggattaccggcattgcattagattctttagaacgtacgtggataaactggatatcaagcccgtcaattgtggttacaaactgtggaagtgcattcagtttatcttccacctttctccagtcgtatccgttaccccaataagtgatcagttcttttaactgttcaagctgaattccctgagaagcatctttcacggtttctttatccggaaaacgggcttcagcaatgcgctttttaagatcatccaattgggattgcggaatactgatgtgaaaaggacggatactggtatcagattttgctgatagagtagaagtctgattaacttgtgctttagaaactgcaggtgtacttaagatgaaagtggctgcgaacaggattgttgaaattgttgttttcattgtttttctgtattagattttaaatctgtttttcttttttgatgagacaaaattatgctccggtaagcagctgttaaacgggtaatttgtttaggtggccatatttgattgtgaagcagacattagggaaggcgaagaggatcgttagttataaatgataaatgatgaatggtgaatagaaaaaactgtataaaaattaaactgtttgcttcataaaggacaaaaattagctccgtttttgattaaacggagctatttttcggctgtattttttaaagattatccgtgagcttcaacagatacatcgttccattcttcccagacttttaatcgctgctcataattatgttttacaaatggcagtgccacttttccaagcaacagacgcaatggaggattttcagtttcggcaagttttatcagtgccggagctgtagcttctacacttccgaaagatgtttctgcttctgagaatgcttttttaacatcatcataaacaggattactttgagtgttaattcctgtatgccagatattggaagcatatccgttcggttctaccaaagtcacattgatgccgaatccttttacttctgtagccaatgtttcacttaatccttcaatagcaaatttagaagcattataaagtcccatagttggtaaagtagccaggcctaaaatagaagaaacctgaatgatatgcccgcttttctgatttctcattatgggaagcactgcctgcgtaagccataaagttccaaagaaatttgtttcaaactgtgctctggcttcctgctcgctggtttcttccacagcacctgttaatgcgtaacctgcattgttgatcaggatatcaatgctgccaaaatgctgttgtaccttctgaactaccgctaatgattgctctcttttgtctacgtccaaggataaaggcaatacggaatctccgtattgatctttaagatcctgaagtgtttctacatttctggctgttgccgctactttgtaaccttttgctaaaaaagcttctgcccatgcttttccgaaaccttttgatgctcctgtaattaaaactgtttttgacattgttttgtttatttaattgttatgcttatgcttttctataaagctttatattaatttatatgaccgatcggtcatttttttgataaaaaaaattatactgtattttcctctataatttttttcagattgtttccgataattttcattgtatcattgttaccggacattctggacattaaatgtccaccctcaagcattgcaaacacaactgtggcaaagtctgatgcattccagtctgctctgaattctttgttggcaatccctttttctataatgccggaaagcaatttttctccctgcttaattccacggtttactttttcttttacaataggattggtatcatccgcttcagttccaaagtttaacaaaggacagcctccaacaaccggtggatgattgggatcactgaaaaaatcaatataggccaataattgttccccggaagttttgaatctgcttaaagttttttggagttgatcactcagcatttgcatattatgctctacagctgcacaggccaatacttctttattttcaaaatgaacatacatactgcccttggacaatttggtggcttccataatatcgctcatagaagtagctgcaattccttttgtattaaaaataggagctgctttttctataatgaactgtctggtttcttcaccttttgccatgatgataataaataatgatgcaaatatatgaccgattggtcataaaaacaaattttatcggatttattttgaaaaatataaatattttcattaactcccagtagcagtcctttattttttattataatagatgcttttaaatagaaattttacctattcataatttactgtatattagctttattgtattgttaatcaatttggtatgttttaactgaaaaaatctaataattatgaatctgaaactacttattcccaataaagtttttcttttgataatgctgaatcttatctggattcaattattatatgcacaggaagatctgccagtaagaacgcaattgaaaaagactattcattctgaagtattaaatgaagacaggatattatggattaatcttccgacaggctatactgaaagcgaacaattatatcccgttatttatttgctggatcctgatctgaattttgcatacgtcagcgaactggaaaaatttctttctgaccgctacagaatccctaaatctatcatcgtgggaattgtaaatacagatcgggtaagagattttacacctatccattcaattacatttcacggtaaagttgacaatagcctcatgacaaccggaggtgcaaagaaatttcagagttttctgaaaacagaagttattccttatgtagaaaggaatttccgagtagcaccatatcgcatcttagaaggccattcactaggtgggctatttgctctttattgtaaagtggaagactctgaactctttcaggcttatattattattagtccggcaatctacgatggaaattcaaaaattttagagcaatttcctgaagcattaagtaaaaataatgacagggtcagctatctgcacctctctataggaaatgagcctgatggaagagatgctgtaaacgtacttcatgagcaacttaaaaaatatgcacttaaaacgttaaaatgggattttaaaacttatatgaaagaagatcatttttcagtaggatatcaaagtatgtatgatggactccggtttatttattcaaaatggtttattaacccgagagattcttctgtaatacgatctctttcagatattcataaacattatgattttctatcccgggagtatggatatagaattattcctgatgaagattttatgaatgattcgggataccaaaggctgaataatgaagattttcagcatgcaatcgaaatttttacagagaatgtaaggaataatccaaagtctgccaatgcttatgatagtttgggtgaagcatatatgaaaagtggtaataaaaagctggctattgaaaattatgaaaagtcggttcagttaaactctcataatgataatgcagtgaaaattttgcagacattaaaaaaggaataatgggcataggtttaatgtaaagcagaaactattagagtttctgctttttatttaacgataatcttaatgctttccctgcggtcattttcatacacaatactgatcatgtaaaccccttttccatacgctgataaatctaattttatatcatgggaatgcaggtttttccattcggaaagctttctttgagccatatcataaagattgatattctttatcatttctttactcttaaggtaacagaaatccgtaacaggattaggataaaatgtaagctcagactgtacttcaatatccatagttccaagagaaccgacattaatgattttactgatgatttccgaacatgagtttttattaacagtgagattaaccgtatagcttccgggagaggtatattgatgaatcggattcaatgatgagtcattggtgccatctccgaaattccacagtactgaattgtaattcgctgattgattggtaaagctcacagtcattccattgattcctgctataaaatccgaatgaagatgaaatacattactgttccattgcgccggattattaaaaaagaccagatcagcaatattctgaaaattttcagcagtattttgaggtagtccgttataaaaattggatggaaagacatggtcctggaaaatagcggaatatatagaagcagccacaagatagcttcctttgggccccggatgaatatcattataagatccgtgaagtgccagatcctgggaagaattgtagtaatgcctggcagattcactggcaggtattatttccacctgcatcagattagacatctttgtgatggaatcctttattttctgctggaaattgaaataaacattgtattcattcgcagatggtactccgtaaggaatttcatacagaaatattttggaacaggggctgtacttccggatagagtctcttattttgcgtccgcgttcggctgttaaagaaacagggtaagaatgaccagcagattcagccgttccgggctgcataacaacatatttgtagtttttagatcttactttctgatacagcaaaggatcatccacgtgattgacaaaacctgttcctcccggtgtatgcgtcgttatcgaaacattttttccttttgaaatcgctatattgttgaaaatttcaggcatatcattaaaataggtaacactgtttccaataaacagaacctcatcggcttggcagaataataagactgaaaaacctgtacatatcagaaagagtagtttttttatcatatatcaatttgttgaattgtaattttaaaaaggtacctgtagacaaccacttatactacaggtactaaacacaaacgatgattaaaaaatgttttataaattttaaagttatgtactattctttgccttttttaaatataatcatttttatagtatactgctaaaaatatttaaattgctgttgtatacacatattgtattttataatattcgggcattcaaaagtaattgctaattttgtattacaagcaatgttgtattgtgattttcgcatattgtgtatgtaatacgtacgtattttaggttatttggtggttgggtagtattaatattgcattttattttaatagcattatgatgaaaaaaataatgattgtattctttttcatttcttccttcttcttctatgcacagcaaacggaacaagaaataaagaatattatttttgatatagacttttcgaccgccggcccaaaagagataaaacagattgacagtcttattgcagtttgtaaaaaatattcatacaatgattgtgttgcattaggatatcttaagattgcgaatatctatgataaaatgaatgataccagaaagtctttttattatatcaataaagtagaaaaagaaaacctcatcaattctgataccgactttgaagttatcttttatgttcatttgcaaaaatcttttttataccggaaattgggtgaaagggttgcttcttttaaggaactggatgaaatctatgatgaagcaatgaagacagggaatgcttattttatttatctgatcaacaggcaatatgctgataaatatattgacaccaataagccgctcgcattacagtatagtaaaattgcgtataaattttcaaaaatatacagagaaaataaaggtaaccgttatcggattgataaaaacagattgagtaacagttataaaacttcagcttatctgggaggaatatatactgatcttaataaattggattctgcacggatttatattgaggaagccattcaggatgaaaaaaaagtaaatgatactagtctgaaatatataacttcattatatgccggaagatattttagaacagttaaaaatgttgaacaggcgcagcactatttatggattgccaaaaatattgccaaaaattactttaaaagtgagaactatcaaattgcagtgggagatgagcttaatgctttatataaaagtattggtcagaaagacagtgttggctactattccaactggctggtaagtatagaagaggtaaaccgtgagcaaaatcaaacactgaatgatactgtagacaaacagaatgaattggaaaatatgaataggaaaaaagaaaacaaaaagctttttttcattttatcactaagtattgcaatatgtattctctttattttcctttttctatattattatagaaaacataaaagtaaaaacctggataaaattgatatccctcatcagttgccgatgcaggagagcatttttaaagaagtgacacagcttgccaaagaaaataatcctgagtttttgacccgttttaatgagtactgccctcgtttttcagaagagctgctgaaagtttctcctttaaaaatatcagaaataaggttctgtgcttacatctacctgaatttttccaccaaagaaattgctgaatatacttttacttcagtgaggacggtacaaacaaaaaaatacaatctaaggaaaaagctaaatgtccccagcgatatggatatttatgtttggttttcaaaactgttgaaataaagtaaaacaaagtcccgaaataaaatatactcaattagccaaggttgaaatatggatacattgctgcccattgacctctttaaattcaatggtggtgatcatatcattataaatcagagtactggtgtcattgaattgatagccatcaatatatacaggcctttctttaggaagattattttgctcattgagcatttccagggataaactgtccggatagcccgcattttttttaaatatgatttctaccaaaccattgtcagccagataatcaaatttctttaggtgagaaggtaggctagctttggttttaaaaacatttatcttttcgatgctgcttttgtatagattaaacatactgacagttccgataacattattataaatagcgaactttacagtattgtttttttgagccagaagaactcctgaaaaaaatataaggaatgtatataatagctttttcataattaaagtaatttatatgttttggatcaatttctattttttaccgtaatccatcccgtatattttattggaatctgtttttggttaatctcatcccagctcatgtcaaaccaatagtttgcagtagaaacttttttgccgtcaacagttccatcccatttaaatccgtttgacttattcccttcatgaaccttgcttccatatctgtcatagatactgaatgtgaaattaggtttatttgctaaagcagaataatcaagtatatcatttattccatcaccatttggtgtgatgatattgataaggttgagaactgtaatctctatcttaacaggagtacaattatatgaatcttttacataaaatgtatggctcccacgagggatgttagtaaatatattctcgttttgccagttgatattatccatagaatacttataaggagcttttccggcagttatctttaatataaccgaattattattaatatttacttccgaaatgactgggttttcagaagcatatacctttacagtttgctttataccacattctctggttttcaggtttacccaatatgttccaactcctacatttttgatggattgtgttgttgctccagtgctccattcataagaagtatatcctggtcccgcatccaatgtagtagtatcctccatgcagataatcttatcctttaacgtatctgaataaatagcagaaatgactgtaagagttacttctgcaactctgtaacatccgttagcattacttaccttaacgtaaactattccattaggagcaatataattggctggtgtcagaatttcgtttgttccgttatttgcatcagtaagagacggataatattgcttaattattcccggctgtaaactaactcctgccaatgttaagttaaaattcccaagcaatggattcgaaggtagaaaacatgattttaaagcagcattattaacgattggcttttctgaaatggttaatgttaaagttacccgctcacaatctgtaaaaacgggattatttccacaaaatttataaacaatagtatctgtacccaaataaccagaattgggaacataagtaatgactcctgtcggatcaatagtaacggtaccgtgtaatggcggagttagaatagttactgtgctgggaacatacgtctgagtagaattggtaaactcaggaacaatggtcttatatccttcgcagacagttagtgctttagtagattctgtaaggcaagtatataccttataaaccggagtaattgctggcgtacatgttcctactgcaatttttacggtataatttccggcaaccattggagtataggtgttggaattagctcctggtatcggatttccatttaagcaccattgataggtatcataactatcatcaacttccaatactatgccgggtatacattctccagcttgtttggtaattagcggtatagaagagaatcctgcaaaatatcctccatatcctgatgttctgtagcctccatttatacccgcggttacagccttatcagaaataattgttatatttccggcaattgatgggatgccatatgttacccagctgctatttcctgtcaaaggaaaggggccttctgcagctgtaggtgaaactccgtttaccgtcacattagccccagcttccgttaagatattaagttttacaatagttccgggtgtgacaacacttgttgttccgggtccggttggcatctcgttgattttcccgatttcttcaatttttctcggcaaaaagcagtttaacggtggaatgtagttaaaaccacaggttgcgctactgttattcactgaaaccaattgatataaataaaccttttttgaagtcgaaataaacatgttaaagtgtccggaagttccctgctgaacgtatttgtttcctaatattctgtaaaattctccactgttgatggttgcaataggcgtattagaaccattgatgaatatttgggtattgttttctgtccctatgatgataccaccttctagatcagcattggtagatctggttcttaccatggcaaaagtacttccaagtctttcgataggaacagactgatcaagaatcgcatcggatcccgagcttgtattgtttccaaaatttccattaacatttccattggtaagggtaatcggtttatcggaaacaattttagctcctataaaagcggatagattttgaccacctactccaggacctcctgcaaaaataaaagattgccctttgttaagagtaattgtgtgcgtatgggttgtaggggctgctccgaaaaatgttacatttccgttccacgtagttgttacaacagtattattttctgttgccagtatgcctgcagtgaaattataacctgaaagtgatgaggtgctgggagttccggcaacgtaaaattctttcccgagtccggcttttcctttgcttgttataatttcagcatgtggagtgctacttaccattcttaacgaacagtaaaatggcttggttccttttacatacagccctttattgataacagtaaaggcttcagacgtaaccatagcttctatattgctaataggtacaacaaaggtctgaggagaacctttactaatggtgacagtaccaattggaaggttattactattaactgtaacaacaaaaggagttgttgaatcagtagagagatatagtgcctgtgtataatttgtagaagcataataaggagcaaaccaatgttctgtgtctcgttgggcagaaatatgaatgcttaataagagaaacaataaactaaataaaatattcttcacgcatttctgaattttgattcttaaaattaagaattattttataaaaagcgattatgattattttatattttttttctacatagttacattttgttaacaagattactaataccaataacaatgttaggaggcattgaaccagaataattcttttaatggaaatgttgtttgtcgaaatagttttatatcatcttatacatatcaataatgattttcataaatcattgtatgccagaaatgtaattaacattgttaattctttaaacatgaaagcatcagtaaatatttacctccaaaagattattccatagaatttataatgttagagaaatctcaaatagtatgcatagattactattctttcaatcaggacgcaatactcggatatatgcaccagaaatttattaaaatataaagtgagcttaaaataagggaaatcaagatactttcctgtaatttaaagataataaaaagaaattgcagaattgctttttgtgtcacaagttacagtgtcagagaagcagataattgatagaatcagaaaaaatataatcaaaacaataaataatagtttgatttatagtctgcaggttaatataaaaaacggctatttcatgcaccttttcctgagaattctcctcctgcaaaaaatacaaaaggagaattacccggaacagcttaattaagctgataatttgcgatcactaaactcaggatgaaatgaacataattctgttctacctcttttctgttaatcaatttgtttttgtattcataagaattcagatctttagataatttctgataggtttcaaaatcatcaccttttacctttactcttatattaccatcttttctgttaatcaacacatcatccaaagttcttactttaaacaaaacttcacataatgtaggacgagccttcatggaaccgatatatctttcaactatattaatcttgaacgaatcaaatatgatgttattaaaaacgattttagaattaggctcctgagtgttgagttcaagtttatagttcattactttataaattttggcaaatataagtttaattatgccaaaaaacagactgttttaatagatcattcccatattaatgattgaattttattctgtaaactcaaaatcatatgaaaatgtgaatattagagggcataaatgaaagtattgaaaactttttcttttcttttatttttttccttatagtcatttgcgtaattttattctctgtataacaaaattcatattaataccaatataatggaaagatatagttatggaatggttggccttggagtaatggggcggaatctactttataatatcgctgacaacgggttctcaatcgcgggatttgaccttgatcaggagaaagttaaagaactggaagaaggagctgcttcaggaatgaaagtaagaggtacagacactttggaagatttcgtatcagcgctggaagtcccgagaaaaatcattcttatggttcctgcaggcaaacctgtagatgcagtgctgggaaacattaccccgcttttaactgaaggtgacattgtcattgatgcaggaaattcttattttgaagacaccaacagacgggttgctgatcttgcatccaagaaactgcatttcatgggaatgggagtttcagggggtgaaaaaggagccagaacaggtccaagcataatgcccggaggcgatcctgaagcatttaaacttctgaagccaatgctggaggccatcgcagcaaaagttgataacgaagcatgtacagcctacatgggaaaaggatcagccggaaactacgtaaaaatggtccacaatggtattgaatatgcaatcatgcagcttatcagtgaagcgtatgatcttcttaaaagaggagcaggcttaaataatgatcagctgtatcaggttttcaaagaatggaatagcggagaaatgaactcattccttatcgaaattaccagagatattttcacccagaaagatacattcacagataattaccttgtagatcagattttagataaagctggcgcaaaaggaacaggaaaatggacttctgaacaggctatggaaattggggtttctattcctaccattgatatagcggtaacatcaaggattttatcagcatataaagaagaaagagttcaggcttctgaaatatactctgaaaaagaaattacaaaacctgaggatacagaacagtttattaaagaagtgggagatgctcttttcctttctacgttaatcagctatgcacaaggtttatctttactggtaaaagcatctgaagaatatggttttgaaattccgttaaaagatgttgtgaaaatctggagaggaggatgtatcatccgttctgtgctgctggaaaaattctattctgcatatactcaggatcctaatctttccaacattctgcttgataaagaaatttcagaacttgtaaaatcaaaaatcaaagctttaagaaagactgccggatatgctgtagcaaacggaatttccagcttgggaatccagacagccttaggatattttgatgcctataccacaaaatctcttcctgtgaatctgatccaggctcagcgtgattatttcggagctcatacttatcaacgtattgacagggaaggagttttccatacctcatggcaaagttcaaacaattaaaattcggaaaaaaatgaatcaacacaaagtcttgcagccaacaaatattgttatttttggtgcgacaggcgatctggcaaaaagaaaactttttccggcattttataatctgtatatcgatgggagaatgcccaaaggctttaatattatagcactgggaagagcagaaaataccaatgaactttttagaaattacatcaaggaaaatcttgagagtttctccagaaaaaaagtaacttctgaagactgggcaggttttcaggctcacattacttactttcagcatcagctggatgaagaaagttcttatcagaatctgcagcaaaaactgcaggattttgattccgtttacggaatgagagcaaacagattattttatctctcaatcggacctaattttatctccacaatttccaatcatattaagaccacatcgttagcttccgatccgaaaaaagaccgcattattattgagaagccatttggccacaataaacaatcagcgattgaactgaacagtcttttggcaaaaacttttgaagaagagcagatctatcgtatcgatcattatctgggaaaagaaacggtgcagaatatattggcgttcagatttggaaattcaatttttgagcctttatgggatcataaatatatagaatcagtacagattacggtagccgaagaagtaggagtggaaaccagaggtgctttctacgaacagacaggagcattaagagacatgattcagaaccaccttttgcagattctttgtatgatcgccatggaaccgccggcttcattgcagtctggtgagatcagggatcgtaaggtagatgtgctgaaatcaatccgtagaatatcacccgaccaggttgatcactatgctgtaagagggcagtatggaaaagcaacaataaaaggtgttgaagtaaaaggataccgccaggaggatggtattgcaggagattcaaacacagaaacctttgccgcaataaaattctatctggataatgaaagatggcagaatgtacctttttatgttcgtaccgggaaaaaaatgaaagaaaagcattcctacattacgattcagtttaagccgcttcctcattccacattctcagacagtccgcaccatttatcagcgaacaggctgatcattaatattcagcctatgatggatatcaggttgcagtttatgacgaaaaaaccggggctgacattggatttgaaaccggcagaaatgatttttgataattttgcatgccaggaagatactccggaagcctacgaaacgcttttacaggatgcacttttaggagatcttaccttatttatgcgttccgatcaggtagaagaagcatgggacgttgttaccactatacaggaagcctgggagaataataaagacttatctttcccgaactataaagccggaagctgggggcctgaagatgttaatgctttggttgaaagacaggggcacagttgggtataacaatttaaatttaaacagacaaaaaatgaatattacagtatttgacgatctcgaaaaactgtacacgaaggcagcagatgcatttgttgacctttcaaaaaaatctattcagaaaaagggaagctttgtggtggcgctgagcggaggatcttctccaaaagccattttcaaactactggcaacgcctgaatataaagatcagattgagtggaataaaatctactttttttgggttgatgaacgttgggttcctttacatgatgataagagcaatttccgcatgacagatgaaacccttctcagtcaggttcctgtagataaaaatcatgtatttcctatgtatgctgaaggaatcagtcctgaagactatgcggaaacctacgaacagcagatcaggaatgttcttggtaatgagggaacttttgattttatccttttaggaatgggagatgatgggcatacagcttctcttttccccggagaggccgttttggaagaaaaagaaaagtgggtctctgcctattatcttaagccgcaggaaatgttcaggattactttgacagcacctgtcatcaacaaagcagaaaatattctggtaattgcatttggtgaatccaaaaagcatgcattgaatgaagtgctgaacggtgaatacaatccgtctctatatccgttacagcttattgagaagaaagagggatttcagtttttcacagacgaaaaagcaaaaggttagaatagcttaaactttataaaaatgagactgtcctcggacagtctctcttcatatcaactattttgataccgtaccgtcggtatacaattttctgcagattaaatcaaaaatcagcacttaaattaaaaacagtatcactaaagagctaatgatactgttgcattgtgcttttaccttagttgcatttttcgaaatttttattttccatccacatagtgttctatataaaatggttattagtttgaagcaaatatacaaaataagacactacgtagtgtctaaattgaaaaaaaattgaaaaaaaaatgttaaatttttaaagtggcagataaaaccctttcatacagcgactttacatacatttaaaaatcagaaaagccatatcttatcaaatgaccagttacaatatcttgcagaatattcataactggtaaaaatatctttaataaaagacagcaccattacaatgataataatgctgtctgagtaatgttttacctcagttattgaatattaaaatactttaactgagggaactaatggtacaatctgatctcaatcaacctcacaactttgattatccgtttcaataaaatggttattagtttctacaaatatatacatttagacactaaaaagtgtctaaaatgaaaaaaaattcataaacttgtacgattgaaagtttgtcatggaaagaaagccagtagcaggaagcattcggaacaaagaacgtagtaaaaaaaagttcctggatgcagtagggaaaatactgagaacaaaaggatataccgccttgaaagtaagcagtattgctgcagcagccggagtagataagaaaatgatctattcttattttgggggcttagacgggttgattgatgagtattttcgatcacaggattactggagtgaattagacattgaagaagttgaaaaaataagctttcaatcagaagatggtggaaaatctttcatggaaaaaatgcttcagacaaaatttgattatgtctacaacaataaagaggcacaaaaattacttctatggtgtttatcggaaagccggaaaccattaaaaaaactcaaccatatccaggaagaaaacagagaatatatttttaaaatgctgatgaatccctatgttaaggataaaactgaagatgtccgttctattcttgccattttggtttctggattgtattatcttaatatgtatgctgcgatgaatgggagtattttctgtggaatagacctcagtactattaaaggaagagataaaatcaaaacagcaatctcatttctgctgcactgtacttatgaacatttgcagggttctgataaaaaaacaaaaccattagaaatctaatggtctgtctataaagttgcgtttctaccttagtcgtttcatttcgaaatgttcttaagtaagggaactcaataatacaatgtgacttgttttatttttcaacctgatagtgttttaaatatatagatggtattagtttctacaaatatataaaataagacactactaagtgtgtaaaataataaaaattttattggttttatttaaagcgttgattatcagtgtaataatttttattgttgtaaagtgattcttactttgatgagcaaaacagattcggttttacccaattacagaagtaatttttatgcttacctcggtgttgtcaaataagaaatatctatacaaaaatattttatttatatcaaaacactttcagatttaaagacaaaccgctatgaaagagtaataccgtttttgtcttttttcctcaggtgctgatgacagaaacattttaaactgagggaactaacaatacaatctgaagagttttatttttcaaatctgatagtgatcctgtctgtttggtacgatcagtttttgcaaatatagacaaaccaatgatattagacactgtgtggtgtctaaaataataaaaaaaattcttaaacttgtatattgaatgtttagtcatggaaagaaagtcagcatcaggtagtatcagaaataaagaacgaagtaagaaaaagtttttagatgccgttggaaaaatactgaaaactaaaggacatgcagggttgaagataaatgacatcgctgctactgccggggtagataagaaaatgatctatacctattttggcggaatggatggccttatggacgaatatgtcagaacacaggatttttgggtaaaagtaaccagtgaggaagtggaaaagatgaagccgaatcttgaagatggaggcagagaatttatcgagcatatgctgctttcccagtttgattatgtatacgccaataaggaagctcagaaactcttgttgtggactatttctgagccccggaaatcattaaaaaaactgattgacactcaggaggaaaacggagaatatatcttcaaattattgatggagtcccgtttcaaagataaaatggatacctatcgttctattatggctattatggtttcaggattgtattacctgaatatgttttcgtctctgaacggaagtattttctgtggtatagataccaatactcctgaaggacgggaaaaaatcaaaaaggcaatatctttcatggtagagcaggcccacgataatctttaatctattataaagaacagaaaaagggacaaactattgtccctttttttatgataattatggtgtctatcctttatgataaggacagccagaagctgcgccggcattaactccggtattaaagaactgctcttcaattacttttctctgatcctcaggaatatcttctattttacggagtgtgttcacctggatgtggggccagctcgtggtaccaccgtcatttccgaaatcaaattcgaaaaatacaatctgctcatattgcagctgaagaatctcttttccgttttcaatcactgtttcaatccacatgttcatatccacttcaacggtcgggacaaaacggttgacaaacggtacatttaaaattccgccctgcgccccggttttcatcttggaagacattctgacatggacataattgctgacctcctgacctcttaatgtatctctgagtcttaaatccggccgtacagaatagggatacaaatcatcagccagtattctctgggtgtaaattttgtttgaaccaggatcattatcatcattaagtgtttcatgcacccaggccggtgctggctggtcaagatcaataatattgtcaggtgttacccctgcatttcccattgtacgtgaaatagaaagatgattcgtatcccatgcctctttaccgtaagggaacttaggagaaccattgattaaataaaaggtttgatcagcagtattttgcgggacaatatctccaagcaaagtaatggtgctcccatgaggaatcacaccgcttcgcgaaatagagtagtccgggataaaataaggaccatcaagtcctgctcccggctttatttcctgtgcaggaatgatttcataataaagctgccccggttgtagctggctttgaaggatatactgaggatttgcttcgccgtccggtgttatcctcagcaaaggctcatctctgtattcgccggtatatccatacttggcatcttctgttgaaacggcatggataccacggtctctttcaatagattttttggtagccgcatgattatagacatcgctcagccaaagatacattccgttttcttcatgaataggagtgtattttaatgcttcctgcccctgtacggtagtcgcacttttaatactttgctcatatttaactgctccgcagaatagctcactggcaccaccacggttacgtacaccgccgggaacaatggaaaaggtcagtttctcaatatactcttcactggtaaaagcgaattttccgggaattgttcccgggttggttcccggagacggcataattgtagtatggacaccgcttgccagtgaaggactggtaacatctttattatagttcacattatagcttacccatgtgccatccaatgcggcaaggataccgtaatctacattgttttcaatcgactggagattgtcttctctgaatggtcttaccggatcatcaataagaagcctggaatagccatccataagttcggccagattaactccattttggtctggcattctgcggaacagctgttctcctcccgcttcgggactctctttttttcttttaagcatgatatttagtttttatagttacagatcggtgtattcaaatgttggtcccgcattagtctgagcatccaggggttgtttcatcagattaacagcctgttcttttaaagcatacatgtacataattgatttttcaagctctctctggttaccttccacagcactttgaatagcatccagcagacgtctgtatgttttattaaattcaatagcctgagtatgtaattctttatcttgaatataatcttccagcttaggattgggtttcatcggatatgcctcattccagtctaccggaagatcttttcctgtaggcggtgtggttacaggcatcatcccattttcgtccatgaaaggctcatagtttcctcccagataaaaatgctcatggaaaacttctttgaatctgaaataatgagccagttcaaccccttcttcaaactgcgaaggatccacatcgaaaatagaatcatcagctccttcaccctgacccttaatttcctggaaaacagcaataactccagttaaagcttccacggaatgtaattttccaccacttccataatattgttcaggacggatttgtttttccggctctcctgtgaaaattcctccggtatttaattcttcgaaattcttcggaagtgtcccatgtgctttatagtaagcaataatctggaaaataacgatatagaagaataaaacatcataatactcaccaatggtgtgtacattttccatgatgaaacctttcatgttttcaagtgtccagaggtggttttcctgcagggcagctctttgggaatataattcagaagttttcgtttcataatcatatttcggagcttttaccacaggagtgcttggactttcgatggcaataaatgtagcaatgctgttgcttgagaatgcttccagacctacatagaaatcaacattcatgggtaatttcatgggataagtagggtaattctcctttttgttgacggaaggttgaatatcgatggcattcaatacattacaaaccatgatcaaatgaagcatttcctctacggcaacacttcttatgatttgtgaagccagagcattggttccgtctttaattgaatacaaagcggtaagataaggtggaatggtagaatgctcaataagaattgctgtttgcaaaaggtcctgcaaaatcggtttgtaatcgatttctgtgatctctttttttatttctgaaattcctgaaccgaactgagattccagataggcattaaaatctttaatctgatcattcagtaaaagatgggttactgttttactatgatgctttaatccttctatccagtcttctttactcagtgttgaatcaaataataaagaaggcaatgaaacaggttctataatggctgcgcttcttgccgccaccattttttctgctgttaatgtctcctgtggttgtggtgctttattgataagtctttgtctcatgttgttattttttaagttgaatttcaagatcagcaagaatagattctaccgaacggatggtgaatgctgataatgttaaagtaggatttgatgttcccagcgtggtcatatttcccgcacctacaacgtataaattcggatgatcccaggttttgcagtagctgttggttactgattcttcagctttagaacccattctgtgagttcccacgatgtgccctgcaccattgtaagaatatcttttcttattgtatatcacagagtttttgtctttctcagtatattttgtgaaatccgtaatgtttaatcttttaaacatttgatccgaagcattttttgcctgctccatagctttcatttcatactctgtaagttcataatgaatcacaggtcgtggaattccgaggacatccagatattcatcattaatggttaccctgttattgggattcgggagctgttcaatttcaaaatgaaataatacctgctttgaaagtctgtcggtgagattttttcttaattctgccccaaactgtttttctctgataaagtaagccacatcagaacccggagaaaatgccggccaaccccagccccaattgtcgagcggagagatccatgcggaaaagtcctttctgaacgctccgtcacggaaagaagaaatgtttgtagtggaacccggacctctgtacggatacactggttcagggaaaagtccccacgtaagcattaccatatggtccatcaggtttcttcctacctgatcactgctgttggctgctgtttttacaccatctgaagttgtatatttggagttcagcagaattttcggattttcaaaagcattggccgccagaatgacgatggcatctgaagtatcaatagattcttcaacgaaatcggttttttcttttgagatatatcttctcagatgaacctttgaaactttatgattatcatttggatcaatgcttaatctgtacactacactctgtgcctgaatctgcatgaatggattacggctcaggttatcgttatcatttattttatataaagcctttttcaatgtttttaaggcattgtacttcgcctgaacaggacagatcggaacacacgaagcattcccttcgcagcgttcacccatataaggattccaaacagaaccgagcgctttgtattcttcttttccggaactgtctaaaaccagttgatatccggagtcctttggttctgctttaatgatcttcgtttttccgtattttggattgggaacggaatttctcccttgtggagaaggcaccatcattaaaggaatttctcctgaacttagatttacacttgtccctttaagtccctcaataatcttgtggtccatataactctgtggaatttcttccattggaaatacataattcccataataatcttgcattttctcagtaataggatattcctgtttcgaaacatccccggaaaccccgatttcaaactctgccatctcataataaggccttaattcttcatagcttatcggccagtcgacaggagtttgctcatcagaatccggctttggaatcgtaataccatatttttcggtaagtttgaaatcgttgggaagcattcttggagtggttcccagccagtgaagggtagttccgccgcctactcttattgcatcactggcaaacggcatcggcccgaactgaacgagatacccttttttatccggatacggctggacaatatgttccatatccagaacgttgggagaaggagcctgctttaagttcggataaggagaattgggaactttggcttcctctctgtaaaaagtccggatatactcattataagtggtcattgaggatacggaatccagctcaatacctgcttccaggcctgcttcgtacataagtatggaaatctccttaatattatcagattttcccgcatctgcacgatgaaccatttttcctttggtgacgttaaatacatggtcagacaatagctttgcgattaatgaccctgcgatccctgttcctacaatgatcacatcttttttgttatggattggattcatgagtggatgtttacaggtttaatattccaagatttgtagccaggttgttttgctccgggcggatgggcatgcatcaggttccatacaaggccttccttgtaagaaagatcattgatataagcaccatcccaggttcccaggtaccacatggtaattacttttccggctatgtcgttcattcccgggttaccaataatttcggattggatggcattttttaatgcttcctcaccggaagaattttcaaggatatttttagaaaccgtaaggaattctacgaaagtggctgcttccaggctttttaaaacatatgtgtaataggtttctgcaagccctgttgactgcagttcgtttactgtgaacccggtaagcgcttccgagatagacatgaacacatcgaaataataatcgtcgacgttgagaattttgttaataatattcatttcgtaaaaaatttggattcaatatcttcaactccctttaacaggagatgatcaagctgattgatctacagctgccggatttttcagatatcacctctttttcagaaatgattgaatgtatttcagacgatccatagttatcaattttgttgatccgaaattaatcacatcccggcagataagattcagtatttctacgtaatttgaattaataatcttttaattttttgtaacaattcctttgttgtaagtgtttggaagagattttattttcacatagtttagaattattttaaataatgtggtatcttgttgtttaaaaatatcggataaaaacagtgatgatagcctttgatataaataaaaaatgcctgaattgaatattcaggcaggattaaattaataaggttgaaggtaagaattatcatatcatcgtatcagatactcctagctgtcaagctgttccacagcaattgcgtctatttcaaacaacattccgggtaaagccagctgacttacaggaataagtgtactcgttggaagcaatgtagatttccagactttcatggcttcttctgtccatatctcaagtttttcctggttgtggtctacaataagcagggttattttaacaatattatcaaacgtcattgaatggctctgtaaaacgatttgcaaatttttcaaagcattctgaacctgagttttaaagtcatctgccaatacatgattttcacctacgccgccactctgtccggatataaaacacatcctggaaggagattccacagaaatactgtgagaaaaaccataaggagcaggattaaataactcagcaggattgatcagtttgggttgtttattgttttccataatctttcatttaataaagtaaaaatgagaggaaaaatttgaaaaaacatttacatatgttgaggaaagtatttttttaattctttatatactttcgtgaataataaaattctgatacaaaaaattgctgttcgaaggaacagcaattttttgtttttattctacaataatactttcaatccctttttgcagggctgtttcctgaacgaccggaacagaaagaccttctgcacggacaacagaaatatccgtcattcccataaatccaagcgttttttccaagtaaggaattacgaagtcgtaagcctgtctttccccttcagaatatacgccgccacttgaaaaggcaaggtatacttttttattttttaccaggccttcaggaccgttttcgctgtagctgaatgtttttcctgctctggcaatatgatcaagccatgatttcagtgtggaagtgatgctgaaattgtacaggggcgcttcaataacaataatgtcagcctcctgaagctcatcaattaccgtatccgaaagctttacaatttccgactgttcagaagtccggttttcagccggcgtaaagaatgcattgatatgcgcttcttccaaatgaggaaaaaggggatttgccagatcacgtttttttaaaatatggtcaggatacttggctgtgattttctctacaactgcatttcccagttttttactcactgatgattcacttctcggacttgaagtaatatgaagtactcgtttcattttttattttttttaaaattgatgttccaaaattatctatatttactaataaaaagatagtagttaccgaaaggttagtaataacatttaggttagtaacagaataaaacagaggtaatggaagaagaaaaaatagtgtattcaaggccgcaatgcagtaaccatctctctgctacagaggatgcattatatgttcttggaggcagatggactatacgtgtaatgattgcgatcctgggagggcacacccgtttcaatgaattacagcgtaccatcaagggaatatctgcacgggtattatccagtgaattgaaaaaactggaagttaatcatctggtagaaagaaccgtaattacagatcagaaacctgtgctggtagaatatgttcctacagagtatagtgaatctctgaaagatgtcattgctgctttggcagactggggaacaaaacacaaaaaaaaaatcactacataataaaagtatagcggtgttgcagcaaaatcactttttctgtggtatttgttaagttgcaactttgcttgtactttaagtatttttactcaatttaataatggcaagatgatcatatgcgaagacttattattttcccacggagccagtctggaaaggtatgaagcaggagaaacaatttttcaggaaggaaccgctgcaaaatattattttcagatcagatatggcactgtgaaactgaatactttattggaagacggaaaagaatttgttcacggccttccttttgatgggcattgcatcggcgaaagttatttgtttacagggcatcattatgctgttaacgcagttgcagtgaccagctgtgaaatcatcaggctttctaaaaccagatttcttgaaatattgctggaaaaacctgcattaatgcttgagattaataaatataccgcagacagactgcatttcaggtatatgatctccagttttctggctatttcagatcctatcgtaaagctggtgaaacttttcgaccatcttaaaaaatattttggttttgaagaagcctattcattcctgattccctataccagacaacagattgcaacactcaccggtctccgggtagagacggtgatcagatatgtcaaaaaaatgcaggagctgaagctcgttaaaatcgaaagctctaaaatttattattaatttcaatcagccttttttatttcaggatgagtacaggctgatgggtgttctggtaaattccttcggaaatacttctgcttgccagatagtacaaaaaactgtgcttgccgggcaaagcaataataagatctgcttcatgagtggctgcaaaagtcagaatgccattaatgatattttcatcatgagagtaataaatgttgcttgggatttctgttaaatgctcacggatatagtcttcaagctcttttttcttgttttcatcttctttttcgcgggcattgatatttaaaaaagacagatgcacatcctgcttatgaatgagagatttatgatgaaacaatctttctaaccgtttaattccattgatgtcacaagggataaaaatatttttaacaggagtataatgatagctgttgggaacaattaaagtttttacaggacttgttcttgcgatacttataatattgtcagatacaaaactttcagtggcagatgtctgatcgtcacttcccagaataatcagttccacagacggttcatcttttaaaagttcattgatacttctggtaagagcccaatcacttaaaatttttgaaaccttgatctcaggtgatttttctgttacaatgctgcttaactgatcaagtaataattctgttctttgcaatagattgttgacactttcttcatttacaaatgaatgcccttctgcaatatgcagatagtcaaactcagattctcctgccgtttttaataggataatgttttgatagccgtaggtttttgcccagtctgcggcaactcttactgcattttctgtagttgatgtaaaatcaacaggtacaaggattgttctcatattgtatcgtgttttgatcccggttattccaggtttgctgtcattttttttaccaatagcagtgctttgctgatttctttttcatcaatgccttcaactgcctttttataaagatctaatgcccatggataaacggtttccacaatctgtttacccttcggagttaaaaaaatctgtttatttcttctgtcgttttcatcagctatccgctcaacaagatctctttttacaaggctgttgatgagataggtaatactggatttgtctttgcttactttatttcctatttcctgctggttgattccgttatagcgtgaaagtaatcccagaatctcaatcagttcaaaagacagatcagggtcatattcattaacggtagcctggatcttctgccggagacggctcttcatctcgctcattgccaatccaagctccagagccagttcagaaatatcattcttttttgcaggcatactttttatttatataatgataaacaggttaggagtcatacacaaatggatttttagcataaccttaccctaacaaatatacggaaaattagttttaattaaaactaatagaatgttaaataatgaccggaaaaaattaagctggaatatacttttgcaggaataaattttgctgttgtttattcaataaatttcaaagtgtcatttaaaatcgtaatcatgcctgaaattgcattaaaaagagtttatgaggctgcgtctccggacgacggataccgtgttctgatagatcgtctttggccaagaggcctttctaaagaaaatgctgatcttgatgaatgggataaagacattgcaccatccacagaattaaggctttggtttcatcatgatgtcaggctatgggaagaattctcagaaaaatataggaaagaactccatgaaagtaaccttggaaaagatttcatgaaacgccataagaaacataaaaaaattacattactgtatgcagccaaagatgaagaacactgtcatgcaattattctgaagaagtatcttgaaagcataaaataaacataaaaaaagcagagaatcaactgatctctgctttttcttttttaacagcctgatgcatcatcataataatcccgaaaagaaaacaggcaatgatcagataacgccaggaaagatctttctgttcacttaccgttccgcttaccgaaatgataaagcttgttacggaggtaatcacatataccaatccgcccatgagtccgccggcagttcccgcgtttttaggaaagtaaagcatacttgtcgtaaagaatgaggtaaataaaattccggagcagatatggatgaagaatgcgaaaggaatcataataaaaagactttctgcaaaataacttgtgataatcaaccctgcgatgaggattagctggagaaaaataggctgtaaaatccttgatctgaatccaagagtcagtctgcgtttcccaataaaacctccgatcatccaggaaaaccccaggatcaatgtacaatatccgatcactaccggagtaaaatgaaacgtattttcaataataaaaggtccggtaatattaaacaacattacaatggagtagctcagtcctaagatgaaaattcccagcataaaaatcctgttcttaagcatcattttgtaaaggctgatattctctgaaagatccagtttctttttttgaggaaggctctctccgctgaagaaccattcaaaaaggaagaggaatccggcgtatgcggcaaggaaataaaaattggcatgccagttaaacattttctcaagataacctccgaggaaaggtgccagaatgggaccgcacgaccatacaatggtaaaataactcagatagtgcttcactttctctgcatcatatatatctacaaaaatagcacgggtagctacgacaagcactgaaactgctgccccctgaagtatacgaagcagacagatcaataagatactattcgtcatagtaattaaaatacttgtcagaattaacagaaataaggcgatcagtttgggacggtagcggccgatgctgtccagaattcctcccacaaacaactgggaaatcccgtagctcagaaggtatgatgttaaagtaatctggatatctttttctgataccatcatttcttttgccatagagggaaacgatggtagataaatgtctgtgacaaacccggaaagcgggatagacacgaaagccataatggtaattaatctgattcgttgttcagatgcttctctcaacatattcattcattttttactatgcaaaaataagccaggaaataggaaagtgaattttaaaagacaaagtaaaaattacaaaaatcaaagattaagataaattcttaaattttaatggtgaagtgcgggcgtgctttttaaagaaattattaaagtgggcaggctggtcaaatcctaacgtatagccaatctgggcaatatcccagttcgtatacttcagcagatttttggattcttcaaacattttttccttgataatctgagtggtcgtaagatttgtcacggattttaccgaagagttcaggtggttgacatgaacgttcaggtgttcggcaaagtcagaaggcgtttttaaagccagcggataagcaggagaatccaaaggaaactgtttgttgagcagctcatcaaacagtttatataaacgcacatttgcaggaagctcattcggattgatatcttctacacggttttcaagagccagatgcatcacggacgccagattgcttttgatgctgctgcagcggaaaggataagtggagttgttcattctgtacatctgctcgaaataaagagttgccagctgagtttgctcctctgtcagaaaaacaaccggcttgctccattctttgaacatcgatgtttttttgaacaggttgaattctgtatttccactaaagaattcctggttaaacaaacaaaagtatccttcctgtacatcactctcacattcccatgaatacggaatacccggagatggaaagaacagggcagggcggtcaatatacagctgatgtgaaccataatgaatcgttccttttccaatgataaagctgattttataataatcacggcggttataggggcttttgaagctgcagtatctccgcatggaaatattgaagtgggattttcccgtttcaaagtcttcagaatcaaacattttaatctgatctttgcggatgcgtctgtaataatcttctatggtttccagctgatcactcataaataaaaattataaaaatcaaagataagcaaactgctgttcactcatgattattttaagtgagataataagaatcagaattataggttttctcgatttcgttaaacatcttacgaatctctgtcctgtagttaagaatcagtttttattaatctccagttccaaaatatgcgaaggaagctgaaaaggacccgcctttgaaatatccgcagttacaaatccggactctttaaaaaatgctgcaagcggatcatggtccagcatattgatccatataatatcagtgaagcttactgctgatctgcattttttccagagtgactgccttgtttccggagtgtcaaactctgaaagaagcacaaaactgatttctgttgctctttttccttcaggaattccgggatgaagagaaccgcttttaataatgctgtatcctatgggtttctggtcagcataggtcatgatcagctggttggaaagatcgttaagatcattgatcatctttctcggatctatatcgttgtgaatatattttttaatctgctcctcgcttacgaaattcttatataatgtataaacagaagaatcgataatggttataagatcagaaattccttcttcagaacctactgtaaattttgaaataatatccatggggatttttttttattcaaaattataagattaatctatttaaaaaggatacagtttgctaaaatataatcggtacagaaggatatttttataaatttgttcagtacagttgaaatgtatgatgaaaccctataagtacgaagtttttgcagctgcaatagaggaacagatacgcaatggaattttacaggaaaatgacaggcttccgtctgttcgtgagattaagaaaaaatacaagctgagtacaagttctgtacaaagcggatttgaatatctgatgatcaaaggactgatcaggagcaatccacggtccggatattttgtcaggagaattcaggatgaaaatatcccggaagtgaaaacaaaattcccggcggtcgtgagagacgaagtgtttatgaaaaacataatgctgacttcgaaaaggacttccgaatccagctcttttaatacggcagtgcccggtgatctgctgattccacagaagcttatcctgagaaccatgcaggaagttattcgtgaaaaaggagcatctcttctcagatattatccttcaaatggccttgaagcattaaggatgcatattgcaaaaaaaatgggcacctatgactgtaccttaaatcctgatgaaataattatcactgatggtgctttgcaggctcttaccattgctttaaaatcggctgtaaaagccggtgatgtggtagccgttgacagtccttgtgtgttttctgtactggaagtaattgcccatctggaactgaaagtgatagagattcctgtacattataaaggaggttttgatactgaattcttcagaaaagcttgtaaggaaaataatatccgtgctctggttgttactccgaattttcacaaccctacaggagtgctgatgaatgatgaaacaaaaaaagaaattctaactattgcagaagctcatcagttatatattattgagaatgacatgtattctgatctatattttggcgagcaaagaccacgcagtataaaaagctttgatacgaaagatcaggtcatgatctactcttcattttcaaaaacactttcgccgggaatccgcctgggctggctgtatgccggtgatttgtatgcaatagctgaaagagtgaggtttgctttgggacgttctgtttctccgatatatcaggagttggtgttgaaactgctccagggaaacagctatgaaagacatcttcagtccttccggaaaaaacttaatcagcaggctgctgaggtattggaagctgtaaggaattcttttcctgaaaactcttattttcacagaccacagggaggttacagtatttggggacagcttccggaaagtacagatatgaaaaggttttacaactattgtgagcgataccggattttatttactcccggagatactttttcttttatgaacagatatcattaccatttcaggattatttttgcagaaagaattacttctgaaagtattgttttgctggaaagtgcgggcagtaaagcaaaagaattgcagatttaagaacattaagtttgaaaggtaaatccaaagattttataagtaagacctgtcaaacggagtgatgttgattttattcgtttctttttgatttttaatggtttaattgaatattaaattatactctatatcatgcccggttagatgcttgatttctacaatacttgattttcattttaaaaattaaattgaaattaagaaagactcaaaaaaaataataaaatctgctattttttttcagcacaattaggctggaatcaccataaaacctatatttgcagcctaaatttttaaataaatgaaagaactaattgaaaaaatcaacgcagaatttgaagcgttcacaactgaggcaaaccaacaagcggaaaaaggaaacaaggctgctggtacaagagctcgtaaagcagctttagaactaagcaaactgttcaaagaattcagaaaagtttctgtagaagaagctaagaaataattcacctttaaccggcttttgaagccggtttttttatatctgtactttcctgatcactttcgatcctgtcatacatttatgttgatgctttttaaatccaatgttaatttattttgtttgaatacataccatttatataatttgtattttagaaacatcaatgatggtatattatgaaatatttttatctgctgtttattctcttttttaattttttttcagggcagaaattaaaagttgtggatgcagaaaacgggaagcctattttcaatgcaagaattcttttacaaaatcagattgtgtataccaatgaagacggttttgcacctgttgaacaaggcgctgtgaactttgaaatttctgcttccggtttccaaaagacaatagttcatgaatttcattctgttataaaactaaagcgggtttataaaaaaattgatgaggtaaaactagcaaaaatcgatatcagaaaactctttgaagacgtgagtgataattatagaaagagatattacagtgatccatctctatatgacgtaatctacaaagaaaaaaagagtgataataataagctttattttttagtaattgcggagactaaattgtggagtaaggccaattattacaaccataataaatcctatgataagaacctgcaaatgcagttaaataatgtgaaaagctttaaaaatgtaaagtcagacagtatttttaccgcaggattaaaagaattttctgaagaatatatggggaatttttttttcaattttgaattaacacgggtgctggctcatttaaaaaataaagattcaaaatattcaggatggatgatcttcgaagaaggcaatgaacaattggttacatttagtattaaatcgggattgggaattgaaatggaaggtgaatttaaatttaataaagcagataaagtaattaactattttgagatccattatttacaggatcaatatccgatgatgaaaagaaaaacaggagagggggaagaatatgattatcaactgggaaatgcaatacttgttttcgatttttataagaatgatggaatgtatgttcctgcaatgagcagacttgaagggaataaatatgttgcatattacaaaggggttaaacatgaaaggaagagcagtagggagcttatatacaatacctttaaaaaatcagaagaaaaaggacttgtccctaaagtggattttactaaaaatatttgggataatgttcaggtgaaagaaaataaaaataatacaattttactttccagggaagagcaagcttttatcgataggaaattacctgattttggatccgaatagcagaaatatttctaattatattctttataaatttaatttattatataaaaaactctttaaacaatatagtttaaagagttttttgctttcatttccccaatttctgctatctttaaaccaatcaatatatattatgaggataaatagattttttgcagtgccagcagtagtgctggctgcccagttttcatgggctcagataaaggttgaccccaaagaaaggttagaccctgtcgtaaaaagttttgtagatgaagtaaataataattcccagctggaaaatctggcttatgaactgctggacggtatcgggccacgccttgtaggaactccggaaatgcttgctgcaaatgaatggagtgccaataagcttcgttcgtggggagtggatgccaatcttcagcaattcggaacctggaaaggatggcaaagaggaacaacgcatgttgatatgacctatccgcgggtgaaatctcttgcagcaacacagctggcttggagtccggcaactaaaaaagcggttgaggcagaagtgattactcttccgaaagtatcttccaaagcagaatttgaccaatggcttccttctgtgaagggcaaaatagtcctgatggcacaatatcagaaaatcggacgctctgatgagcagatcaaagaattttctactcctgagttgtatgaaaagcttaaggcagaaagagaacaggctgccaaagactttacagcgtatgtaaaaaatataggatatgataacaacagccttcctgaagcgttagaaaaagcaggtgcagcaggcattgccatctcaaactggaccggtatcatgggggctaacagaatatttggcgcaaaaacatccaagattccaatgatcgatattgatgtggaagactatggaatgctttacaggatggcggaaaaaggagggaagcctaaaattaaaattgatacccagtcaaaaatacttcctgaagccaaaagttttaatacgatcggtatgatcaaaggaaaagaaaagccagatgaatatgtgattctttccgctcaccttgattcatgggatggcgcccagggcgctacagataacggaaccggaacgatcacgatgcttgaggcaatgaggattctgaaaaaatactaccctaacaataagagaacgattgtcattggactttggggaagtgaagagcagggactgaacggttcaagaggttttgttgcagataatcctcagattataaaaggagtacaggctgcttttaatcaggataacggtaccggtcgtgtggtaaatatcagcggtcagggatttgtaaaagcttatgattatatcggaagatggcttgatggtgttcctaaagcagtaaagacccatattaaaacagacttccctggaatgcctggcggcggtggatcggatcatgcttcttttgtggcagcaggagtaccgggattttctttagggtctctgaactggggttacttcggatatacatggcacactacaaaagatacctatgataaaattgtttttgatgaagtaaaaaataatgtgatcttaacggccgcattagcgtatatggcttctgaagatccggaattcaccaacagagagaagagagcaatgcctcaggatgataaaggggaaacggtaaaatggccggaagtaaaagaaccaagaagaagttctaaggattataaataataatttttcttctttgaaaaaatcaaggctgcctaacaggcagccttgattttgatatataatcttatcttgcaatatcagaaatatgaatctttaaatctgaaaatgtaagaatggatggctcataaagagattcagctaactttccaaaaccgtattcacagaaaacaaacggaagtccattagcccttgctgaatcataatcggtttgagtatcacctatgtatacagaatcttcaaaggatagctgatttctttccataagaagtttaatattttcagcctttggcttttgggtccggccatgggattcaaaatcagtaaacagatcattgaattgataatattctaaaaaagattcaatataaccgtcctggcagttacttacaataaaaagagaatgagtactggcaaggcttttcaatgtatcttccacaccgtcatataaaattccgccttgtatacgcaggattttattttcttcggctacgatctcagaaaggagttcccgtatctgaaggtccgaaatttccggaacaatatctttgataatatcgtgagctaataaacccatgtactgatccatgtcttcgggttttatttctctctggatcaactgacgtttacccaataccttattccatattttgatgatcgtcgttctgggatcccataatgtcccatccaggtcgaaaattaagttctttgtgttcaaaataaaaattttgtgtttatactttaatctgcagcagctatttacaaaatcatactcagctgcactctttttcttgcctcatccacttcggttacctttacacgaacatgctggtgaagctttactacttcattgacatcggaaacaaatccgtctttcagctgagaaatatgaaccagtccgctttctttaattccaagatctacaaaacatccgaaggctgtaatattattgataattccaggaagaatcataccggcttttaaatctttaatgcttttaacattaggatcgaattcaaatactttggcggcctttcttggatccagtcccggtttttcaagttcttttaaaatatccttaattcctaaaatcccgatctctcccgtgatatagttttccggttttaccagagctattttttccttattggcaatcagttcattggttttaatccctaaatctttggccattttctcaacaattccataagcttcggggtgtacggcagaattatccagcggatttctggcattcgtaatccttacaaaagctgctgcctgctggaaagctttatctccaagtctcggaacctttttaagctgctttctgtcttcaaacgctccgttttcagtacggtaattaactatattttcagccattttttccccgattccggaaacgtagcttagaagtgatttgctggcagtattgagattaattcctacagaatttacacatttcatcacagtagaatccagctcattttttaattgagtctgatccacatcatgctgatattgccccacacctatagatttggcgtcaattttcaccagttctgccagcggatcagagagtcttcttccgatggaaacggctccgcgaacggtcacatcataggaaggaaactcgtctcttgcgattttacttgcagaatacactgatgctccggcttcagaaaccacgaaaacctgcagaggcttatcaaaagcaatttttttaataaaaaactctgtttcacggcttgcggttccgttaccaattgaaatggcttcaatattataggcatttaccatagaacgaatttttttcatggccattccgctttcgttctgtggagcatgagggtaaattgtttcgttgtgcaacaagtcacctttttcatccagacatactactttgcagccgcttcggtatccgggatctattgcaaggattcttttctctcccaaaggaggagccagaagtagctggcttaagttttcagagaagatttcgatggcttttttgtctgccttttctttggcttcctgcagggcttcatttgaaatggcaggctcaagaagtcttttataactatcttttatggccagcgaaatctggtccgaactttcattatttgatttaataattgctttttcaataaaatctattgcttcatctttatctattcctacattcgttttgacgaagccttccgcttcagctctcagcatggccagaagtctgtgggagggagttctgttaaggctttcttcccattcaaaatattgggagaatttctgtgcttcctcttcatcttttttagcctttacaacttttgaagtaataactgccttacgctgaaataatctgcggagatttttacgcacatacatattttcattaatccattctgccataatatccctggctccctgaagtgcttcttcttcggatgtaacttcgctgctgaggtattttgatgccagaaactgcacatcattattcttttgactcatgataattctggccaaaggttcaagccctttttccttagcggcatcagctttggtttttttacgctttttgaaaggtaaataaagatcttccagctcctggatgtcaaagctttcctctattctctgttgaagttcaggcgttaaagaattctgttcttcaatagattttacaatagattcctttcttttaacaatctcttcaaactgcctgcttatttttgaaatctgttcgatttgtgtttcatcaagatttccggttttatctttccggtaacgggaaataaaaggtatggtacagtcttctgctaatagttgtaaagtattgttgatgctcttttcagaagtattcagctgtttctgtataaattctacggtcgtcattgttctgttttcgtaaggctaaaatagggttttgcgatgaaaaaacgggaatacaggtataaaaaagcccgatggcattgtgtagcaatcgggctgtatcatcagtttttaaattaattaaggcagaacttcgttataataaagcggagtatcattgtttttatcatatcctattatgatcactttgtacttttttgcatcatcattgttataaaactgtacttttgatgattcttcaggttgtgcttcaagaaaggaattccaataaagaacacttcgggtatcctgtgaaactcctttaaatttttcattgccataatcagggctttcaaatggagcttctttgtcatatccggttaaggtaatctgtcttaatttggaagatacaattctatcagaagaggctccccggcggctataaatagcaatggctccattaccaccaccgaaaccgcctgcaaagaatccttttatcacttttaccatagcaatatctgatgtagaaatattgtctacctggctgggatcaacaagcatttcatcaagatagatgcctacttgtcctcctcttagggatgcagtgtagcttccacgctgcatttgaattgttaagccagcaactcttccctgtagccacttcagaatattggttgaagttaccattgtagagtcatttacaaaatcgaaaacctgctcattcatgcttttgaatcgtgggctgctcaactcatcatttaatttcttagtcttattctttacttctccttttaattttatttcttcaatattggtgatgttttcacttatcactttttgagcattaagtgctgtaagtgagcggctgacctcactagatggtttatcatcagaagggcgctgaaccagtttgtaagaacttgtaggaagattctttttgtaaggaacaaaattggaagtaggctgaaaatacacagaatagttattattgagatccttcggctctgaatttagctggtaaaaaaacttcatagaatcctcaaataccagattgttcagtgttagaaatccattgttgtccgatattatctgagacattctggaaccaggctctgaaccgaaaattaagtttacttctgtattgggagcaggtttcccttgaatatttacttttcctttgtaagagagataactttccggctgatatttgatcatcgggtaattgccagtcataatggatttccattcaaaacgtttccacttttctgaaatcagcagggcatccaaagcatctgtattgcgagtttttgtaaaatactgagcaggattggtaataggtgaagtaatgtctccggttaaccacaaagaactcagtaaactttgatcttcttccgaactcctggtattggagtcaaggactaaaaccgtataattggagtaattcgcatccttgggaatatcaaatgaattttttcctcgtggtgtatcttttagcgaaacagactgtaatgaaggttgcttgaactgtaatgactgtggctgaacaaaagcaagtctgtttaaaatcacattctctttatcatcaaaaacggtaagttgcaaaattccattcacaagttggctgttggaaatggagtattgagtttcattattgattttattaatcttagctttataaacaagttggttgttgatagttcccaaaacagtataatattgtgaatcttgagagagagatttggactttatcgtatattttacatggtctttatcacttgtcacctgcaggtttattccggatgcagaaacttcagggagtataacgttttgtttttgtccattcttatcctgaacaatcagttggtacttctttccggttttaggagtgatattaaatattccgatattttgatcaaatcctttaaatgttgtgatttttgtatctggactatcagaatctatgacgtatccttcccattcagaaggagctgttccgttggattgtaatcgtactgctatttttgtattgatcccatctataaaggttccgctttccgggtatgctgtcacagtccatggagttggattgtctatcaatttctgtggagatgaaggattataaatggcaataggttttataagctgaaaatcttcattaaaatttgccatccagctggtataagctctgatatagtaaacatcttccttgaagccggcaagagaaatattaccgctcccttctccgttaattaatggaatcaattttttactgatctgatttttattactgtcataaagctccacaaatagagtagtggaaatggaagatgtagtatagccatcaaaaacgaaagacttaaaccataggttttctcctgccacataactgcttttatccagtaaaagatgtattttttcctggggatattttttttcaaatgttttgagagcctcttcggccttggtttgtgcattaagaccgtagattgtgcttattgctaatagtgttattagtttttttgacatatttcattaaatttgcgtttttcctacaaagcggcaaaaatacatttttattgtgatgtataataacggaaaatgtaaaataataagaatctgtaaaatctggcatatttatttgctaaagctatattttacggtttcccgtattgtgtaattgaataatttatatacttttcagtcaggaaaataaaacttaaattaacacaaataatgaaaaacaaatttattgcgaggttactcacattagtaaccattatggtcttgttctattcctgcaggaatgaactcacaacagaacaagaaacctacaacaacagcagccaattcaggccaacatccaaaacaatccgtttagaccaaagtaaacacaaattagctcttaaaactgaattacaaaaagcacaaaacaatctaacagaaatcaaaac

(The sequence listing continues in the following parts.)

What is claimed is:

1. A method of killing an insect, said method comprising contacting an insect with a composition comprising an insecticidal indole compound, wherein said insecticidal indole compound is a diindolylalkyl compound.

2. The method of claim 1, wherein said insecticidal indole compound is 3,3-diindolylmethane.

3. The method of claim 1, wherein said insecticidal indole compound is 3-((1H-indol-2-yl)methyl)-1H-indole.

4. The method of claim 1, wherein said insect is a lepidopteran or dipteran.

5. The method of claim 1, wherein said insect is from the family Culicidae, Noctuidae, Tortricidae, Crambidae, or Erebidae.

6. The method of claim 1, wherein said insect is from the genus *Aedes*.

7. The method of claim 1, wherein said insect is from the genus *Culex, Anopheles, Trichoplusia, Spodoptera*, or *Chloridea*.

8. The method of claim 1, wherein said insect is *Ae. aegpyti, Anopheles quadrimaculatus, C. quinquefasciatus, H. viriscens, T. ni, S. exigua, C. includens, H. zea, S. eridania, S. frugiperda, D. saccharalis, D. grandiosella*, or *A. gemmetalis*.

9. The method of claim 1, wherein the insect is an insect larva, an insect pupa, and/or an insect adult.

10. The method of claim 1, further comprising surveying for a presence of an insect that is inhibited by the composition comprising the insecticidal indole compound.

11. The method of claim 1, further comprising spraying a composition comprising the insecticidal indole compound.

12. The method of claim 1, further comprising surveying a plant for insect damage.

13. The method of claim 1, wherein the insecticidal compound contacts the insect at a concentration of 0.001-1000 µg/mL.

14. A method of killing an insect, said method comprising:
    producing a culture comprising a microbial organism that is PLU6;
    isolating an insecticidal indole compound from said culture; and
    contacting an insect with a composition comprising the insecticidal indole compound, wherein said insecticidal indole compound is a diindolylalkyl compound.

15. A method of killing an insect egg, said method comprising contacting an insect egg with a composition comprising an insecticidal indole compound, wherein said insecticidal indole compound is a diindolylalkyl compound.

* * * * *